United States Patent 11,098,302 (IDENTIFICATION OF POLYNUCLEOTIDES ASSOCIATED WITH A SAMPLE) - sequence listing, part 25

SEQ ID NO: 82835 - DNA, 550 bp, Homo sapiens
  misc_feature: GYAE6OF02G4P6C.22.57.F02.1.454.CMB.1.raw
  modified_base (198)..(198): a, c, t, g, unknown or other
  misc_feature (198)..(198): n is a, c, g, or t
  modified_base (247)..(247): a, c, t, g, unknown or other
  misc_feature (247)..(247): n is a, c, g, or t
  modified_base (250)..(250): a, c, t, g, unknown or other
  misc_feature (250)..(250): n is a, c, g, or t
  modified_base (272)..(272): a, c, t, g, unknown or other
  misc_feature (272)..(272): n is a, c, g, or t
  modified_base (280)..(280): a, c, t, g, unknown or other
  misc_feature (280)..(280): n is a, c, g, or t
  modified_base (352)..(352): a, c, t, g, unknown or other
  misc_feature (352)..(352): n is a, c, g, or t
  modified_base (355)..(355): a, c, t, g, unknown or other
  misc_feature (355)..(355): n is a, c, g, or t
  modified_base (357)..(357): a, c, t, g, unknown or other
  misc_feature (357)..(357): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcattctgtagganacagagtcaccatcacttgcgggccagtcagatatagtgtgtgctgatnagnagaacaggaacgcctatactcngactccanaggctactattagaagtcgggccatacagtcagcgacagtgatcgtaggacagtatcactctcactatcaanacncngacacgctgatgtattaggacctaacgttacacgtacgacctaacgtacttacgtactttacgtccgttactaccgttccggaccgtaaccggacgtaccgtacgtgggtaacgaacgtttaaaccggagttaccggtagtacgttaccgaccgtaaccgtcgtttaccgtcgttaccttacctacttccccg

SEQ ID NO: 82836 - DNA, 763 bp, Homo sapiens
  misc_feature: GYAE6OF02GE6SR.22.57.F02.1.454.CMB.1.raw
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatcgacccagtcctccttccaccctggctgctatcgtagtaggagacagacgtccacctatctacgttggtccgggccaaggtacaagtaaattagttaagttaggtttaggttggcccttaggtactcgaagtaccgaacggaaaccgaacgggaaaccgtcccccttaagtaccctacctaggtaacctacccgaaccggtaacgggtaccgtttaccgttaaacgttttaagggaaaacgggtttccggggtaccctaagttaccggtaacggttacgacggccggtactacgtggtactggtacgggaactacgtaactccaccgtctaccgaactacgtaccgaactaccgtaccgtcgaccgtacgtaccgtgtaacgttgttaacggttcgtaaccttaaactttaccgtaccgttaccgaacccgttaaccgttacgttaacgttaaccgtttacgttcccgttaccgttacccgttaccggaaccgtaacgggaacctaacggaccgttacggtaacgtaaccgttaaacggtacgttggtacgtaccgtaccgaccgtactaacgttcgttaccgttccgttacctaccgttcccg

SEQ ID NO: 82837 - DNA, 571 bp, Homo sapiens
  misc_feature: GYAE6OF02JD1U4.22.57.F02.1.454.CMB.1.raw
  modified_base (275)..(275): a, c, t, g, unknown or other
  misc_feature (275)..(275): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaancccctaatactcctgatccacaaggctctactttagaaagtgggtccatcaaggttcagcgcactggatcgtgggacagaattcacttcgtcaccatccaacagcctgacagcctgatgatttggactaacttactactgacctaaccgtatacgttacttaagtttccggtactaccgtttacgggacctaagggaacctacgaaccgtcgggaagtaacgttaaaaccggtacttaggtacgggtactacggacctaaccggtacttccttacgtcctttacgaactttccccg

SEQ ID NO: 82838 - DNA, 695 bp, Homo sapiens
  misc_feature: GYAE6OF02I55O2.22.57.F02.1.454.CMB.1.raw
  modified_base (106)..(106): a, c, t, g, unknown or other
  misc_feature (106)..(106): n is a, c, g, or t
  modified_base (131)..(131): a, c, t, g, unknown or other
  misc_feature (131)..(131): n is a, c, g, or t
tcagacatacgcgtcacgaccggtgctcgatttagctcgatatagttggggtttgggggagtcgagacccagtctaggacacagcatgggacatgagggtccccgntctagctcctgggctcctgctgctntggctcctaggtgccaagtgtgacattccagagtcggaccctagtcctaccttccaccctggctgcatctgtaggagacagagtcaccatcacttggtcgggccagtcaagtatattaatgttggtgcctggtatcagcaagaaaccgagggaaacgcccctatacctccgtagactaccacgaacggtctacttactttaaggaaaggttcggggtacccagtaccgtaaggttcgaggtccggacacgtggtactcggtagggaactaaggtaacttctaaccttcctaaccgtacctaactaccgaaacgtacgaccgttcggaccaacgggtcccttaaggtacgttacgttaacggtttccggtaaaccttaaacgtttacctaaccgttacgtaaccccgttaaacgtacgttaacgtttaacctttacgtttaccggtaccttaaccggttccggaacgtaaccgggctaacgacgtagtaacgtaaagttaaaccggtaagtcggtacgtaccgtacgacctaactcgttagttacgttcgttactcgtttacccg

SEQ ID NO: 82839 - DNA, 593 bp, Homo sapiens
  misc_feature: GYAE6OF02F2BSC.22.57.F02.1.454.CMB.1.raw
  modified_base (275)..(275): a, c, t, g, unknown or other
  misc_feature (275)..(275): n is a, c, g, or t
  modified_base (340)..(340): a, c, t, g, unknown or other
  misc_feature (340)..(340): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtcctccttccaccctggctgcatctgtaggagacagagtcaccatcacttgcggccagtcagaatattaatagttggttggcctggtatcagcagaaaccagggaaacncccctatactcctgatccacaggctctacgttagaaagtcggggtaccatcaaggttcagccggnacgtggatcgtgggacaggaattcactctacaccataccaactcgcctgacctacgccctagactaggtactttcggaccttaaacttactactacgaccctaaacgtattaacgttacttagttccgtacctaccggtttcggaaccgtaacggacctaacgacgtagggtaacgtaagttaaaccggaacgttaggtcggaacttcggaaccctaccgtacgttccgttcgttcctttacgactttccccg

SEQ ID NO: 82840 - DNA, 695 bp, Homo sapiens
  misc_feature: GYAE6OF02HVZXR.22.57.F02.1.454.CMB.1.raw
  modified_base (221)..(221): a, c, t, g, unknown or other
  misc_feature (221)..(221): n is a, c, g, or t
  modified_base (309)..(309): a, c, t, g, unknown or other
  misc_feature (309)..(309): n is a, c, g, or t
tcagacatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatcgacccagtcctccttccaccctggcctgcatctgtagganacagagtcaccatctacttgtccggccagtcaagtaatattaataggttggttggcctggtatcgagacaagaaaccgacgggaaacncccctaagttaaccttcctagacctaccgaactacgggaccgttacctttaacgtttaaggtaaacggtttccgggtttaccccaatttacgtaaacggtttaccgaacgggtaccggtacctaacgttcgggtactaccggttagggaacctaaggttaacgttccaaccgttcctaccaacccgaacttaccgaaacccgtacgtcccgtagtacccgaccgtcccgttagaacgttagttacgtttacggtactaaccgtttacctacgtcctaccgtaaacgttactaacgtttacttacgttaccgttaccgtcccgttacggtacgaacggtacctacgtacgtacggacttaaacgttaaacggtactcggtaggtacc

SEQ ID NO: 82841 - DNA, 784 bp, Homo sapiens
  misc_feature: GYAE6OF02G6H98.22.57.F02.1.454.CMB.1.raw
  modified_base (198)..(198): a, c, t, g, unknown or other
  misc_feature (198)..(198): n is a, c, g, or t
  modified_base (277)..(277): a, c, t, g, unknown or other
  misc_feature (277)..(277): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatcgacccagtctccttccaccctggctgcatctgtagganacagacgtcaccatcacttgcgggccagtcaagaatattaatgttggttgcctggtatcagcaagaaaccgaggaaacnccctaatacctcctagactacccaagaacggccgttaccgttaacgtttaacgaaacgggttcggggttaccccagttaccgtaaaggttcgaacggtccggtacacgttgggactcgtacggggaacctaaggtaaactttcccgaaaccttcctacccgtaaaccctacgttacccaaaccgtaacgtcccctaggtacctaacggcccgttaggtaacttacgttaccgtttacgggtaacccttaaaaccgttttaccgtaaccgttccggtaaaccctaaaccggtttaacgtttaacggtttaaccttttaaccggtttacccgggttacccgttaaacccggtttacccgggtaaacccgtaaaccggggtaacctaaaccggttaaccgtagggtaaccgttaaaccgttaaaaccgggtaaccgttacgggtaacgggttacctacgtaacccgtaacgtacgtttaccgttccgttactttcccgtactttcccccg

SEQ ID NO: 82842 - DNA, 655 bp, Homo sapiens
  misc_feature: GYAE6OF02HUW5A.22.57.F02.1.454.CMB.1.raw
  modified_base (304)..(304): a, c, t, g, unknown or other
  misc_feature (304)..(304): n is a, c, g, or t
  modified_base (649)..(649): a, c, t, g, unknown or other
  misc_feature (649)..(649): n is a, c, g, or t
tcagacatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtcctccttcccaccctggctgcatctgtaggagacagatccaccatcacttgtcggccagtcagaatattaatgttggttcggctggtatcgagcgaacgaaaccgaacgggaaacncccctatacctcctagactccaacgaacggtcttacttaacgttagaaacgggttcgggtaccctagtacgtaaacggttcaggcgacgtacgtcggtaacgtcgtacggggactaacggtaacttccaaccgttacctacccgaacccgtaactacccgaaaccgtacgtccgtacgtaccgtaacggcccttaaggagtttacggttaagtttcggaaccttaacgtttaaccgttaccgtacgtaccctaaacggttacttaacgtttacttacgttccgttaccctacgttaccggaccgaacggacgacgtacgacggtaactacgttaaacgacgttgngtaccg

SEQ ID NO: 82843 - DNA, 534 bp, Homo sapiens
  misc_feature: GYAE6OF02GVA1T.22.57.F02.1.454.CMB.1.raw
  modified_base (248)..(248): a, c, t, g, unknown or other
  misc_feature (248)..(248): n is a, c, g, or t
  modified_base (268)..(268): a, c, t, g, unknown or other
  misc_feature (268)..(268): n is a, c, g, or t
  modified_base (394)..(394): a, c, t, g, unknown or other
  misc_feature (394)..(394): n is a, c, g, or t
  modified_base (396)..(396): a, c, t, g, unknown or other
  misc_feature (396)..(396): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctccaggtgccaagtgtgacatccagatcgacccagtctccttccaccctggctgcatctgtaggagacagagtcaccatcacttggccggcagtcagaatataatgttgtgctgtancagcaagaaccgagggaacncccctatacctctgactccaacgaggccgttactaacgtttacgaaaggttcggggtaccagtacgaaaggttcgagcggactacgtggatcgtgggacaagtaactcactctacactactcaacncnctgcagctgatgtattggactaacttactactcgaaccctacgtaattacgtatttactcggtactacgttcgaccgtaaggcaacgacgagacgtactaacggatcggtgcgtagcactatctcgtcttcactcccg

SEQ ID NO: 82844 - DNA, 602 bp, Homo sapiens
  misc_feature: GYAE6OF02H9HGN.22.57.F02.1.454.CMB.1.raw
  modified_base (102)..(102): a, c, t, g, unknown or other
  misc_feature (102)..(102): n is a, c, g, or t
tcagacatacgcgtcacgaccggtgctcgatttagctcgatatagttgggtttgggggagtcagacccagtcaggacacagcatggacatgagggtccccgntcagctcctggggctcctgctgctctggctcccaggtgcctaagtgtgacatccagatgacccagtctccttccacctggctgcatctgtaggacgacagacgtcacatcacttgtcggcagtcagaatatatagttgtgctgtatcgagcaagaacgaggaacgaccctatactcctgactccaacacggtctactacgttaggaaagtcgggacctatcgtaaggttcagcgctacgtggactcgtaggacagtatcactcacactactacaacacgccgtagacacgtctagtacgtacgtagtttacggaacttaactttacgtaactccgtaacctaaacggttaacttaacgttaaccttttaacgttccgtaccgttacccgttacggaaccggtaacggaccacgtaacgtgaacgttaaacgttaaccgtaacgttaggtacggacctacggacctaccgtactcgttcgttaccttaccgtattaccccg

SEQ ID NO: 82845 - DNA, 599 bp, Homo sapiens
  misc_feature: GYAE6OF02HVV8X.22.57.F02.1.454.CMB.1.raw
  modified_base (276)..(276): a, c, t, g, unknown or other
  misc_feature (276)..(276): n is a, c, g, or t
tcagacatacgcgtcacgaccggtgctcgatttagctcgatatagttgggtttgggggagtcagacccagtcaggacacagcatggacatgagggtccccgctcagctcctgggctcctgctgctctggctcccaggtgccaagtgtgacatccagatgacccagtctccttccaccctggctgcatctgtaggagacagagtcaccatccacttgcgggccagtcagaatattaatagttggttggcctggtatcgagcagaaaccagggaaacncccctatacctcctgactccacaggctctactttagaaagtcgggtccatcgaaggttcagcggcacgtggactcgtaggacagtattcacttcaccaccatacaacacgcctgacacgctgactgtatttcgacttaactttactactcgaacctaacgtatacgttacttacttccggtactaccgttcggaccgtaacgggactacgacgtaggtaacgtaacgttaaaaccggtacgttacggttacggaccttacggtaacccttaacccgtaacgttcccgttccggtttaccctttaccgtacccgtttacccccg

SEQ ID NO: 82846 - DNA, 549 bp, Homo sapiens
  misc_feature: GYAE6OF02HDS4Q.22.57.F02.1.454.CMB.1.raw
tcagacatacgcgtcacgaccggtgctcgatttagctcgatatagttggggtttggggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcgggccagtcagaatataatagttgttaggcctggtatcagacagaaaccaagggaaacaccccgtaatacctacctgactaccacaaggcgtactaactttaagaaaggtaggggtcccagtcaaggttcagcggcactgatcgtgggacaggtaattcactctacacactacaacagctagcagactgatgatttggactaattactactgaccctaacgtatagtacttattcgtctaccttcggacgaaggactacgacgtagaacgtacttaaacgtaactgtacgggactcgacaacctagtaccttggtacttactacttcccg

SEQ ID NO: 82847 - DNA, 733 bp, Homo sapiens
  misc_feature: GYAE6OF02F8Y1U.22.57.F02.1.454.CMB.1.raw
  modified_base (199)..(199): a, c, t, g, unknown or other
  misc_feature (199)..(199): n is a, c, g, or t
  modified_base (270)..(270): a, c, t, g, unknown or other
  misc_feature (270)..(270): n is a, c, g, or t
tcagacatacgcgtcacgaccggtgctcgatttagctcgatatagttgggtttgggggagtcagacccagtcaggacacagcatggacatgagggtccccgctcagctccgtggggctcctgctgctctggctcccaggtgccaagtgtgacatccagatgacccagtcctccttccaccctggctgcatctgtagganacagagtcaccatcacttgcggcagtcagaatatatgttgtggctggtatcagacagaaacgagggaaacnccctaatactcctgactaccaacgtaacggcgtacttaacgtttaaggaaacggttcggggtacccctaagttaccgtaaaggtttcgaacggtccggaccgtaacggttagggtaacgttcggtacggggaactaaggtaaacgttacctaaccgttccgtaaccaacccgtaactaccaaacgaccgtcccgttagacccgtagtcccgtaggtaacgttagtaacggttacgtaaccttaaactttacccttaaccgtccgtaacccgtaaaccgttaacttaacgttaacctttacgtttacccgtaccgttaacccgttccggaacccgtaaacggaccgtaacgtaacggtacggtagtaaacggttaaaccgtaaacggtaacggttacgggtaccggtacgtaccggtaacctaaccgtaccgtttacgtcccggtttacctaccgtttaccccg

SEQ ID NO: 82848 - DNA, 604 bp, Homo sapiens
  misc_feature: GYAE6OF02I9GLA.22.57.F02.1.454.CMB.1.raw
  modified_base (288)..(288): a, c, t, g, unknown or other
  misc_feature (288)..(288): n is a, c, g, or t
  modified_base (361)..(361): a, c, t, g, unknown or other
  misc_feature (361)..(361): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcctatctggtaggagacagagtcaaccatctacgttcggtccggccagtcaagtaatatttaatggttggttgaccttggtatcagcaagaaccgaggaaacncccctatactctgactccaagaggtctactaactttaggaaaggtcgggtaccatacgaagttcacgcgtacncgtaggactcgtagggacagtatcacctcgtaccaccatacgaacctacgcctacgacacgtcctaggtatcggtagttcgacgttaaccttacgtacctacgtacccgtaaactagttacgttactttacgtaccgtacttaaccgtcggaaccgaagggtacacgtacgtaggtactaacgttaaaccgtatgggtacgtcgtaacgcctacgtatccgttagtccttacgtccttacccg

SEQ ID NO: 82849 - DNA, 600 bp, Homo sapiens
  misc_feature: GYAE6OF02F2CEJ.22.57.F02.1.454.CMB.1.raw
  modified_base (376)..(376): a, c, t, g, unknown or other
  misc_feature (376)..(376): n is a, c, g, or t
tcagacatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccacctggctgcatctgtaggagacagacgtcaccatcacttgtcgggccagtcagaatattaatagttggttggcctggtatcagcagaaaccgagggaaacgcccctatactcctgactccacaaggctactactttagaaagtcgggtaccatcgaaggttcagcggcacgtggatcgngggacagaattcactctcaccatacaacagcctgcagcctagtatgtagtttggaccttaacgttacctacgtacgacctaaacgtacgttaacgttaacctttacgttaccggttcctaacccggtttaccgggacccgtaaacggggtaaccctaaccgggtaaccgtacgggtaaacggttaaacgttaaaaccggtaaccgttacgggttacggtacccg

SEQ ID NO: 82850 - DNA, 629 bp, Homo sapiens
  misc_feature: GYAE6OF02GTGIJ.22.57.F02.1.454.CMB.1.raw
  modified_base (198)..(198): a, c, t, g, unknown or other
  misc_feature (198)..(198): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtcctccttccaccctggctgcatctgtagganacagagtcaccatcacttgtccgggccagtcaagtaatattaatagttggttggcctggtatcagacaagaaaccgagggaaacgcccctatacctcctagactccacgaaggcgtactaacgtttagaaacggtcggggtaccatacgtaaggttcaggcggacacgtggatcgtagggactagacttcactcacacatcaacagcctagcaacgcctagacttagtacttcggactaacgttactacgtacgaccctaacgttacgttaacgttaaccttagttaccggtaccttaccgttacggaaccgtaaacgggtacctaacgtacggttaggtaacgtaacgttaaaccggtacgttacgggtacggtacttaccgaacgtacccgttagttccgtttagtccctttacgtacgtttaccccgg

SEQ ID NO: 82851 - DNA, 577 bp, Homo sapiens
  misc_feature: GYAE6OF02JFJ1P.22.57.F02.1.454.CMB.1.raw
  modified_base (268)..(268): a, c, t, g, unknown or other
  misc_feature (268)..(268): n is a, c, g, or t
  modified_base (276)..(276): a, c, t, g, unknown or other
  misc_feature (276)..(276): n is a, c, g, or t
  modified_base (288)..(288): a, c, t, g, unknown or other
  misc_feature (288)..(288): n is a, c, g, or t
  modified_base (358)..(358): a, c, t, g, unknown or other
  misc_feature (358)..(358): n is a, c, g, or t
  modified_base (379)..(379): a, c, t, g, unknown or other
  misc_feature (379)..(379): n is a, c, g, or t
  modified_base (447)..(447): a, c, t, g, unknown or other
  misc_feature (447)..(447): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtcctccttccaccctggctgcatctgtaggagacagagtcaccatcacttcgcggccagtcagaatattaatgttggtgctgatcagcaagaacgaggaacncctatacnctagactccaanaggctacttacgtttaagaaggtcgggtcccatacgtaacggttcaggccgcacgtggattcggtagganagtaactcactctacaactanacaacctgccctgcacgccgtagattgtacgttagacctaacttacgtaactccgtaacctaacggtnttaacgttactttagttccgtacctacgttcggaaccgtaaaggcacggtactaggaacgtaacgttaacgtacgttaggacgtccgtacgaccgtaacctgttccgtcgttccttacctattacccccg

SEQ ID NO: 82852 - DNA, 794 bp, Homo sapiens
  misc_feature: GYAE6OF02I0EZQ.22.57.F02.1.454.CMB.1.raw
tcagacatacgcgtcacgaccggtgctcgatttagctcgatatagttgggtttgggaggctggtctcactttgtgcaggagtcagacccagtcaggacacagcatggacatgagggtcccccgctcagctcctggggctcctgctgctctggctcccaggtgccaagtgtgacatccagatcgacccagtcctccttccacccgtggctcgctatccgtgtaggagacagtacgtccaccatcacgttcggtcgggaccagtcaaggtaatattaagttaggttcgggtttacggccttagggttactcgaaggtacctaacggaaaaccgaaggggaaaccgtacccccttaataacccgttcctacggaacttacccgaaacgtaacgggtaccgtttaccgttaaacgttttaagggaaaaccgggtttccgggggtaaccccttaagtaaccgttaaacggggttcaacgggtacccgtacgaaaccgtcggtacgtcggttacggggaactaacggtaagtttcccgaacgtcctaccgaacctaacgtaaccctaacgaaccgtccttaacggaccgacgtcccttaagggtacttacgggttactttacgggaaccttaaaccgttaacgtaccggttaacgtacccgttaaacgttacttaaacggttaacctttacgttaccggtcccgtttaaccggttaccggtaaccggttaaacgggtacccgtacggtaacggttacggtaacgttaaacggttaacgtaacggtacgttacggtaaccg

SEQ ID NO: 82853 - DNA, 547 bp, Homo sapiens
  misc_feature: GYAE6OF02IOR0N.22.57.F02.1.454.CMB.1.raw
  modified_base (281)..(281): a, c, t, g, unknown or other
  misc_feature (281)..(281): n is a, c, g, or t
  modified_base (354)..(354): a, c, t, g, unknown or other
  misc_feature (354)..(354): n is a, c, g, or t
  modified_base (405)..(405): a, c, t, g, unknown or other
  misc_feature (405)..(405): n is a, c, g, or t
  modified_base (416)..(416): a, c, t, g, unknown or other
  misc_feature (416)..(416): n is a, c, g, or t
  modified_base (515)..(515): a, c, t, g, unknown or other
  misc_feature (515)..(515): n is a, c, g, or t
  modified_base (524)..(524): a, c, t, g, unknown or other
  misc_feature (524)..(524): n is a, c, g, or t
  modified_base (528)..(528): a, c, t, g, unknown or other
  misc_feature (528)..(528): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtcctccttccaccctggctgcatctgtaggagacagacgtccaccatccacgttggtccgggcctagtcagaatagttatgttggttgcctggatcagcaacgaaccagggaacncccctatacctctagactccaacgaggccgtactacgttagaacggccgggtccagtcgtaaggtcagcgacncgtggactcgtaggacaagtaatcgacttccacaccataccaacacgtccngacacgctagntagtagttcggacttaacgttactactacgaccctaagtattacgttacttacgttcgtactaccttcggaactacgggacacgataggataactacgngtgcgtacncgancatctgttctcgtctcccg

SEQ ID NO: 82854 - DNA, 718 bp, Homo sapiens
  misc_feature: GYAE6OF02GRG0L.22.57.F02.1.454.CMB.1.raw
tcagacatacgcgtcacgaccggtgctcgatttagctcgatatagttgggtttgggaggctggtctcactttgtgcaggagtcagacccagtcaggacacagcatggacatgagggtccccgctcagctccgtggggctcctgctgctcgtggcctcccgaggtgaccaagtgtgacatccagatcgacccagtcctccttccacccgtggctgctatcgtagtaggacgacagagtacaccatcacgttcgtccgggccagtacaagtaattaattaagtagttggttggccgtaggtatcgagacgaacgaaaaccgaagggaaaccgtaccctaatacctaccgtagaactaccgaacgtaacggtaccgtacttaaacgtttaaacggaaacgggttcggggtaaccctagttaacgaaacggttacgaacggcggacacgttaggacgttacggtacggggaactaaaggtaacttactaccttacgtaccaaacgtaactaccgtaaacgacgtaccgtacgacgacgtaccgtagtaattcgttaacgtttcggaaccttaacgtttacgtacgtaccgtaaccgtaaacgttacttaaacgttactttaccgttccgtaccgtaacccggttaccggaaccggtaacgggtaaccctaacggtacgtaacggaacgttaaacgttaaacgtaacgttacggtaggtaccg

SEQ ID NO: 82855 - DNA, 589 bp, Homo sapiens
  misc_feature: GYAE6OF02FKVZT.22.57.F02.1.454.CMB.1.raw
  modified_base (466)..(466): a, c, t, g, unknown or other
  misc_feature (466)..(466): n is a, c, g, or t
  modified_base (480)..(480): a, c, t, g, unknown or other
  misc_feature (480)..(480): n is a, c, g, or t
  modified_base (507)..(507): a, c, t, g, unknown or other
  misc_feature (507)..(507): n is a, c, g, or t
tcagacatacgcgtcacgaccggtgctcgatttagctcgatatagttgggtttgggaggctggtctcactttgtgcaggagtcagacccagtcaggacacagcatggacatgagggtcccccgctcagctcctggggctcctgctgctctggcctcccaggtgccaagtgtgacatccagatcgacccagtctcccttccaccctggctgcatctggtaggagacgagagtccaccatcctacgttggccggccagtcaagaattattaagtaggttggttggtcctggtactcgagacgaagaaaccgaagggaaaccgtcccctagtacctccgtgactaccgaacgaacggtccgtacttaacgttaaggtaaacggttcggggtaccctagtacgtaacggttacacggccggactacgtgtactcggagggaactagtactacctactctcaacataccanaccgactgcgtacncgtagtactagtcttgacctacttacnctcgacctactattacgtcttagttccgtactaccgtcgactacggacacgtacgtacgacgtaagaacgtacgtcgtgtcg

SEQ ID NO: 82856 - DNA, 736 bp, Homo sapiens
  misc_feature: GYAE6OF02GJ35M.22.57.F02.1.454.CMB.1.raw
  modified_base (225)..(225): a, c, t, g, unknown or other
  misc_feature (225)..(225): n is a, c, g, or t
tcagacatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccgaggtcgccaagtgtgacatccagatcgaccctagtcctccttccacccgtggctgcattctgtagganacagtacgtcacatctacgttggtccggacctagtcgaagtaaattaagttaagttaggtttcggttaggccgtaggtactcgaggacgaaaacggaaaaccggaacgggtaaaaccgtccccttaagtaccgtaccgtagtaacctacccgaacgtaacgggttaccgtacgtttaacgttaaacggtaacggggttccgggaccctaagtaaccgttaacggttaccgaacgggtccgactaaccggttacggtagtaccgggtacgggaacaaacggtttaccgtaccctaccgttacccgttaaccgtaccctaacgttaccaaaccgtaccgtcccgtaagtacccacgtaccgtagtaggtttacgttaacggtttcgaaaccttaaccgttaccgtaccgtaactaccgtaacctagttaacttaccgttacgttccgtactaccggtacggaccacggtaactcgtaacgtaggtaacgtaaacgttaacgcgtaggtcgtac

SEQ ID NO: 82857 - DNA, 663 bp, Homo sapiens
  misc_feature: GYAE6OF02I5AYV.22.57.F02.1.454.CMB.1.raw
  modified_base (331)..(331): a, c, t, g, unknown or other
  misc_feature (331)..(331): n is a, c, g, or t
  modified_base (442)..(442): a, c, t, g, unknown or other
  misc_feature (442)..(442): n is a, c, g, or t
  modified_base (451)..(451): a, c, t, g, unknown or other
  misc_feature (451)..(451): n is a, c, g, or t
  modified_base (495)..(495): a, c, t, g, unknown or other
  misc_feature (495)..(495): n is a, c, g, or t
  modified_base (511)..(511): a, c, t, g, unknown or other
  misc_feature (511)..(511): n is a, c, g, or t
  modified_base (516)..(516): a, c, t, g, unknown or other
  misc_feature (516)..(516): n is a, c, g, or t
  modified_base (535)..(535): a, c, t, g, unknown or other
  misc_feature (535)..(535): n is a, c, g, or t
  modified_base (648)..(648): a, c, t, g, unknown or other
  misc_feature (648)..(648): n is a, c, g, or t
  modified_base (657)..(657): a, c, t, g, unknown or other
  misc_feature (657)..(657): n is a, c, g, or t
tcagacatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtagacactccagatcgacccagtcctcccttccacccgtggctgctatcctaggtagacgacgagacgtacaccatactacgttggtccgggccgagtccaagtaatatttaataggttggttcgcgttgtactcagtcaacggaaaccgtaacgggaaaccnccccgttaactaccttccgacgtaccgtacctaacgaacggttccgtacttaaccgtttaaagaacggttccggggtaccctactacgtaaagggtttcaacggccgtacncgtacggtntaccggtaggaacctagttactacgtactcgttaccaaccttanaccgtaacgccgtacngaccnctacgtagctttaagggtntttacggaccttaacgtactactacgtaccctaagttagtaccttagttaccgtcgttaaccgtcccgttcggaactaacgggacctacgttacgaggtacgtaaccgtaaancggtacgtntaacgg

SEQ ID NO: 82858 - DNA, 562 bp, Homo sapiens
  misc_feature: GYAE6OF02FYMXH.22.57.F02.1.454.CMB.1.raw
  modified_base (555)..(555): a, c, t, g, unknown or other
  misc_feature (555)..(555): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcgggccagtcagaatattaatagttggttggcctggtatcagcagaaaccagggaaacgcccctatactcctgatccacaaggcgtctactttagaaagtgggtccatcaaggttcagcgtcactggatcgtgggacagaattcactctcaccatacaacacgcctgacagcctgattgtatttcggactaaactttactacgtcgaccctaacgttatacgttactttacttccggtacctaccgttcggtacgtaagggaccacggacgtagggacgtaagttaaacggaacgttaggtacggtacctagaccacctattaccgttagttccttacnttccccg

SEQ ID NO: 82859 - DNA, 640 bp, Homo sapiens
  misc_feature: GYAE6OF02GORZY.22.57.F02.1.454.CMB.1.raw
  modified_base (390)..(390): a, c, t, g, unknown or other
  misc_feature (390)..(390): n is a, c, g, or t
  modified_base (421)..(421): a, c, t, g, unknown or other
  misc_feature (421)..(421): n is a, c, g, or t
tcagacatacgcgtcacgaccggtgctcgatttagctcgatatagttgggtttgggggagtcagacccagtcaggacacagcatggacatgagggtccccgctcagctcctgggctcctgctgctctggctcccaggtgccaagtgtgacatccagatgacccagtctccttccaccctggctgcatctgtaggagacagagtcaccatcacgttgtcgggccagtcagaatattaatagttggttggcctggtatcagcaagaaaccgagggaacgcccctatacctcctgactccacgaacggtcgtacttaacgtttaaggaaacgggtcggggtaccctagtacgtaacgggttcacggcggccgtacgtgggactcggtacgganacgtaattcactctccaactaactacaaccncgtccctagaccgcgtaccgtagagttacgtatttcggaccttaacgttactacgtacgacctaaacgttataacgttacgttagttaccggtacctaccggttccggaccgtaacggaccgtaacgacgttacggacgttaacgttaaaccggtaggttcgaggtcccttaggacccttaaccgtgttaccgttacggttccttacgtaccgttcccc

SEQ ID NO: 82860 - DNA, 876 bp, Homo sapiens
  misc_feature: GYAE6OF02FLAUH.22.57.F02.1.454.CMB.1.raw
  modified_base (202)..(202): a, c, t, g, unknown or other
  misc_feature (202)..(202): n is a, c, g, or t
tcagacatacgcgtcacgaccggtgctcgatttagctcgatatagttggggtttgggggagtcagacccagtcaggacacagcatggacatgagggtccccgctcagctcctggggctcctgctgctctggctcccaggtcgccaagtgtgacatccacatgacccagtcctccttccacccgtggctgctatcgtgtaggngacagagtccacactcctacttggtccgggccgtagttcgaagtaattaagtttaacttaggtttcgggttacggcccgttgggttacttacgacgaccgtaacggaaaaccgaacggggaaaccgtccccccgtttaacgttaacctcccgttaggtaacctacccaacgggggtaacggtccgttacctttaaacgttttaacgggaaaacggtttccggggggttaccctaacgttaccggttaacgggttaccgtaacggccgggtaccttaacgggttcgggtaaccttaccgggtaacggggtaacgaaacggttaacgtttaccctaaaccggtttcccttaacccgtaacccgttaacctaacccgtaaaccggaaccggttccccgtacgggtaaccccgacggttcccgttaaaggtaccgtttaacggttaacgtttaccggtaacgttaaaaccctttaccgtaaccttacgggaaccccttaaaccggttaacgtttaacgttaccgtttaccgtttaccggtaccttacccggttccgggaaccgtaacgggaccctaacgtaccggttacggtaccgtaaacgttaaccggaacgtcgggttacggtctaccgtaccgtacctacggttccgttacggttccttacgtacctttacccg

SEQ ID NO: 82861 - DNA, 834 bp, Homo sapiens
  misc_feature: GYAE6OF02IFA5O.22.57.F02.1.454.CMB.1.raw
tcagacatacgcgtcacgaccggtgctcgatttagctcgatatagttgggtttgggaggctggtctcactttgtgcaggagtcagaccccagtcaggacacagtatggacatgagggtccccgctcagctccgtggggctcctgctgctctggctcccaggtcgccaagtgtgacatccagatcgacccagtccttcccttaccacccgtggcttcgctatcctaggtaggaacgacagacgtacacctatcaccgttgtccgggcctaggtcaagtaacttaatttaaagttacggtttgggttacggtcccgttagggttacttacgacggtaccgaaacggtaaaaccggtaaacggggtaaacctacccccgttaaagttacccgtacgttaccggaactccccgtaaacgaaacggttccgttaacgtaaccgttttaaacgggaaacgggttccggggtaaccctaaggttaaccaacgggtttaccgaaggttacccgggacctaacggttacgggtaccgtccggtaacggggtaacgtaacggtaatttacccgtaacctaccctaacctaaccgtacgtaacctaaccgacggtcctaacgtcgaccgtccgtaaggtatttaccgggtgtttaacgtaacccgttaacctttaacgtaccttacccgtaaccgttaaccggtaacgtttaacgttaacccgtttttgacccggtttaccgtaaccccgtttcggggtaaaccctaacggggtaccttaacggaacgttaaggtaaccgttaaaacggtttaacctacgggttaggtcccggttactaacccgg

SEQ ID NO: 82862 - DNA, 680 bp, Homo sapiens
  misc_feature: GYAE6OF02GJ9AE.22.57.F02.1.454.CMB.1.raw
  modified_base (197)..(197): a, c, t, g, unknown or other
  misc_feature (197)..(197): n is a, c, g, or t
  modified_base (293)..(293): a, c, t, g, unknown or other
  misc_feature (293)..(293): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtagganacagagtcaccatcacttgcgggccagtcagaatattaatagttggtgcctggtatcagcagaaaccagggaaacgcccctatactcctgatccanaaggcgtactactttagaaagttgggtcccatacaaggttcagtcgactactggactcgtggaacagtaacttcgaccttctaccaacctataccaaaccgtacgccctagccaacgcccttagaagttcgtaagttttccgggaaccttaaaccttaccttaaccgtacgtaaccccgtaaaccgtttaacgttaacgtttaaccttttaacgtttacccgggttaccctttaacccggtttacccgggaacccgttaaaacggggacccgtaacggtaacgtcgggtaaacgtaacgtttaaaaccggaacgttcggttacgggtctaaccggtacctacccgtagtttacccgttagtttacccgttaccgtactttacccccg

SEQ ID NO: 82863 - DNA, 651 bp, Homo sapiens
  misc_feature: GYAE6OF02IKOBR.22.57.F02.1.454.CMB.1.raw
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtcctccttccaccctggctgcatctgtaggagacagagtcaccatcacttgtcgggccagtcagtaatattaatagttggttgcctggtatcagcaagaaaccgagggaaacgcccctatacctccgtagactccaacgagggtcctaccgtttaacgtttaaggaaacggttcggggtacccctaagttaccgtaaaggtttccaggtccggactacgttaggacttcgtgggaacctagtaactttcactcctacgaacccactacaaacacgaccgtcgaccaacgtcctacggtactaggttactttagggaccttaaacctttactacgtccgaacccgtaaccgtattaacgttactttacggtttccgtccttaccgttcgaaccgtaacgggacaaccggtactagaacgtacttaaacgacgtagtacggtcctacgtccaccgtactcgttacggttaccttacgtacttccccg

SEQ ID NO: 82864 - DNA, 766 bp, Homo sapiens
  misc_feature: GYAE6OF02JCWZ3.22.57.F02.1.454.CMB.1.raw
  modified_base (216)..(216): a, c, t, g, unknown or other
  misc_feature (216)..(216): n is a, c, g, or t
  modified_base (229)..(229): a, c, t, g, unknown or other
  misc_feature (229)..(229): n is a, c, g, or t
tcagacatacgcgtcacgaccggtgctcgatttagctcgatatagttgggtttgggaggctggtctcactttgtgcaggagtcagacccagtcaggacacagcatggacatgagggtcccgctcagctcctgggctcctgctgctctggctccaggtcgaccaagtgtgacatccagatcgacccagtcctccttccacctgctgcatctgagganacagagtcacctntactacgttgtccggactagtactaagtaattattaagttaggttcggttacggaccttaggtactacgacggacctaaacggaaaaccgaacgggaaacctccccttaagtaacccgtccgtacgacctacccgaagtaacggtccgttacttaacgttaaggtaacgggttccgggtacctagttaaccgtagggttcaacggtccggtactaaccggttacggtacgttcggtaacggggtaactaacggttacctaccgtaacctccgttaaccaactaacttaaccgaaccgtaccgtacccgttaggacccgttaccgtccgtagttacgttacgttaacggtttccggaaccttaaaccgtttacctaccgttaacccgaacccggttaactttaaagtaaccgttttaaccgtttaccggtaccggttacctaacccgggtttccggtaaccggaaacgggttaccaaccggttacggtaacggttaacgtaaaaccggtttaaaccgcggtttcggttacggacccgg

SEQ ID NO: 82865 - DNA, 865 bp, Homo sapiens
  misc_feature: GYAE6OF02FH99L.22.57.F02.1.454.CMB.1.raw
  modified_base (102)..(102): a, c, t, g, unknown or other
  misc_feature (102)..(102): n is a, c, g, or t
  modified_base (216)..(216): a, c, t, g, unknown or other
  misc_feature (216)..(216): n is a, c, g, or t
tcagacatacgcgtcacgaccggtgctcgatttagctcgatatagttggggtttgggggagtcagacccagtcaggacacagcatggacatgagggtccccnctcagctcctgggctcctgctgctctggctcccaggtgccaagtgtgacatccagatcgacccagtcctccttccgacctggctgcatctaggtagacgacagagtccaacctntcctacgtttcggtaccgggacctaggttaccaaaggtaaacttttaagtttaaagtttagggttttcgggtttaacgggtcccgtttagggttaacttaccgacggaccgaaaacgggtaaaaaccccgaagggggtaaaaccgtacccccctttaactaacccgttacccttaggtaaccttaccccgaacgtaaacgggttccgttaacctttaacggtttttaaaacggaaaacgggtttccgggggttaaccccaacggtttaacccggtaaacgggtttacgaaccgggtccggtaaccgtaccgttagggtacctttaccggggtacgggtaaaccgtaacggttaaaccgttttccctaaaccgtttccctaacccgtaacctaccgtaaccgaaaccgtacccggacccgttacggaaccctaaccggtccgttaacggtaacgttaggttacgtttacggtacctaaacgtttacgttaacctacgtacctaaacgtactttaacgttaaccttagtttccgtaccttacccggtaccgaaccggtaaacggacgtaccgaacgttacgggaactaacgtaaacggtcgtaggtacgactacgactacgtcgttacgttctacttacctcgttaccccg

SEQ ID NO: 82866 - DNA, 628 bp, Homo sapiens
  misc_feature: GYAE6OF02GATAP.22.57.F02.1.454.CMB.1.raw
  modified_base (162)..(162): a, c, t, g, unknown or other
  misc_feature (162)..(162): n is a, c, g, or t
  modified_base (482)..(482): a, c, t, g, unknown or other
  misc_feature (482)..(482): n is a, c, g, or t
  modified_base (489)..(489): a, c, t, g, unknown or other
  misc_feature (489)..(489): n is a, c, g, or t
  modified_base (494)..(494): a, c, t, g, unknown or other
  misc_feature (494)..(494): n is a, c, g, or t
  modified_base (499)..(499): a, c, t, g, unknown or other
  misc_feature (499)..(499): n is a, c, g, or t
  modified_base (529)..(529): a, c, t, g, unknown or other
  misc_feature (529)..(529): n is a, c, g, or t
tcagacatacgcgtcacgaccggtgctcgatttagctcgatatagttgggtttgggaggctggtctcactttgtgcaggagtcagaccccagtcaggacacagcatggacatgagggtccccgctcagctcctggggctcctgctgctctggctcccaggtnccaagtgtagacatccagatcgacccagtcctccttccaccctggctgcatctagtagagacagagtcaccatctacgttgtccgggaccagtcaagtaaacttagttaacgtaggtttgggttcggtccgttaggtactccgagaccgaaacggaaaacccgaaggggtaaaccgcccccttaaactaccgtcccgtagtactaccgaacgaacggtcctacttacgtttaaggaaaggttccggggtacccatacgtaacggttcgacggtcgctacgtggtactcgtaggacaagtaatccactcacaccataccanacgtctncgacnccgtnagtgttattacggacttacgtatccgttanacccgtaacttagtacttaccgttacttccgtaccgttaccgtacggaccgaacggtacaacggtatacggtagtaaccgtaagacgtttcggacgtcg

SEQ ID NO: 82867 - DNA, 590 bp, Homo sapiens
  misc_feature: GYAE6OF02GVS36.22.57.F02.1.454.CMB.1.raw
  modified_base (142)..(142): a, c, t, g, unknown or other
  misc_feature (142)..(142): n is a, c, g, or t
  modified_base (168)..(168): a, c, t, g, unknown or other
  misc_feature (168)..(168): n is a, c, g, or t
  modified_base (197)..(197): a, c, t, g, unknown or other
  misc_feature (197)..(197): n is a, c, g, or t
  modified_base (409)..(409): a, c, t, g, unknown or other
  misc_feature (409)..(409): n is a, c, g, or t
  modified_base (581)..(581): a, c, t, g, unknown or other
  misc_feature (581)..(581): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggcctcccaggtcnccaagtgtgacatccagatcgacccngtctcctccacctggctgcatctggaganacagtactcaaccatcacgttgccgggaccagtcaagaatattaagtgttggttgccttggtatcagacaagaaaccgaagggaacctacccgtatacctcgtagactaccaacgaggtcctacttacgttaaggaaggttcgggtaccagtacgtacggtcgagcgacacgtggatcgtaggacagtactcgactctaccacactacaacnctccgtagctacgtctgagtagtagttacgacttaacttacgtactcgaacccgtactagtacttacgttacgtccgtacttacccgtcggaaccgtaggaccaagtcgtaaggtataacgtaacggctaggtacgtcgtacgacctacgttcttaccgtcttacgttaccncgttacccg

SEQ ID NO: 82868 - DNA, 602 bp, Homo sapiens
  misc_feature: GYAE6OF02G69CM.22.57.F02.1.454.CMB.1.raw
  modified_base (162)..(162): a, c, t, g, unknown or other
  misc_feature (162)..(162): n is a, c, g, or t
  modified_base (293)..(293): a, c, t, g, unknown or other
  misc_feature (293)..(293): n is a, c, g, or t
  modified_base (304)..(304): a, c, t, g, unknown or other
  misc_feature (304)..(304): n is a, c, g, or t
  modified_base (402)..(402): a, c, t, g, unknown or other
  misc_feature (402)..(402): n is a, c, g, or t
tcagacatacgcgtcacgaccggtgctcgatttagctcgatatagttgggtttgggaggctggtctcactttgtgcaggagtcagacccagtcaggacacagcatggacatgagggtcccccgctcagctcctggggctcctgctgctctggctcccaggtnccaagtgtgacatccagatgacccagtctccttccacctggctgcatctgtaggagacagatcacatcacgttgtcggccagtcagtaatattaatagttggtgcctgtatcagacaagaacagggaaacncccctataccnctgactccagacgctactacgttaagaacggtgggtaccagtacgtaaggttcaggtcgactacgtggatcgtagggaactagtacttaccacttacnccacctaactaccgaaactcggtacctgaccctagtccctagcttaggtatttcggaactacgttactaccgtacgacccgttaaccgtaagttaacgttaccttaggtttcccgtaactcccggttaacggaccgtaacgggtaccctacggtaaccgtagggaacgtttaaacgtaaccggtacgtagttggtaaccg

SEQ ID NO: 82869 - DNA, 589 bp, Homo sapiens
  misc_feature: GYAE6OF02IMIQK.22.57.F02.1.454.CMB.1.raw
  modified_base (202)..(202): a, c, t, g, unknown or other
  misc_feature (202)..(202): n is a, c, g, or t
  modified_base (585)..(585): a, c, t, g, unknown or other
  misc_feature (585)..(585): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatcgacccagtcctcccttcccacccgtggctgcatctgtagganacagacgtcaccatctacgttgtccgggccagtcagtaatattatagttggttggtcctggtatcgagacgacgaaaccgagggaaaccgtcccctatacctctagactaccacgaggtccgtacttaacgttaaggaaggtcgggtccatacgtaggtcagtcgctacgtgcgtcgtaggacagtaatcactctaccacctaactaccaacgaccgtacctcgaccacgtctagtatggtacgtttcgacttaacttactacctcgacccgtaacgttacttaagttacttacgttccgtacctaccgttacggacgtacggactacgacgacgtagtagttaacgcgtagtcgacgtacgacactgtcctacgtctacctntccc

SEQ ID NO: 82870 - DNA, 803 bp, Homo sapiens
  misc_feature: GYAE6OF02G2GHU.22.57.F02.1.454.CMB.1.raw
  modified_base (102)..(102): a, c, t, g, unknown or other
  misc_feature (102)..(102): n is a, c, g, or t
  modified_base (142)..(142): a, c, t, g, unknown or other
  misc_feature (142)..(142): n is a, c, g, or t
  modified_base (288)..(288): a, c, t, g, unknown or other
  misc_feature (288)..(288): n is a, c, g, or t
tcagacatacgcgtcacgaccggtgctcgatttagctcgatatagttgggtttgggggagtcagacccagtcaggacacagcatggacatgagggtccccgntcagctccgtgggctctgctgctcgtggctcccgaggtcncaaggtgtagacatccagatcgaccagttcctccctccacccgtggctgctatcgtaggtaggaagacagacgtcaacctagtccttacgtcggtaccggcctagactaagtaatactttaagttggttggtcgtccgttagtacncgaacgacgaaacgaaaccggtaaggaaacccgtccccgttaagtaccgttacgtacgtaaccgtaccgaaccggtaacggtccgttactttaacggtttaaggtaaaacgggttccggggtaacccctagtaaccgtaaccgggttaccacgggtaccgtaccgtacggttaggtaccgtaacggtttcgggaaaactacggttaacccttactaactacccgtacccaacctaacgtaaacgtaaacgtccgtaactaccggtacctacccgtattaaccggtggtttaacgtaccggtaaaccttaacgttaccgtaccttacccggttaaccctaaacgttacgtttaacgttacgtttacgttaccggttacccctacgggttaacccgaaccggtaacgtaaccgtacggtaaccgtacgaacggttaactaaccggtaacggttcgttaacggcgtacgaccttaacgtcttcgttaaccgttccttacgttaccgttaccccgtccg

SEQ ID NO: 82871 - DNA, 834 bp, Homo sapiens
  misc_feature: GYAE6OF02H9LFL.22.57.F02.1.454.CMB.1.raw
  modified_base (123)..(123): a, c, t, g, unknown or other
  misc_feature (123)..(123): n is a, c, g, or t
  modified_base (161)..(161): a, c, t, g, unknown or other
  misc_feature (161)..(161): n is a, c, g, or t
  modified_base (206)..(206): a, c, t, g, unknown or other
  misc_feature (206)..(206): n is a, c, g, or t
tcagacatacgcgtcacgaccggtgctcgatttagctcgatatagttgggtttgggaggctggtctcactttgtgcaggagtcagacccagtcaggacacagcatggacatgagggtccccgntcagctcctggggctcctgctgctctggctcccaggtnccaagtgtgacatccagatgacccagtctccttccacctgctgcntcgtgtaggagacagagtccacatactcttggtccggcctagtcagtaaacttattaacgttaggtttggtcggtccgttaggtataccgagtaccaaggaaaaccgtaacgggaaaccgtcccccttaagtaacccgtaccgtacgtaacctaccgaaccgtaaacgggtccgttaaccttaaacgtttaacggtaaaacgggttccggggttaaccccagtttaacgtaacgggtttaccaccggtacggtaccgtacggttaggtacgttacccgttaggggaactaacggttaactttacccgtaccttaccgttacccaaacctaaccgtaaccgtaaaccgtacggtaacccgttcggtaaccacgggtcccttaggaacgtttacggttacgtttaccgggtaaaccttaacccgttttaacgtacccgttaaccgttaaaccccgttaaaccccggtttaatttaaacccgggtttttacttaaccgtttcccgggttaaccctttacccgggtttaacccggtaacccggggtaaacggtaaccggttaacccggtacggttacgggttaaaccgttaaaccggttaaaaccggttaaccgttacgggtacgtacccgg

SEQ ID NO: 82872 - DNA, 758 bp, Homo sapiens
  misc_feature: GYAE6OF02IDC66.22.57.F02.1.454.CMB.1.raw
tcagacatacgcgtcacgaccggtgctcgatttagctcgatatagttgggtttgggggagtcagacccagtcaggacacagcatggacatgagggtccccgctcagctccgtggggctcctgctgctctggctcccagggtgccaagtgtgacatccagatcgacccagtcctccttccacccgtggctgctatcgtaggaggagacagacgtcaccatctacgttggtccgggccagtcagtaactattaagtaggttggttcggccttaggtatacgacgtacgaacgtaaaccgagggaactccccttaatactcctacgactaccgaacgtaaggtccgttacttacgttaaaggaacgggttacgggaccctaataccggtaacggttcacggccggtaccacggttaggactcggtacgggaacgtaagtactccgtaaccttcctaaccgaccaactaaccgtaaacgcgttacccgagaccgaccgtacgtaggtacgttaggttacgtttaccgaaccgttaaacctttacgaaccgttaccgaaaccgttaaaccggttaattaccgttaacctttacggtttacccgaccgtttaacccgtaccggggaaccgaaacgggtaccgaaccgggttaagtaaggtaacggttaaaaccgtttaacggacggtttccggtaagttcccgtaacggtcttaacccggtcgtttaccggttaccggtttacctttaccgtcctttaccccgg

SEQ ID NO: 82873 - DNA, 655 bp, Homo sapiens
  misc_feature: GYAE6OF02GKGEF.22.57.F02.1.454.CMB.1.raw
  modified_base (231)..(231): a, c, t, g, unknown or other
  misc_feature (231)..(231): n is a, c, g, or t
  modified_base (292)..(292): a, c, t, g, unknown or other
  misc_feature (292)..(292): n is a, c, g, or t
  modified_base (385)..(385): a, c, t, g, unknown or other
  misc_feature (385)..(385): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtcgccaagtgtgacatccagatcgaccagtctccttccacctggctgcatctgtaggagacagagtcaccatcacgttggcggcagtacgaanaattaattaagtagttggtcggccgtaggtactacgacgactaacgaaacgaagggaaacncccctataccgtcctagtacctaccaacgaacggtccgttacttaacgtttaacgaaggtcgggtacccagtaccgtaagttcgacgacgganacgtggtactacggtacgacgtaagtactcgaactctaccaacctaatacaacgtacgcctaggaccagtccgtagtaacgttgtaacgttcgaaccttaaacttacgtacgtctaaaccgtaacgttaattacgttacttacgttaccgtactccggtacggaacgtaacggtaacgacgtaacgtaggtaactaaacgtaacggttaactacggttacgaccgtacgacctaaccgtacttcgtactttacgttacctacttccccgg

SEQ ID NO: 82874 - DNA, 693 bp, Homo sapiens
  misc_feature: GYAE6OF02IHK5M.22.57.F02.1.454.CMB.1.raw
  modified_base (102)..(102): a, c, t, g, unknown or other
  misc_feature (102)..(102): n is a, c, g, or t
  modified_base (302)..(302): a, c, t, g, unknown or other
  misc_feature (302)..(302): n is a, c, g, or t
tcagacatacgcgtcacgaccggtgctcgatttagctcgatatagttgggtttgggggagtcagacccagtcaggacacagcatggacatgagggtccccgntcagctcctggggctcctgctgctctggctcccaggtgccaagtgtgacatccagatgaccctagtcctccttcccacctggctgcattctggtaggagacagacgtcaccactctacgtttggtccgggcctagtcaaggtaattattaattaggttggttcggccttggtatcgagacaagaaacccgtagggaaacnccccttaatacctcctagactaccacgaaggtcctacttaagttaagaaacggtcgggtaccataccggtaagtcgacgcggactacgtagtactcggaggactaagtacttaccgacttcctacaacgactacaacgtcgacctcgactacgccgtagtacgttgttacgtttacggactttaacgttactaccgttacgtaacccgttaacgtaagttacgttaaccgtttacgtttccgtaaccgtacccgtttaccggaaccggttaaacggacccgtaacgtaaccgttacggacgttaaacggttaaaccggtacttagggtaacggtcctacggaccttacccgtacttacccgttcgtttacctttccctaccgtttaccccg

SEQ ID NO: 82875 - DNA, 629 bp, Homo sapiens
  misc_feature: GYAE6OF02JFWO6.22.57.F02.1.454.CMB.1.raw
tcagacatacgcgtcacgaccggtgctcgatttagctcgatatagttgggtttgggaggctggtctcactttgtgcaggagtcagacccagtcaggacacagcatggacatgagggtccccgctcagctcctgggctcctgctgctctggctccaggtgccaagtgtgacatccagatcgacccagtctcctccaccgtggctgcatctagtagagacagagtccaccatcacgttgtccggcagtcagtaattattaagttaggttggttgcgttaggtatcgagctaacgaaccagggaacaccccgtataccactgactccaacgtagctacttacgttaagaaggtcggtaccatcgaaggtcaagcgatcgtgatcgaggactagtaactcgacctcgtaccacactaccaacgccgccgttagcaacgtccgtatacgtacgttacgttcggtaaccttaaccttaccgtcctacgtaacccgttaaacgtacgttaacgttaacctttagttacccgttacccgtacccggtttacccggaaccgtaacggggaaccgttaacggaaccggtttacgggaacgttaaaccggtttaaacgaccggtttcggaacggttaccg

SEQ ID NO: 82876 - DNA, 800 bp, Homo sapiens
  misc_feature: GYAE6OF02G5JJ9.22.57.F02.1.454.CMB.1.raw
tcagacatacgcgtcacgaccggtgctcgatttagctcgatatagttggggtttgggggagtcagacccagtcaggacacagcatggacatgagggtcccgctcagctccgtgggctcctgctgctgtggctcccgaggtgcctaagtgtgacatacagatcgaccctagtctcctccacctggctgcagtcgtaggtaggagacaggacgtaccaccatcctacgttcggccgggaccagtacgaagtaaagttacttaaggttaggtttcgggttacggtccgttaggtactcgtaacgtaacgaacgaaaaccggtaacgggaaaccgaccccttttttttaacgaccgttaccgtacggtaaccgtaccgaacggtaacggtacgttacgttaacgttacggtaaacgggtcgggtacctacgtacggtaggttacgacggtacgtacgacgtacggtacgtacggtaggacgtaacgttacgtaccgtacctacgtaccacgtaactaaccacgaccgtaccagtaccgacgttaccgtagtacgttacgttaacggttacggtaaccttaacgttaccgtaacgtaccgtaaccgtaaccgtttaagtttaacgttaaccggtttacgttacccggttaaccgtacccggttaccggtaaccggtaaaccggtaaccgtaccggtaacggttacggaccggttaaacgttaacggtaaccgtacggtacggtacccgtagtacccgtaccgttaaccgttcgttaaccgttacccgttgttaccccgttacccg

SEQ ID NO: 82877 - DNA, 446 bp, Homo sapiens
  misc_feature: GYAE6OF01BUDM0.21.68.G02.1.454.CMB.1.raw
  modified_base (439)..(446): a, c, t, g, unknown or other
  misc_feature (439)..(446): n is a, c, g, or t
tcagtcgtcgctcgcacgaccggtgctcgatttagtcgatagtgaagggaaagggctggagtgggtctcaggtattggtggcagtgagggtcccacatacttcgcagactccgtgaagggccggttcaccatctccagagacaattccaaggacaccctatatctgcaaatgcacagcctgagagccgaggacacggccgtatattactgtgcgaggaccggggcttatgacagtgggtggtacctggacttctactactacatggacgtctggggcaaagggaccacggtcaccgtctcctcagcctccaccaagggcccatcggtcttcccctggcaccctcctccaagagcacctctgggggcacagcggccctgggctgcctggtcaaggctacttccctcgtctctactgagcgggctgggcaaggcgcatagnnnnnnnn

SEQ ID NO: 82878 - DNA, 444 bp, Homo sapiens
  misc_feature: GYAE6OF01DDMYG.21.68.G02.1.454.CMB.1.raw
  modified_base (361)..(361): a, c, t, g, unknown or other
  misc_feature (361)..(361): n is a, c, g, or t
  modified_base (436)..(444): a, c, t, g, unknown or other
  misc_feature (436)..(444): n is a, c, g, or t
tcagtcgtcgctcgcacgaccggtgctcgatttagtcgatagtgaagggaaaggggctggagtgggtctcaggtattggtggcagtgagggtcccacatacttcgcagactccgtgaaggccggttcaccatctccagagacaattccaaggacaccctatatctgcaaatgcacagcctgagagccgaggacacggccgtatattactgtgcgaggaccggggcttatgacagtgggtggtaactggacttctactactacatggacgtctggggcaaagggccacggtcaccgtctctcagcctcaccaagggccatcggtctccccctggccaccctctccaagcgcacctctgggtncacagccggcctgggctgcctggtcaaggactacttccctcgtctctactgagcgggctgggcaaggcgcatagnnnnnnnnn

SEQ ID NO: 82879 - DNA, 570 bp, Homo sapiens
  misc_feature: GYAE6OF01EM7TW.21.68.G02.1.454.CMB.1.raw
  modified_base (541)..(570): a, c, t, g, unknown or other
  misc_feature (541)..(570): n is a, c, g, or t
tcagtcgtcgctcgcacgaccggtgctcgatttagtcgatagtgaagggaaaggggctggagtgggtctcaggtattggtggcagtgagggtcccacatacttcgcagactccgtgaagggccggttcaccatctccagagacaattccaaggacaccctatatctgcaaatgcacagcctgagagccgaggacacggccgtatattactgtgacgaacgggaccgggtacttagtgacgtaggtggggtacggtaccgtggtacttctactactacagtcggacgtcgtgggacgaaacgggaccgacggtccaccgtcctcctcacgcctccaccgacgggcccagtccggtcccttccccgtggcccaccctcctaccaagacgccacctcggtcggggaccacgacggcccggtcccggtcgggcctcggtcccgttcgggtaccgaaacgggtacccttacccgtttccccgttcgttccttaccttacgtcggacgggtcccgggtcgtcgggacgtaacgggccgactagtagnnnnnnnnnnnnnnnnnnnnnnnnnnnnnn

SEQ ID NO: 82880 - DNA, 443 bp, Homo sapiens
  misc_feature: GYAE6OF01C92WB.21.68.G02.1.454.CMB.1.raw
  modified_base (440)..(443): a, c, t, g, unknown or other
  misc_feature (440)..(443): n is a, c, g, or t
tcagtcgtcgctcgcacgaccggtgctcgatttagtcgatagtgaagggaaaggggctggagtgggtctcaggtattggtggcagtgagggtcccacatacttcgcagactccgtgaagggccggttcaccatctccagagacaattccaaggacaccctatatctgcaaatgcacagcctgagagccgaggacacggccgtatattactgtgcgaggaccggggcttatgacagtgggtggtacctgggacttctactactacatggacgtctggggcaaagggaccacggtcaccgtctcctcagcctccaccaagggcccatccggtcttcccctggcaccctcctcccaagagcacctctggggcacagcgccctgggctgcctggtcaaggactacttccctcgtctctactgagcgggctggcaggcgcatagnnnn

SEQ ID NO: 82881 - DNA, 442 bp, Homo sapiens
  misc_feature: GYAE6OF01DUUXL.21.68.G02.1.454.CMB.1.raw
  modified_base (350)..(350): a, c, t, g, unknown or other
  misc_feature (350)..(350): n is a, c, g, or t
  modified_base (433)..(442): a, c, t, g, unknown or other
  misc_feature (433)..(442): n is a, c, g, or t
tcagtcgtcgctcgcacgaccggtgctcgatttagtcgatagtgaagggaaaggggctggagtgggtctcaggtattggtggcagtgagggtcccacatacttcgcagactccgtgaagggccggttcaccatctccagagacaattccaaggacaccctatatctgcaaatgcacagcctgagagccgaggacacggccgtatattactgtgcgaggaccggggcttatgacagtgggtggtacctggacttctactactacatggacgtctggggcaaagggaccacggtcaccgtctcctcagcctccaccagggccatcggtcttcccctgcaccctctccaagancacctctggggcacagcggccctgggctgcctggtcaaggactacttccctcgtctctactgagcggctggcaggcgcatagnnnnnnnnnn

SEQ ID NO: 82882 - DNA, 535 bp, Homo sapiens
  misc_feature: GYAE6OF01CIBVW.21.68.G02.1.454.CMB.1.raw
  modified_base (211)..(211): a, c, t, g, unknown or other
  misc_feature (211)..(211): n is a, c, g, or t
  modified_base (505)..(535): a, c, t, g, unknown or other
  misc_feature (505)..(535): n is a, c, g, or t
tcagtcgtcgctcgcacgaccggtgctcgatttagtcgatagtgaagggaaagggggctggagtgggtctcaggtattggtggcagtgagggtcccacatacttcgcagactccgtgaagggccggttcaccatctccagagacaattccaaggacaccctatatctgcaaatgcacagcctgagagccgaggacacggccgtatattacngtgcgaggaccggggcttatgacagtgggtggtacctggacttctactactacatggacgtcgtggggacaaagggaccacggtccaccgtctcctcacgcctccaccaacgggccccacgtccggtccttcccccgtggcctaaccccgtcctccaacgacgccaaccgtcgtcgggggaccacacggccggcccgtgggctcggcctggtacaaacgggtactaccttcccctacgtccttctaccgtgtacggccggggactcgggacgaacgggccgacgagttaagcgnnnnnnnnnnnnnnnnnnnnnnnnnnnnnnn

SEQ ID NO: 82883 - DNA, 564 bp, Homo sapiens
  misc_feature: GYAE6OF01C3778.21.68.G02.1.454.CMB.1.raw
  modified_base (267)..(267): a, c, t, g, unknown or other
  misc_feature (267)..(267): n is a, c, g, or t
  modified_base (314)..(314): a, c, t, g, unknown or other
  misc_feature (314)..(314): n is a, c, g, or t
  modified_base (533)..(534): a, c, t, g, unknown or other
  misc_feature (533)..(534): n is a, c, g, or t
  modified_base (536)..(564): a, c, t, g, unknown or other
  misc_feature (536)..(564): n is a, c, g, or t
tcagtcgtcgctcgcacgaccggtgctcgatttagtcgatagtgaagggaaaggggctggagtgggtctcaggtattggtggcagtgagggtcccacatacttcgcagactccgtgaagggccggttcaccatctccagagacaattccaaggacaccctatatctgcaaaatgcacagcctgagagccgaggacacggccgtatattactgtgcggaggaccggggcttatgacgaggtgggtgtacctggacttctactactacngtggacgtcgtggggacaaaggccgacggtccaccgttcctccgtcncggaccctccaaccgacgggcccctagtccggttcccttcccccgaggccctacccctcctaccgaacgaccgccaacccgtcggtaccggggcaaccgtacggccgccccggtgggccttcggcccgtggtaccgaacggtaccttaccgttccctcgtcctacgtacgtgacggtaccgggtctacgggactacggacccgtacacgtagcagtgcnngnnnnnnnnnnnnnnnnnnnnnnnnnnnnn

SEQ ID NO: 82884 - DNA, 614 bp, Homo sapiens
  misc_feature: GYAE6OF01AL667.21.68.G02.1.454.CMB.1.raw
  modified_base (581)..(581): a, c, t, g, unknown or other
  misc_feature (581)..(581): n is a, c, g, or t
  modified_base (584)..(614): a, c, t, g, unknown or other
  misc_feature (584)..(614): n is a, c, g, or t
tcagtcgtcgctcgcacgaccggtgctcgatttagtcgatagtgaagggaaaggggctggagtgggtctcaggtattggtggcagtgagggtcccacatacttcgcagactccgtgaagggccggttcaccatctccagagacaattccaaggacaccctatatctgcaaatgcacagcctgagagccgaggacacggccgtatattactgtgacgaacgggaccggggtattagtacgacgtagggtggggtacggtaccgtcggtactttacttaacgtaactacgtagtacggtaccgttcgggtcggggaacgaaacggggaaccgtaccgggtccgtaccgttccgtccctcgaccgtcccctacccgaaccgaaccgggcccacgtcccggttcccttccccgcggcccctacccctccctacccgaagaccgccctaccgtcggtcgggggaccaaccggccggtcccggtcccgtcggccgtcgtcccgtcggtacggacggtaccttaccttcccgttcgtcctacgttacgtggacggccggtcgtcgacggtacggccgacgagtagcancgnnnnnnnnnnnnnnnnnnnnnnnnnnnnnnn

SEQ ID NO: 82885 - DNA, 557 bp, Homo sapiens
  misc_feature: GYAE6OF01DKNTG.21.68.G02.1.454.CMB.1.raw
  modified_base (384)..(384): a, c, t, g, unknown or other
  misc_feature (384)..(384): n is a, c, g, or t
  modified_base (526)..(526): a, c, t, g, unknown or other
  misc_feature (526)..(526): n is a, c, g, or t
  modified_base (528)..(528): a, c, t, g, unknown or other
  misc_feature (528)..(528): n is a, c, g, or t
  modified_base (532)..(533): a, c, t, g, unknown or other
  misc_feature (532)..(533): n is a, c, g, or t
  modified_base (535)..(557): a, c, t, g, unknown or other
  misc_feature (535)..(557): n is a, c, g, or t
tcagtcgtcgctcgcacgaccggtgctcgatttagtcgatagtgaagggaaaggggctggagtgggtctcaggtattggtggcagtgagggtcccacatacttcgcagactccgtgaagggcccggttcaccatctccagagacaattccaaggacaccctatatctgcaaatgcacagcctgagagccgaggacacggccgtatattactgtgcgaggaccggggcttagtgacaggtgggtggtaccgtggtacctttctactactacatggacgtcgtggggacgaaagggacccacggtccaccggtctccctcacgccctaccaccgaacgggcccactccggtccttcccccgtggcccacccctcctcccaagaccncacctcgcggggaccacgacggcccggtcccgtcgggcctcggcccgttcggtacgaacggtacctacccgtttccccttcgttcctccgttaccgtggaccggcgggtccgtgggaccgaaagggtccccgagtacgtagntntcgnncnnnnnnnnnnnnnnnnnnnnnnn

SEQ ID NO: 82886 - DNA, 520 bp, Homo sapiens
  misc_feature: GYAE6OF01EYC9H.21.68.G02.1.454.CMB.1.raw
  modified_base (493)..(520): a, c, t, g, unknown or other
  misc_feature (493)..(520): n is a, c, g, or t
tcagtcgtcgctcgcacgaccggtgctcgatttagtcgatagtgaagggaaaggggctggagtgggtctcaggtattggtggcagtgagggtcccacatacttcgcagactccgtgaagggccggttcaccatctccagagacaattccaaggacaccctatatctgcaaatgcacagcctgagagccgaggacacggccgtatattactgtgcgaggaccggggcttatgacaggtgggtggtacctggacttctactactacatggacgtcgtggggacaaagggaccacggtccaccgtcctcctcacgccctccaccgaacggcccacgttccggtccttcccccgtggccctacccctcctaccgaagacgccaccgtcggtcggggccacgcgccggtcccgtggcctgccgtggtcgaaggtaccttaccgttcccgtcgtccttactacgtcggacggcggtcgcggacgacggcgcgtagacgnnnnnnnnnnnnnnnnnnnnnnnnnnnn

SEQ ID NO: 82887 - DNA, 820 bp, Homo sapiens
  misc_feature: GYAE6OF01EREG6.21.68.G02.1.454.CMB.1.raw
  modified_base (239)..(239): a, c, t, g, unknown or other
  misc_feature (239)..(239): n is a, c, g, or t
tcagtcgtcgctcgcacgaccggtgctcgatttagtcgatagtgaagggaaaggggctggagtgggtctcaggtattggtggcagtgagggtcccacatacttcgcagactccgtgaagggccggttcaccatctccagagacaattccaaggacaccctatatctgacaaatgacacagcctgagacgccgaggaccacggccgttatacttactggtgacggacgggacccggggtnttagtggacgtaggttggggtacggttacctggtacctttctaacctacgtaacgagtcgggtaccgttcggtaggggaaccaaacggggacctaggttccggtacctacccggttccttacccgtacgaccgtacccgtacccgaaccggaaccgggtccccttaacggttccccggtttccccttttacccccggacggtacccccttaccccgtttaccccgaaccggtaaacggtcccgtacccgtaaccccggttcgggggtaccggggtaaccccaaccgggtaccggggtcccccggttcccgggtcgggtccccgtttacccgggtacccggtttaccgggaacccgttaaaacccgggtcccctttttaacccccggtttccccgttaccggtttaccccttacggttaccggttacggggacccgggtcccgggttacggtaccgggaccggtaaccgggtcctaacgttacgtacgcagtcggcagcgacggctcgtagcgtcgacgtcgactgacgtcgcgtacgtcgtgtcgtcgtacgtacgacgtacgtacgtagtcgtcgtcgcg

SEQ ID NO: 82888 - DNA, 539 bp, Homo sapiens
  misc_feature: GYAE6OF01CNHH1.21.68.G02.1.454.CMB.1.raw
  modified_base (234)..(234): a, c, t, g, unknown or other
  misc_feature (234)..(234): n is a, c, g, or t
  modified_base (265)..(265): a, c, t, g, unknown or other
  misc_feature (265)..(265): n is a, c, g, or t
  modified_base (314)..(314): a, c, t, g, unknown or other
  misc_feature (314)..(314): n is a, c, g, or t
  modified_base (481)..(481): a, c, t, g, unknown or other
  misc_feature (481)..(481): n is a, c, g, or t
  modified_base (502)..(502): a, c, t, g, unknown or other
  misc_feature (502)..(502): n is a, c, g, or t
  modified_base (507)..(508): a, c, t, g, unknown or other
  misc_feature (507)..(508): n is a, c, g, or t
  modified_base (512)..(539): a, c, t, g, unknown or other
  misc_feature (512)..(539): n is a, c, g, or t
tcagtcgtcgctcgcacgaccggtgctcgatttagtcgatagtgaagggaaaggggctggagtgggtctcaggtattggtggcagtgagggtcccacatacttcgcagactccgtgaaggccggttcaccatctccagagacaattccaaggacaccctatatctgcaaatgcacagcctgagagccgaggacacggccgtatattactgtgcgaggaccggggcttatgacgnggtgggtcgtacctggtacttctactactanagtggacgttcgtgggacaaagggaccacggtccaccgtctcctcgacncccctaccaccgaacggcccagttcccggtcccttccccgtcgcctacccctcctacccaagaccgcctaccgtcggtcggggacacgacggcccggtccgtggctcgccgtagccgaaggtccttacccgttcccttcgtccttacctacgtcggaggtcccgggngtacgggacgtacggccgtanagtgnnacgnnnnnnnnnnnnnnnnnnnnnnnnnnnn

SEQ ID NO: 82889 - DNA, 602 bp, Homo sapiens
  misc_feature: GYAE6OF01BSP5B.21.68.G02.1.454.CMB.1.raw
  modified_base (135)..(135): a, c, t, g, unknown or other
  misc_feature (135)..(135): n is a, c, g, or t
  modified_base (184)..(184): a, c, t, g, unknown or other
  misc_feature (184)..(184): n is a, c, g, or t
  modified_base (222)..(222): a, c, t, g, unknown or other
  misc_feature (222)..(222): n is a, c, g, or t
  modified_base (246)..(246): a, c, t, g, unknown or other
  misc_feature (246)..(246): n is a, c, g, or t
  modified_base (444)..(444): a, c, t, g, unknown or other
  misc_feature (444)..(444): n is a, c, g, or t
  modified_base (568)..(568): a, c, t, g, unknown or other
  misc_feature (568)..(568): n is a, c, g, or t
  modified_base (572)..(602): a, c, t, g, unknown or other
  misc_feature (572)..(602): n is a, c, g, or t
tcagtcgtcgctcgcacgaccggtgctcgatttagtcgatagtgaagggaaaggggctggagtgggtctcaggtattggtggcagtgagggtcccacatacttcgcagactccgtgaagggccggttcaccatcnccagagacaattccaaggacaccctatatctgacaaaatgaccaccaancctagagacgccgaaggacaacggccgttaatattacngtgacgagggaccggggctttaangaacgaggtgggtagtaccgtggaccttactactaacctagagtcggaacgtcgtaggggacgaaaacgggaccgaaccggttccgaaccgttcctaccttaccacggtcctacccgaaaccgaacgggccccaacgttccgtcccctttccccgacggtcccaccccttaccgtaccgaacgagacctaccaccggnggggaacaccgaaggcccggacccgtcgggactcgaccgtcggtacaaagggtacctaccgtcccgttactacgttcttacgaggtcggacggtcgtagggaccgaggacgacgtaatagacgntgannnnnnnnnnnnnnnnnnnnnnnnnnnnnnn

SEQ ID NO: 82890 - DNA, 543 bp, Homo sapiens
  misc_feature: GYAE6OF01CUW93.21.68.G02.1.454.CMB.1.raw
  modified_base (322)..(322): a, c, t, g, unknown or other
  misc_feature (322)..(322): n is a, c, g, or t
  modified_base (329)..(329): a, c, t, g, unknown or other
  misc_feature (329)..(329): n is a, c, g, or t
  modified_base (362)..(362): a, c, t, g, unknown or other
  misc_feature (362)..(362): n is a, c, g, or t
  modified_base (378)..(378): a, c, t, g, unknown or other
  misc_feature (378)..(378): n is a, c, g, or t
  modified_base (478)..(478): a, c, t, g, unknown or other
  misc_feature (478)..(478): n is a, c, g, or t
  modified_base (508)..(508): a, c, t, g, unknown or other
  misc_feature (508)..(508): n is a, c, g, or t
  modified_base (511)..(517): a, c, t, g, unknown or other
  misc_feature (511)..(517): n is a, c, g, or t
  modified_base (519)..(519): a, c, t, g, unknown or other
  misc_feature (519)..(519): n is a, c, g, or t
  modified_base (521)..(535): a, c, t, g, unknown or other
  misc_feature (521)..(535): n is a, c, g, or t
  modified_base (537)..(543): a, c, t, g, unknown or other
  misc_feature (537)..(543): n is a, c, g, or t
tcagtcgtcgctcgcacgaccggtgctcgatttagtcgatagtgaagggaaaggggctggagtgggtctcaggtattggtggcagtgagggtcccacatacttcgcagactccgtgaagggccggttcaccatctccagagacaattccaaggacaccctatatctgcaaatgcacagcctgagagccgaggacacggccgtatattactggtgcggagggaccgggggtcttaagtgacgaggtggggtcggtaccttgggacttctactactacagtgggacgtcgtaggggacaaacggccacggtccaccgtctctcncgtcccnccacgacggcccagtccgtcctccccgtgcccncccctccaccgaagcncctaccgtcggcggggaccacgcggccggtcccgtgggctcgcgtgaccaaggtaccctccttacccgtcgtcctacgtaccgtaggacggtcgggtcgnggtaccggaacggtcgaacaagtggactgngcnnnnnnncncnnnnnnnnnnnnnnntnnnnnnn

SEQ ID NO: 82891 - DNA, 686 bp, Homo sapiens
  misc_feature: GYAE6OF01AZSAM.21.68.G02.1.454.CMB.1.raw
  modified_base (129)..(129): a, c, t, g, unknown or other
  misc_feature (129)..(129): n is a, c, g, or t
  modified_base (225)..(225): a, c, t, g, unknown or other
  misc_feature (225)..(225): n is a, c, g, or t
  modified_base (619)..(619): a, c, t, g, unknown or other
  misc_feature (619)..(619): n is a, c, g, or t
  modified_base (623)..(623): a, c, t, g, unknown or other
  misc_feature (623)..(623): n is a, c, g, or t
  modified_base (626)..(626): a, c, t, g, unknown or other
  misc_feature (626)..(626): n is a, c, g, or t
  modified_base (635)..(635): a, c, t, g, unknown or other
  misc_feature (635)..(635): n is a, c, g, or t
  modified_base (639)..(639): a, c, t, g, unknown or other
  misc_feature (639)..(639): n is a, c, g, or t
  modified_base (644)..(644): a, c, t, g, unknown or other
  misc_feature (644)..(644): n is a, c, g, or t
  modified_base (647)..(647): a, c, t, g, unknown or other
  misc_feature (647)..(647): n is a, c, g, or t
  modified_base (666)..(666): a, c, t, g, unknown or other
  misc_feature (666)..(666): n is a, c, g, or t
  modified_base (669)..(669): a, c, t, g, unknown or other
  misc_feature (669)..(669): n is a, c, g, or t
  modified_base (671)..(671): a, c, t, g, unknown or other
  misc_feature (671)..(671): n is a, c, g, or t
  modified_base (678)..(678): a, c, t, g, unknown or other
  misc_feature (678)..(678): n is a, c, g, or t
  modified_base (681)..(681): a, c, t, g, unknown or other
  misc_feature (681)..(681): n is a, c, g, or t
  modified_base (683)..(683): a, c, t, g, unknown or other
  misc_feature (683)..(683): n is a, c, g, or t
tcagtcgtcgctcgcacgaccggtgctcgattttagtcgatagtgaagggaaagggctggagtgggtctcaggtattggtggcagtggaggtcccacatacttcgcagactccgtgaagggcccggttnaccatcctccagagacaacttccgaaggacaaccctatatctgactaaatcgcacagcctgagacgccgaggacacgggaccttaatacgttacgnggtcgacggaacggggtacccggggtacttaagacggaccgtagggtcggggttacgttacccgtaggtaccttttacctaacttaccgtacgtagttacgggaccggtttacggtacggggacgaaaacggggtaccctaaccggtcctaacccgtcgttacccgtaccgaacgcccctaccgaaccgtaacggggcccctaagtcccggtacccttccccgtggaccccacccgtacctaccgaagtccgactaccgtacggtacggggcaacggacggtccgtcccggtaggcgttaccgaccgtttaaggacgaaacgtaaccgtacccgttcggaacgtacgaaccgtactcggaggcggtaccgaggaccgtaggccgacaacttagngacngcntgacacagntacngctancanacgcgacacgacgctatancananagcacanacngngcg

SEQ ID NO: 82892 - DNA, 776 bp, Homo sapiens
  misc_feature: GYAE6OF01ATLG6.21.68.G02.1.454.CMB.1.raw
  modified_base (738)..(739): a, c, t, g, unknown or other
  misc_feature (738)..(739): n is a, c, g, or t
  modified_base (742)..(745): a, c, t, g, unknown or other
  misc_feature (742)..(745): n is a, c, g, or t
  modified_base (747)..(750): a, c, t, g, unknown or other
  misc_feature (747)..(750): n is a, c, g, or t
  modified_base (752)..(755): a, c, t, g, unknown or other
  misc_feature (752)..(755): n is a, c, g, or t
  modified_base (757)..(761): a, c, t, g, unknown or other
  misc_feature (757)..(761): n is a, c, g, or t
  modified_base (763)..(769): a, c, t, g, unknown or other
  misc_feature (763)..(769): n is a, c, g, or t
  modified_base (771)..(776): a, c, t, g, unknown or other
  misc_feature (771)..(776): n is a, c, g, or t
tcagtcgtcgctcgcacgaccggtgctcgatttagtcgatagtgaagggaaaggggcgtggagtgggtctcaggtattggtggcagtgagggtcccacatacttcgcagactccgtgaagggccggttcaccatctccagagacaattccaaggcaccctatatactgccaaaatgccactagccctgagagccggaggacacggccgtatattactgtggcgacgggaccgggggctttagtgaccgtaggtcggggtcggtaccgttgggtacctttccgtaaccttacctaactagtcgggtaccggttacggtcggggggaaccgaaaacggggacccgtaccgggtaccctacccggttccgttacccctccgaccggccccttaccccgaacccgaaccgggaccccaacgtttcccgggtttacccctttccccccggtcgggaccccctaccccccgttccccgtacccgtaaaaccgggaccgtacccgtacccgttaccggttaccgggggggacccaaccggtacccggggtcccccgggttcccccgggtccgggggtaccgttaccgggtaccccggtttaccggggttaacccgtaacccggggttaaccccctttaacccggttttaccccccgtttccggtttaccctacccggttacgtacgggtaccggggccgggtaccggtacgggaccggaaaccgggtccgaccgtaagtacgcgnngcnnnncnnnncnnnncnnnnngnnnnnnncnnnnnn

SEQ ID NO: 82893 - DNA, 555 bp, Homo sapiens
  misc_feature: GYAE6OF02JUCPZ.21.68.G02.1.454.CMB.1.raw
  modified_base (330)..(330): a, c, t, g, unknown or other
  misc_feature (330)..(330): n is a, c, g, or t
  modified_base (417)..(417): a, c, t, g, unknown or other
  misc_feature (417)..(417): n is a, c, g, or t
  modified_base (480)..(480): a, c, t, g, unknown or other
  misc_feature (480)..(480): n is a, c, g, or t
  modified_base (482)..(482): a, c, t, g, unknown or other
  misc_feature (482)..(482): n is a, c, g, or t
  modified_base (484)..(484): a, c, t, g, unknown or other
  misc_feature (484)..(484): n is a, c, g, or t
  modified_base (491)..(492): a, c, t, g, unknown or other
  misc_feature (491)..(492): n is a, c, g, or t
  modified_base (494)..(494): a, c, t, g, unknown or other
  misc_feature (494)..(494): n is a, c, g, or t
  modified_base (554)..(554): a, c, t, g, unknown or other
  misc_feature (554)..(554): n is a, c, g, or t
tcagtcgtcgctcgcacgaccggtgctcgatttagtcgatagtgaagggaaaggggctgggggacgtgggtcgtcaggtattggtggcgaggtgacgggtcccacactacttcggcagacgtccgtcgaaggccggtttcaccgatctccagtagacaattccaagggacaccctatacttcctgcaaatgcacagcctcgacgagccgaggaccacggcccgtatacttactgtgccgacggaccggggccttaatggaccaggtgggtaggtaccctaggacgttctactactaacatggacgtctgggcaaggacacggtcacgtcnctccagtcctcacctacggcccaatcgtactacccctggccacctccgacctacgacgccactctcggggcacagcggcctagggcngcctgtcaggctactccgagcgacgactcgagcggtcgcggacaacggtcgacgagtacgcgngngngagacgnngngtgtcgcgcgcgcgcgcgcgtcgcgcgcgacgacgcgtcgccgcgcgtctcgtctcctcnc

SEQ ID NO: 82894 - DNA, 448 bp, Homo sapiens
  misc_feature: GYAE6OF02HTGRS.21.68.G02.1.454.CMB.1.raw
  modified_base (441)..(448): a, c, t, g, unknown or other
  misc_feature (441)..(448): n is a, c, g, or t
tcagtcgtcgctcgcacgaccggtgctcgatttagtcgatagtgaagggaaaggggctggagtgggtctcaggtattggtggcagtgagggtcccacatacttcgcagactccgtgaagggccggttcaccatctccagagacaattccaaggacaccctatatctgcaaatgcacagcctgagagccgaggacacggccgtatattactgtgcgaggaccggggcttatgacagtgggtggtacctggacttctactactacatggacgtctggggcaaagggaccacggtcaccgtctcctcagcctccaccaagggcccatcggtcttccccctggcaccctcctccaagagcacctctgggggcacagcggccctgggctgcctggtcaaggactacttccctcgtctctactgagcgggctggcaaggcgcatagnnnnnnnn

SEQ ID NO: 82895 - DNA, 656 bp, Homo sapiens
  misc_feature: GYAE6OF02GO02C.21.68.G02.1.454.CMB.1.raw
  modified_base (625)..(656): a, c, t, g, unknown or other
  misc_feature (625)..(656): n is a, c, g, or t
tcagtcgtcgctcgcacgaccggtgctcgatttagtcgatagtgaagggaaaggggctggagtgggtctcaggtattggtggcagtgagggtcccacatacttcgcagactccgtgaagggccggttcaccatctccagagacaattccaaggacaccctatatctgcaaatgcacagcctgagagccgaggacacggccgtatattactgtgacgaacgggaccgggtacttagtcgaacgtagggttgggggtacggttacccgtgggtacctttacctaaccttaacctaactagtagggaaccgttcggtcgggggaacggaaaacggggaacccgtaccgggtaccgtacccggttccttcccctacgaaccgtccccttaccccaacccggaaaccgggaccccaacgttccggttcccctttccccccgtcggccctaccccctccctacccgaagacgcctaccctcggtcgggggaccaacgacggcccggccccggtcgggccgtcgtccgtcggtaccgaaacgggtaccctttaacccttccccgtccgttccttaccgttaccgtacggacgggccgggtcgtcgggaccgaacgggccgactagtacgacnnnnnnnnnnnnnnnnnnnnnnnnnnnnnnnn

SEQ ID NO: 82896 - DNA, 570 bp, Homo sapiens
  misc_feature: GYAE6OF02GRJRQ.21.68.G02.1.454.CMB.1.raw
  modified_base (543)..(543): a, c, t, g, unknown or other
  misc_feature (543)..(543): n is a, c, g, or t
  modified_base (545)..(546): a, c, t, g, unknown or other
  misc_feature (545)..(546): n is a, c, g, or t
  modified_base (550)..(570): a, c, t, g, unknown or other
  misc_feature (550)..(570): n is a, c, g, or t
tcagtcgtcgctcgcacgaccggtgctcgatttagtcgatagtgaagggaaagggggacgtgggagtgggtcgtcaggtattggttggcgagtgagggtccgacatacttcgcagactccgtgaagggccggttcgaccatctccagagacaattccaaggacaccctatatctgcaaatgcacagcctgagagccgaggacacggccgtatattactgtagcgaggaccgggggcttagtgacagtggggtggtacctgggacttctactactacaatggacttgtggggcaaaggggaccgacggtcaccggtctccctactacgccctccaccaacggggtccccaatccgggtcctttccccctcgggccaccccttaccctccaaacgacgacaccctcgtacgggggcaccgacgacgggccccctggggctcgtccgtcggtccgaaaggggaccttaccttacccgtccggtaccttccacgttcgacggcggggactcggtacgaaggtcccggacacgttcgaagccagagcngnncgcnnnnnnnnnnnnnnnnnnnnn

SEQ ID NO: 82897 - DNA, 522 bp, Homo sapiens
  misc_feature: GYAE6OF02J1ZOK.21.68.G02.1.454.CMB.1.raw
  modified_base (497)..(522): a, c, t, g, unknown or other
  misc_feature (497)..(522): n is a, c, g, or t
tcagtcgtcgctcgcacgaccggtgctcgatttagtcgatagtgaagggaaaggggctggagtgggtctcaggtattggtggcagtgagggtcccacatacttcgcagactccgtgaagggccggttcaccatctccagagacaattccaaggacaccctatatctgcaaatgcacagcctgagagccgaggacacggccgtatattactgtgcgaggaccggggcttatgacagtgggtggtacctggacttctactactacatggacgtcgtggggcaaagggaccacggtcaccgtctcctcagccctccaccaagggcccatccggtccttcccccgtggccaccctccctaccaagacgccacctcggtcgggggaccaccgtacggccggccccgtgggcctcgcccgtgggtaccaacggaccttaccttccctcgttcctacgtaccgtggacggtccgggctcgggactaacgggccgaccataggcnnnnnnnnnnnnnnnnnnnnnnnnnn

SEQ ID NO: 82898 - DNA, 544 bp, Homo sapiens
  misc_feature: GYAE6OF02IXNA8.21.68.G02.1.454.CMB.1.raw
  modified_base (306)..(306): a, c, t, g, unknown or other
  misc_feature (306)..(306): n is a, c, g, or t
  modified_base (374)..(374): a, c, t, g, unknown or other
  misc_feature (374)..(374): n is a, c, g, or t
  modified_base (510)..(510): a, c, t, g, unknown or other
  misc_feature (510)..(510): n is a, c, g, or t
  modified_base (516)..(544): a, c, t, g, unknown or other
  misc_feature (516)..(544): n is a, c, g, or t
tcagtcgtcgctcgcacgaccggtgctcgatttagtcgatagtgaagggaaaggggctggagtgggtctcaggtattggtggcagtgagggtcccacatacttcgcagactccgtgaagggccggttcaccatctccagagacaattccaaggacaccctatatctgacaaatgcacagcctgagagccgaggacacggccgtatattactgtgcgaggaccgggcttatgacagtggggtggtacctggacttctactactacatggacgtcgtggggacaaagggccacggtcaccgtctcccnacgtccctaccgacgaaccggccctaggtccgttccccttccccgcgccctaccctcctacgaacgcncctaccgtcggcgggaccacgacggtcccggcccggtcggtctcgtcgtacggaccgtaacggtccctttacccgttcccgtacgtccttacgtacgtcggacggccggtacgcggaacgtacgggcgtacctagngctgcnnnnnnnnnnnnnnnnnnnnnnnnnnnnn

SEQ ID NO: 82899 - DNA, 524 bp, Homo sapiens
  misc_feature: GYAE6OF02GMVV7.21.68.G02.1.454.CMB.1.raw
  modified_base (491)..(493): a, c, t, g, unknown or other
  misc_feature (491)..(493): n is a, c, g, or t
  modified_base (495)..(524): a, c, t, g, unknown or other
  misc_feature (495)..(524): n is a, c, g, or t
tcagtcgtcgctcgcacgaccggtgctcgatttagtcgatagtgaagggaaagggggctggagtgggtctcaggtattggtggcagtgagggtcccacatacttcgcagactccgtgaagggccggttcaccatctccagagacaattccaaggacaccctatatctgcaaatgcacagcctgagagccgaggacacggccgtatattactgtgcgagggaccggggcttatgacaggtgggtgtacctggacttctactactacatggacgtcgtggggacgaaacgggaccacggtcaccgtctccttcacgccctccaccgaacggcccactcggtccttccccgtgcccaccctcctaccaacgcgcctacctcgtcggggccacgacggccggcccgtgggcctcgccgtcggtacgaaggtacctaccttcccgtcgtaccctctacgtcgacggtcgggtcgtcggacgacggcgactagagcnnncnnnnnnnnnnnnnnnnnnnnnnnnnnnnnn

SEQ ID NO: 82900 - DNA, 576 bp, Homo sapiens
  misc_feature: GYAE6OF02G6NGS.21.68.G02.1.454.CMB.1.raw
  modified_base (232)..(232): a, c, t, g, unknown or other
  misc_feature (232)..(232): n is a, c, g, or t
  modified_base (539)..(539): a, c, t, g, unknown or other
  misc_feature (539)..(539): n is a, c, g, or t
  modified_base (544)..(576): a, c, t, g, unknown or other
  misc_feature (544)..(576): n is a, c, g, or t
tcagtcgtcgctcgcacgaccggtgctcgatttagtcgatagtgaagggaaaggggctggagtgggtctcaggtattggtggcagtgagggtcccacatacttcgcagactccgtgaagggccggttcaccatctccagagacaattccaaggaccaccctatatctgcaaatgcacagcctgagagccgaggacacggccgtatattactgtgcgaggaccggggcttagngacaggtggggtcgtaccgtggacttcgtactactactatcggacgtcgtggggacgaaacgggtaccgaccggtccgtaccgtccttccctcacgcctcccaccgaaccgggacccgacgtccgtcccttccccgtcggccaccctcctaccaagacacgacctcgcgggggacacgtacggcccggccccggtcgggccgtcgtcccgtagggtaccgaacgggtaaccctaccgtttccccgtccgtccttccgtacgtacggacgccggggtacgtcggacggtaacggcgaacgacgtaganacgtnnnnnnnnnnnnnnnnnnnnnnnnnnnnnnnnn

SEQ ID NO: 82901 - DNA, 524 bp, Homo sapiens
  misc_feature: GYAE6OF02GL4LU.21.68.G02.1.454.CMB.1.raw
  modified_base (488)..(488): a, c, t, g, unknown or other
  misc_feature (488)..(488): n is a, c, g, or t
  modified_base (491)..(491): a, c, t, g, unknown or other
  misc_feature (491)..(491): n is a, c, g, or t
  modified_base (494)..(524): a, c, t, g, unknown or other
  misc_feature (494)..(524): n is a, c, g, or t
tcagtcgtcgctcgcacgaccggtgctcgatttagtcgatagtgaaggggaaagggggctggagtgggtctcaggtattggtggcagtgagggtcccacatacttcgcagactccgtgaagggccggttcaccatctccagagacaattccaaggacaccctatatctgcaaatgcacagcctgagagccgaggacacggccgtatattactgtgcgaggaccggggcttatgacaggtgggtggtacctggacttcactactacatggacgtctgggcaaagggaccacggtcaccgtctcctcacgcctccaccaacggcccatccggtccttccccctcggccaccctcctccaacgacgccacctcgtcgggggcctacgacggccggcccgtggggcctcgcccgtggtacgaacggtacctaccttcccgtctcctcctacgtcgtacggcgggcgtcgggacgtaacggcgacgagtacgnagnacnnnnnnnnnnnnnnnnnnnnnnnnnnnnnnn

SEQ ID NO: 82902 - DNA, 168 bp, Homo sapiens
  misc_feature: GYAE6OF01DBR39.25.23.C01.1.454.CMB.1.raw
  modified_base (167)..(168): a, c, t, g, unknown or other
  misc_feature (167)..(168): n is a, c, g, or t
tcagactgtacagtcacgaccggtgctcgatttagtacacgtgattagggattgggaagaggaagactgacggtcccaggagttcaggtgctggcacagcggcctgggctgcctggtcaaggactacttccactgtacagtctgagcgggctggcaaggcgcatagnn

SEQ ID NO: 82903 - DNA, 594 bp, Homo sapiens
  misc_feature: GYAE6OF01DECV8.25.23.C01.1.454.CMB.1.raw
  modified_base (206)..(206): a, c, t, g, unknown or other
  misc_feature (206)..(206): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtccgtggcccagtcgtgtgctgactcagccaccctcagtgtctgggacccccggnagagggtctccatctcttgttctgggagcagctccgacgtcggaaaataagtttgtctactggtaccagcagctcccaagaaacggcccccaagcctcctcatctataggaatgatcagcggccctcgagggataccgtgaccgattctcgtggctcgaagtctggcctccgtccggccctcccgtcggcctatcgaggtcggccgtcccggtccgaggagtggacggctagaatattacgtgtgtcgtaggtttgggattcggacctagttcgtggtaggttcgggtccggtacgggttggtccgggcgggtaacgggaaccgaaggtcgtacggtacccgttccggtacggtccacgaccccgtaaggccgtcccggtccccccgg

SEQ ID NO: 82904 - DNA, 200 bp, Homo sapiens
  misc_feature: GYAE6OF01DRRFD.25.23.C01.1.454.CMB.1.raw
  modified_base (163)..(200): a, c, t, g, unknown or other
  misc_feature (163)..(200): n is a, c, g, or t
tcagactgtacagtcacgaccggtgctcgatttagtacacgtgattagggagttggggaccaaggtcaccgtcctaggtcagcccaaggccaaccccactgtcactctgttcccaccctcctcactgtacagtcctgagcgggctgggcaaggcgcagtacgnnnnnnnnnnnnnnnnnnnnnnnnnnnnnnnnnnnnnn

SEQ ID NO: 82905 - DNA, 162 bp, Homo sapiens
  misc_feature: GYAE6OF01DGIHR.25.23.C01.1.454.CMB.1.raw
  modified_base (157)..(162): a, c, t, g, unknown or other
  misc_feature (157)..(162): n is a, c, g, or t
tcagactgtacagtcacgaccggtgctcgatttagtacacgtgattagggattgggaccaaggtcaccgtcctaggtcagcccaaggccaaccccactgtcactctgttcccaccctcctcactgtacagtctgagcgggctggcaaggcgcatagnnnnnn

SEQ ID NO: 82906 - DNA, 528 bp, Homo sapiens
  misc_feature: GYAE6OF01AZUSM.25.23.C01.1.454.CMB.1.raw
  modified_base (228)..(228): a, c, t, g, unknown or other
  misc_feature (228)..(228): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccgggcagagggtctccatctcttgttctgggancagctccgacgtcggaaatagtttgctactggtaccagcagctcccagaacggcccccaagctcctcatctataggaatgatcagcggccctcagggatacctgaccgattctctggctcgaagtctggctctcggcctccctggccatcagtggctcggtccgaggatgaggctgaatattactgtgctagtttggatgccagtctgagtggtccgaggtgttcggcggagggaccgaaggcgtcgacccgtccgtagggtccacgcccgaaggcctcggccccccgtggtccgtaccg

SEQ ID NO: 82907 - DNA, 531 bp, Homo sapiens
  misc_feature: GYAE6OF01ETAL4.25.23.C01.1.454.CMB.1.raw
  modified_base (197)..(197): a, c, t, g, unknown or other
  misc_feature (197)..(197): n is a, c, g, or t
  modified_base (406)..(406): a, c, t, g, unknown or other
  misc_feature (406)..(406): n is a, c, g, or t
  modified_base (441)..(441): a, c, t, g, unknown or other
  misc_feature (441)..(441): n is a, c, g, or t
tcagactgtacagtcacgaccggtgctcgatttagtacacgtgattagggattgggggagagaagacaggattcaggacaatctccagcatggccggcctccctctcctcctcaccctcctcactcactgtgcagggtccgtgggcccgagtacgtgtgctggactcagccaccctcagtgtctgggacccccgggnagagggtctccatctcttgttctgggagcagctccgacgtcggaaataagtttgctactggtaccagcagctcccagaaacggccccaagctcctcatctataggaatgatcagcggccctcagggatacctgaccgattctctggctcgaagtctggctctcggcctccctggccatcagtgggctccggtcgagatgaggctgaatntactgtgcagtttggatgcagtctgagtggtccgnggttgttcgggcggagggaccgagcgtgaccgtctaggtctagcccgaaggcctcgccccccgtcggtccactcctcgtcccctaccccg

SEQ ID NO: 82908 - DNA, 220 bp, Homo sapiens
  misc_feature: GYAE6OF01EDZS5.25.23.C01.1.454.CMB.1.raw
  modified_base (169)..(169): a, c, t, g, unknown or other
  misc_feature (169)..(169): n is a, c, g, or t
  modified_base (175)..(220): a, c, t, g, unknown or other
  misc_feature (175)..(220): n is a, c, g, or t
tcagactgtacagtcacgaccggtgctcgatttagtacacgtgattagggattgggggggaaggaggaagactgacggtcccccaggagttcaggtgctgggcacagcggccctgggctgcctggtcaaggctacttccactgtacagtctgagcgggctggcaaggcncatagnnnnnnnnnnnnnnnnnnnnnnnnnnnnnnnnnnnnnnnnnnnnnn

SEQ ID NO: 82909 - DNA, 554 bp, Homo sapiens
  misc_feature: GYAE6OF01CP11V.25.23.C01.1.454.CMB.1.raw
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctcgggacccccgggcagagggtctccatctcttgttctgggagcagctccgacgtcggaaatagtttgctactggtaccagcagctcccagaaaccggcccccaagcctcctcatctataggaatgatcagcggccctcgagggatacctgaccgattctctggctcgaagtctggctcctcggcctcccgtggccatcaggtcgggctccggtcgaggatgaggctgaatattactgtgctaggtttggatgcagtctgagtggtccgacgggttgtcgggcggagggaccaaggctcggaccgtccgtaggtccaggccccgaaggcctccggcccccctcgggtcccaccgttccctcggttcccccgtccccg

SEQ ID NO: 82910 - DNA, 616 bp, Homo sapiens
  misc_feature: GYAE6OF01COIO5.25.23.C01.1.454.CMB.1.raw
  modified_base (207)..(207): a, c, t, g, unknown or other
  misc_feature (207)..(207): n is a, c, g, or t
  modified_base (236)..(236): a, c, t, g, unknown or other
  misc_feature (236)..(236): n is a, c, g, or t
  modified_base (241)..(241): a, c, t, g, unknown or other
  misc_feature (241)..(241): n is a, c, g, or t
  modified_base (271)..(271): a, c, t, g, unknown or other
  misc_feature (271)..(271): n is a, c, g, or t
  modified_base (424)..(424): a, c, t, g, unknown or other
  misc_feature (424)..(424): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagcccaccctcagtgtctcgggacccccggnaggagggtctccatctcttgttctgggancagcnccgagtcgaaatagttgtctagtggtaccngcagctaccaacgaaccggccccaagcctcctcatctataggatgatcacgcgccctgaggataccgtgaccgtattcctcgtggctcgaagtcgtcgccttccgtcgtccctccgtcggccctagtcgaggtcggccgtcccggtcgaggtntcggagtctagaattacgttacgtgtgtacgttaggtttcggattcggaccgtagttccgtagggtacggttcgggtaccggtagggttcgggttcggggacgggtaccgggaccgtaaggtcgtcccgggtacccggttccgtacgggttccgaaccgtacccggaacggtccgtaccccggtccccccgg

SEQ ID NO: 82911 - DNA, 519 bp, Homo sapiens
  misc_feature: GYAE6OF01B7TH6.25.23.C01.1.454.CMB.1.raw
  modified_base (200)..(200): a, c, t, g, unknown or other
  misc_feature (200)..(200): n is a, c, g, or t
  modified_base (320)..(320): a, c, t, g, unknown or other
  misc_feature (320)..(320): n is a, c, g, or t
  modified_base (459)..(459): a, c, t, g, unknown or other
  misc_feature (459)..(459): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggagcagctccgacgtcggaaatagtttgctactggtaccagcagatcccagaaacggccccaagctcctcatctataggaatgatcagcggcctnagggatacctgaccgattctctggctcgaagtctggctccgtcggccctccctggccatcagtgggcctccgggtccgaggactgaggctgaatattactgtgctagttggatgccagtctgagtgtcgaggtgtcggnggaggaccagcgtcgaccgtcgtaggtcagtcccgaaggcctcgccccctggtctacccg

SEQ ID NO: 82912 - DNA, 513 bp, Homo sapiens
  misc_feature: GYAE6OF01BZO6H.25.23.C01.1.454.CMB.1.raw
  modified_base (199)..(199): a, c, t, g, unknown or other
  misc_feature (199)..(199): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggagcagctccgacgtcggaaatagtttgctactggtaccagcagctcccagaaacggcccccaagctcctcatctataggaatgatcagcggccctcagggatacctgaccgattctctgctcgaagtctggctctcgcctcctggccatcagtgggctccggtcgaggatgaggctagaatattactgtgctagtttgggatgccagtctgagtggtccgaggtgttcggcggaggaccaagcgtgaccgtcgtaggcacgcccgaaggctacgcccctggtctaccg

SEQ ID NO: 82913 - DNA, 183 bp, Homo sapiens
  misc_feature: GYAE6OF01AF8WL.25.23.C01.1.454.CMB.1.raw
  modified_base (174)..(183): a, c, t, g, unknown or other
  misc_feature (174)..(183): n is a, c, g, or t
tcagactgtacagtcacgaccggtgctcgatttagtacacgtgattagggagttgggggaagaggaagactgacggtcccccaggagttcaggtgctgggcacagcggccctgggctgcctggtcaaggactacttccactgtacagtctgagcgggctggcaaggcgcatagnnnnnnnnnn

SEQ ID NO: 82914 - DNA, 755 bp, Homo sapiens
  misc_feature: GYAE6OF01A5N9F.25.23.C01.1.454.CMB.1.raw
  modified_base (139)..(139): a, c, t, g, unknown or other
  misc_feature (139)..(139): n is a, c, g, or t
  modified_base (174)..(174): a, c, t, g, unknown or other
  misc_feature (174)..(174): n is a, c, g, or t
  modified_base (200)..(200): a, c, t, g, unknown or other
  misc_feature (200)..(200): n is a, c, g, or t
tcagactgtacagtcacgaccggtgctcgatttagtacacgtgattagggattggggagctgtggtagagaagacaggattcaggacaatctccagcatggccggcctcctctcctcctcacctcctcactcactgtcnctcgtctggccgagtcgcgtaggcgtcgactacgngcacctcagtgtctgggaccccgggnacggacggtctcatcttcttgttcgtagggacgcacgtcgtccggacggtacggtaaaagttacgtttcgtactacgtcggtaaccagtcacgtcctacccgaacggaaacccggaccccaacgtcctcctctacttacgtaagtaacggaatcgactcgacggtccggccgtacgacgggtactaccgtcgaccgtacttcgtcgtcggcctacggtaacgtcgtcggtcctccggtccggtccttccgtacggacctacgtcgtacgggtcgggtccggttaccgggtcggtagggtacgtcgggtacggtacgttagtaacgtttacgtttacgtggttacggtacgtttagggtttacgggacgttcggtaccgttacggttcggttacgggttacgggttccgggttaccgggttacgggttcgggttccgggggtaccgggtaacgggtaccgtaacggtaccggtaccggtacccggtacggttacggtaccgtaccggtacccggtacgggtcccgtaccccgggtccccgttcggtacccgtaccg

SEQ ID NO: 82915 - DNA, 195 bp, Homo sapiens
  misc_feature: GYAE6OF01EF7PB.25.23.C01.1.454.CMB.1.raw
  modified_base (174)..(195): a, c, t, g, unknown or other
  misc_feature (174)..(195): n is a, c, g, or t
tcagactgtacagtcacgaccggtgctcgatttagtacacgtgattagggagttgggggaagaggaagactgacggtcccccaggagttcaggtgctcgggcacagcggccctgggctgcctggtcaaggctacttccactgtacagtctgagcgggctggcaaggcgcatagnnnnnnnnnnnnnnnnnnnnnn

SEQ ID NO: 82916 - DNA, 525 bp, Homo sapiens
  misc_feature: GYAE6OF01A5W78.25.23.C01.1.454.CMB.1.raw
  modified_base (191)..(191): a, c, t, g, unknown or other
  misc_feature (191)..(191): n is a, c, g, or t
  modified_base (219)..(219): a, c, t, g, unknown or other
  misc_feature (219)..(219): n is a, c, g, or t
  modified_base (310)..(310): a, c, t, g, unknown or other
  misc_feature (310)..(310): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggancagctccgagtcggaaatagtttgctactggtaccagcagctccagaaacggccccaagctcctcatctataggaatgatcagcggccctnagggatacctgaccgattctctggctcgaagtctggctctcggcctcctggccatcagtcgggctccggtcgaggatgagctgaatattactgtgctagtttgggatgcctagtctgagtggtccgacgggtgttcggcggtagggaccaaggctggaccgtcgtaggtcagcccgaaggcctgccgttcccgtcggtcactcgtcgttcccccg

SEQ ID NO: 82917 - DNA, 494 bp, Homo sapiens
  misc_feature: GYAE6OF01CKQDE.25.23.C01.1.454.CMB.1.raw
  modified_base (206)..(206): a, c, t, g, unknown or other
  misc_feature (206)..(206): n is a, c, g, or t
  modified_base (414)..(414): a, c, t, g, unknown or other
  misc_feature (414)..(414): n is a, c, g, or t
  modified_base (436)..(436): a, c, t, g, unknown or other
  misc_feature (436)..(436): n is a, c, g, or t
  modified_base (454)..(454): a, c, t, g, unknown or other
  misc_feature (454)..(454): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgtctgggagcagctccgagtcggaaataatttgtctactggtaccagcagctccagaacggccccaagctcctcatctataggaatgatcagcggccctcagggatacctgaccgattctctggctcgaagtctggctcctcggcctcctggccatcagtggctcgtccgaggatgagctgaatattacngtgcaggtttggatgccagtcngagtgccgaggtgtcggnggaggcaagctgacgtctaggtcagacccaggctgccccg

SEQ ID NO: 82918 - DNA, 574 bp, Homo sapiens
  misc_feature: GYAE6OF01EC4DP.25.23.C01.1.454.CMB.1.raw
tcagactgtacagtcacgaccggtgctcgatttagtacacgtgattagggattggggagcttcagctgtggtagagaagacaggattcaggacaatctccagcatgaccggcctccctctcctcctcaccctcctcactcactgtgcagggtcctgggcccagtctgtgctgactcagccaccctcagtgtctgggacccccgggcagagggtctccatctcttgttctgggagcagctccgacgtcggaaataagtttgtctactggtaccagcagctccagaaaccggcccccaagctcctcatctataggaatgatcagcggccctgagggactaccgtgaccgtattctctggctcgaagtctggcctccgtcggccctcccgtggccatccgaggtcgggccttcccggtccgaggagtggaggctagaattagttactgtgctaggtttgggatcgccgtagttcgtggaggtcggtccggacgggttcggttcggggcgggtagggacccaaggccgtcggacccggtccgtaggtccacggaccccgaaggcctccggtccccccg

SEQ ID NO: 82919 - DNA, 522 bp, Homo sapiens
  misc_feature: GYAE6OF01AOT9I.25.23.C01.1.454.CMB.1.raw
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
  modified_base (322)..(322): a, c, t, g, unknown or other
  misc_feature (322)..(322): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggancagctccgacgtcggaaatagtttgtctactggtaccagcagctcccagaaacggcccccaagctcctcatctataggaatgatcagcggccctnagggatacctgaccgattctctggctcgaagtctggctccgtcgcctccctggccatcagtggctccggtcgaggatgaggctagaattattactgtgcgtagtttggatgccagtctgagtgtccgaggtgtcggcggaggaccgaagcgtggaccgtccgtaggtcacgcccgaacggctcgccccctcggtctaccg

SEQ ID NO: 82920 - DNA, 545 bp, Homo sapiens
  misc_feature: GYAE6OF01BLQMX.25.23.C01.1.454.CMB.1.raw
  modified_base (430)..(430): a, c, t, g, unknown or other
  misc_feature (430)..(430): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggcaggagggtctccatctcttgttctgggagcagctccgacgtcggaaataagtttgtctactggtaccagcagctccagaaaccggcccccaagctcctcatctataggaatgatcagcggccctcagggatacctgaccgtattctctggctcgaagtctggctcctcggccctccgtgccatcagtgggctccggtctgagatgaggctagatattactgtgntaggttgggatgcctagttcgtgaggtcggtccggacggttggttcgggcgggacgggacccaaggccgtcggaccgttccgtagggtcacggccccgaagggtccgtaccccgg

SEQ ID NO: 82921 - DNA, 554 bp, Homo sapiens
  misc_feature: GYAE6OF01DF3JD.25.23.C01.1.454.CMB.1.raw
  modified_base (195)..(195): a, c, t, g, unknown or other
  misc_feature (195)..(195): n is a, c, g, or t
  modified_base (309)..(309): a, c, t, g, unknown or other
  misc_feature (309)..(309): n is a, c, g, or t
  modified_base (357)..(357): a, c, t, g, unknown or other
  misc_feature (357)..(357): n is a, c, g, or t
tcagactgtacagtcacgaccggtgctcgatttagtacacgtgattagggattggggagcttcagctgtggtagagaagacaggattcaggacaatctccagcatggccgcctccctctcctcctcaccctcctcactcactgtgcaggtccgtggcccgagtacgtgtgactgactcagccaccctcagtgtcncgggacccccggcagaggtctccatctcttgttctgggagcagctccgacgtcggaaaataagtttgtctactggtaccagcagcctcccagaaaccggcccccaagcctcctnatctataggaatgatcacgcggcccctgagggatacctgaccgattcnctggctacgaagtctggctccgtcggccctcccgtaggcccatcaggtcggcctacccggtccgaggatgagctagaatattactgctcgtagtttcggatgtcctagtctgagttcggtccggtaggttggtcggcggaacgggccaaggcgtacgaccgtcgtacggtccagcccgaaggtcctccggtcccccg

SEQ ID NO: 82922 - DNA, 535 bp, Homo sapiens
  misc_feature: GYAE6OF01A4VER.25.23.C01.1.454.CMB.1.raw
  modified_base (184)..(184): a, c, t, g, unknown or other
  misc_feature (184)..(184): n is a, c, g, or t
  modified_base (204)..(204): a, c, t, g, unknown or other
  misc_feature (204)..(204): n is a, c, g, or t
  modified_base (480)..(480): a, c, t, g, unknown or other
  misc_feature (480)..(480): n is a, c, g, or t
tcagactgtacagtcacgaccggtgctcgatttagtacacgtgattagggatttggggagctgtggtagagaagacaggattcaggacaatcttccagcatggccggcctccctctcctcctcaccctcctcactcactgtgcagggtcctgggccctagtctgtgcttgactcagccaccctnagtgtctgggacccccgggnagagggtctccatctcttgttctgggagcagcctccgacgtcggaaatagtttgctactggtaccagcagctcccagaaaccggcccccaagctcctcatctataggaatgatcgaggccggccctgagggactacctgaccgtattctcgtggactacgaagtctggcctcctcgcctccgtggccatcagtcggcctccggtcgaggatgaggctagaattattacgtgtgcgtagtttaggatcgcctagtctgtagtggtcgaggtgtcggnggacggaccagcgtcgaccgtcgtggtcacgccgagctccgccccttggtcctcg

SEQ ID NO: 82923 - DNA, 511 bp, Homo sapiens
  misc_feature: GYAE6OF01ER8R8.25.23.C01.1.454.CMB.1.raw
  modified_base (206)..(206): a, c, t, g, unknown or other
  misc_feature (206)..(206): n is a, c, g, or t
  modified_base (503)..(503): a, c, t, g, unknown or other
  misc_feature (503)..(503): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggagcagctccgacgtcggaaataagtttgtctactggtaccagcagctcccagaaacggcccccaagctcctcatctataggaatgatcagcggccctcagggatacctgaccgattctctggctcgaagtctggctcctcggcctccctggccatcagtgggctccggtccgaggatgaggctgaatattactgtgctagtttggatgccagtctgagtggtccgaggtgttcgggcggagggccaagctgaccgtcaggtcagcccagcncgcccccg

SEQ ID NO: 82924 - DNA, 627 bp, Homo sapiens
  misc_feature: GYAE6OF01B9HXR.25.23.C01.1.454.CMB.1.raw
tcagactgtacagtcacgaccggtgctcgatttagtacacgtgattagggattggggagagaagacaggattcaggacaatctccagcatggccggcctccctctcctcctcaccctcctcactcactgtgcagggtcctggcccagtctgtgctgactcagccaccctcagtgtccgtcggggacccccgggcaggagggtcctccatctcttgttctgggagcagcctccgacgtacggaaataagtttgctacgtggtaccagcagctccagaaaccgcccaagcctcctcatctataggaatgactcagcggcctgaggactacctgaccgtattctcgtggctacgaagtctcggcctccgtccggccctacccgtggcccatcgaggtcggcctccggtccgaggatggagctagaattattacgtgtgcgttagtttggattgccgtagtcgtggtacggtcggtccggtacgggttcggttacgggacgggtaacgggaccgaaggtccgtaccgtacccgggttaccgtaacgggttccgaacggccccggtaaggcccgttacccggccccccgttacggtaccctaccgttccgttcccgtcccccgttacccccg

SEQ ID NO: 82925 - DNA, 540 bp, Homo sapiens
  misc_feature: GYAE6OF01BV3T5.25.23.C01.1.454.CMB.1.raw
  modified_base (205)..(205): a, c, t, g, unknown or other
  misc_feature (205)..(205): n is a, c, g, or t
  modified_base (233)..(233): a, c, t, g, unknown or other
  misc_feature (233)..(233): n is a, c, g, or t
  modified_base (336)..(336): a, c, t, g, unknown or other
  misc_feature (336)..(336): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggancagctccgacgtcggaaataagttgtctactggtaccagcagctccagaacgcccccaagctcctcatctataggaatgatcagcggccctcagggactaccngaccgattctctggctcgaagtctggcctctcggcctccgtgccatcagtcgggctccggtccgaggatgaggctgaatattactgtgctagttggatcgccagtctggagtcggtccgaggtcgttcgggcggtaggacccgtaaggcgtcggacccgtccgtagggtaccacggaccccgtaaggccgtccggtaccccccg

SEQ ID NO: 82926 - DNA, 511 bp, Homo sapiens
  misc_feature: GYAE6OF01A9THO.25.23.C01.1.454.CMB.1.raw
  modified_base (200)..(200): a, c, t, g, unknown or other
  misc_feature (200)..(200): n is a, c, g, or t
  modified_base (228)..(228): a, c, t, g, unknown or other
  misc_feature (228)..(228): n is a, c, g, or t
  modified_base (457)..(457): a, c, t, g, unknown or other
  misc_feature (457)..(457): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggancagctccgacgtcggaaatagtttgctactggtaccagcagctcccagaaacggcccccaagctcctcatctataggaatgatcagcggccctcagggatacctgaccgattctctggctcgaagtctggctcctcggcctcctggccatcagtgggctccggtccgaggatgaggctgaatattactgtgcagtttggatgccagtctgagtggtccgaggtgtcggnggagggaccaagcgtgaccgtctggcagcccaaggctcgccccctggtctaccg

SEQ ID NO: 82927 - DNA, 515 bp, Homo sapiens
  misc_feature: GYAE6OF01BMR50.25.23.C01.1.454.CMB.1.raw
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
  modified_base (424)..(424): a, c, t, g, unknown or other
  misc_feature (424)..(424): n is a, c, g, or t
  modified_base (432)..(432): a, c, t, g, unknown or other
  misc_feature (432)..(432): n is a, c, g, or t
  modified_base (449)..(449): a, c, t, g, unknown or other
  misc_feature (449)..(449): n is a, c, g, or t
tcagactgtacagtcacgaccggtgctcgatttagtacacgtgattagggattggggcagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggancagctccgacgtcggaaataagtttgtctactggtaccagcagctcccagaaaccggcccccaagcctcctcatctataggaatgatcagcgccctcagggactacctgaccgtattctctggctcgaagtctgctcctcggcctcccgtgccatcagtgggcctccgggtcgaggatgaggctgaatntactgtgnagtttggatgccagtcngagtggtccgaggtgtcggcggaggaccagtctggacccgtcgtaggtcaggcccaaggctcccgg

SEQ ID NO: 82928 - DNA, 453 bp, Homo sapiens
  misc_feature: GYAE6OF01A178R.25.23.C01.1.454.CMB.1.raw
  modified_base (272)..(272): a, c, t, g, unknown or other
  misc_feature (272)..(272): n is a, c, g, or t
  modified_base (445)..(453): a, c, t, g, unknown or other
  misc_feature (445)..(453): n is a, c, g, or t
tcagactgtacagtcacgaccggtgctcgatttagtacacgtgattagggattggggctggatccggcggccccccgggaagggcctggagtggttgggcagtgtccaatacggtagacctccccactacgccccatccctcaggggtcgcctcacgttgtcaattgacacctctaagaagcagttctctctgggtctgacttctgtcaccgccgcggacacggccacatactattgtgtctcggacacatgggcccacgactacccctttntctactggggccggggaatcgtggtcaccgtctcctcagcctccaccaagggcccatcggtcttccccctggcaccctcctccaagacgcacctctggggcacagcgccctgggctgcctggtcaaggactacttccactgtacagtctgagcgggctggcaaggcgcatagnnnnnnnnn

SEQ ID NO: 82929 - DNA, 541 bp, Homo sapiens
  misc_feature: GYAE6OF01BB9GM.25.23.C01.1.454.CMB.1.raw
  modified_base (191)..(191): a, c, t, g, unknown or other
  misc_feature (191)..(191): n is a, c, g, or t
  modified_base (219)..(219): a, c, t, g, unknown or other
  misc_feature (219)..(219): n is a, c, g, or t
  modified_base (465)..(465): a, c, t, g, unknown or other
  misc_feature (465)..(465): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggancagctccgacgtcggaaatagtttgctactggtaccagcagctcccagaaccggccccaagctcctcatctataggaatgatcagcggccctcgagggataccgtgaccgattctctgctcgaagtctggctctcggcctcctggccatcagtcgggctccggtccgaggatgaggctgaaatattactgtgtcgtaggtttggatgcctagttcgtggagtcgggtccgacgggttgttccgggnggagggaccaaggcgtggaccgtcgtaggtcacgcccaaggcctcgccccgtcggtcacgtctcgtcccctacccg

SEQ ID NO: 82930 - DNA, 541 bp, Homo sapiens
  misc_feature: GYAE6OF01BZM0F.25.23.C01.1.454.CMB.1.raw
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggcagagggtctccatctcttgttctgggagcagctccgacgtcggaaataagtttgtctactggtaccagcagctccagaacggcccccaagctcctcatctataggaatgatcagcggccctcgagggactacctgaccgattctctggctcgaagtctggcctcctcggcctcccgtggccatcagtcgggcgtcccggtccgaggatggaggctgaatattactgtgctaggtttgggatcgcctagtctggagtggtccgacgggttgttcgggcgggtacgggacaggcgtcgacccgtcgtaggtcacggcccaaggccgtcgtcccccgg

SEQ ID NO: 82931 - DNA, 543 bp, Homo sapiens
  misc_feature: GYAE6OF01DWPNY.25.23.C01.1.454.CMB.1.raw
  modified_base (199)..(199): a, c, t, g, unknown or other
  misc_feature (199)..(199): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggagcagctccgacgtcggaaatagtttgctactggtaccagcagctcccagaaacgcccccaagctcctcatctataggaatgatcagcgccctgagggactacctgaccgattctctggctcgaagtctggctcctcgccctcccgtggccatcaggtcggcctccgggcgaggatgaggctgaattattactgtgcgtaggtttggatgcctagttctgaggtcggtcggtacggtgttcgggcggaggcccgaaggccgtgacccgtcgtacgggtcacggacccgaaggtcctccggcccccctggtcctacccg

SEQ ID NO: 82932 - DNA, 519 bp, Homo sapiens
  misc_feature: GYAE6OF01CD0ON.25.23.C01.1.454.CMB.1.raw
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccggcagagggtctccatctcttgttctgggagcagctccgacgtcggaaatagtttgctactggtaccagcagctcccagaaacggcccccaagctcctcatctataggaatgatcagcggccctcagggatacctgaccgattctctggctcgaagtctggctcctcggcctcctggccatcagtggctccggtccgaggatgaggctgaatattactgtgctagtttggatgccagtctgagtggtccgacggtgttcggcggagggaccaagcgtcgaccgtccgtaggtccaggcccaaggctcgccccctggtctaccg

SEQ ID NO: 82933 - DNA, 586 bp, Homo sapiens
  misc_feature: GYAE6OF01DSPN6.25.23.C01.1.454.CMB.1.raw
  modified_base (195)..(195): a, c, t, g, unknown or other
  misc_feature (195)..(195): n is a, c, g, or t
  modified_base (199)..(199): a, c, t, g, unknown or other
  misc_feature (199)..(199): n is a, c, g, or t
  modified_base (219)..(219): a, c, t, g, unknown or other
  misc_feature (219)..(219): n is a, c, g, or t
  modified_base (224)..(224): a, c, t, g, unknown or other
  misc_feature (224)..(224): n is a, c, g, or t
  modified_base (361)..(361): a, c, t, g, unknown or other
  misc_feature (361)..(361): n is a, c, g, or t
  modified_base (412)..(412): a, c, t, g, unknown or other
  misc_feature (412)..(412): n is a, c, g, or t
  modified_base (418)..(418): a, c, t, g, unknown or other
  misc_feature (418)..(418): n is a, c, g, or t
  modified_base (442)..(442): a, c, t, g, unknown or other
  misc_feature (442)..(442): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcgtggtcgtggcccgagtcgtgtaggcctgactcgagccaccctgagtgtcgcgggaccccggnaggnggtctccatctcttgttcgngggancagtctcgacgtaggaaatagttgctacgtggaccagcacgccaccgaagaaacccggccccctaagcctcctacacgttctaagtaggaatgatcgacgccggttcccagacgggacttaccgtgaccgtatttcncgtggccttacgacgtcgtcggccttccgtccggcccttaccgtggacccngttcgnggtcggccgtccggtcgagtacgngagtagtagtatagtagtgtgtgtagtgtgtcgtcgtagtgtggtcggtcggtcggtcggtcggtcggacggacggacgacgtcgtcgtacgtacgtacgtcgacgacgcgcgtccgtccgtcgtctactcctccgtcccgtcc

SEQ ID NO: 82934 - DNA, 703 bp, Homo sapiens
  misc_feature: GYAE6OF01DZGUW.25.23.C01.1.454.CMB.1.raw
  modified_base (203)..(203): a, c, t, g, unknown or other
  misc_feature (203)..(203): n is a, c, g, or t
  modified_base (228)..(228): a, c, t, g, unknown or other
  misc_feature (228)..(228): n is a, c, g, or t
  modified_base (233)..(233): a, c, t, g, unknown or other
  misc_feature (233)..(233): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcgagggtccgtgggcccagtcgtgtgctgactcagccaccctcagtgtcgtcgggaccccggnaggagggtctccatctcttgttcgngggancagctccggagtcggaaaattagtttgctactggtaccagcagctacccaagaaaccggccccaagcctctcatctatagatgatcagccggcctcgagggacttaccgagaccgtattcctcgtcggcttacgaagttcctcgggtaccttccgtccggtcccttacccgtggaccctaagttccgacggttcggggtcctcccggggtaccggaagggacgtcggaacggtctaaggtaaactttagtttaaccgtgtcggtacgtaagggttttcggggaacttcggtcccgtaaggtccgttagggtaacggtttccggggtacccggtacggggtttggttacccggggacgggtaaccgggtaacccgaaggcccgttacgggaacccgtttacccggtaaggtcccgaacggaccccggtaacgggtcccgtacccggtccccccggttaggccttaaccccg

SEQ ID NO: 82935 - DNA, 532 bp, Homo sapiens
  misc_feature: GYAE6OF01BRPI6.25.23.C01.1.454.CMB.1.raw
  modified_base (199)..(199): a, c, t, g, unknown or other
  misc_feature (199)..(199): n is a, c, g, or t
  modified_base (228)..(228): a, c, t, g, unknown or other
  misc_feature (228)..(228): n is a, c, g, or t
  modified_base (340)..(340): a, c, t, g, unknown or other
  misc_feature (340)..(340): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccggnaggagggtctccatctcttgttctgggancagctccgagtcggaaatagtttgtctactggtaccagcagctcccagaaacgccccaagctcctcatctataggaatgatcagcggcctcgagggatacctgaccgattcnctgctcgaagtctggctctcggcctccgtggccatcagtcgggcctccggtccgaggagtggacggctagaatattacgtgtgcgtagtttggatcgcagtctgagtggtccgacggttgttcgggcggaggaccgaagcgtggtacccgtcgtcggtcgagcccgaaggcctcgccccctggtcctacccg

SEQ ID NO: 82936 - DNA, 556 bp, Homo sapiens
  misc_feature: GYAE6OF01BVFHC.25.23.C01.1.454.CMB.1.raw
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
  modified_base (321)..(321): a, c, t, g, unknown or other
  misc_feature (321)..(321): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggancagctccgacgtcggaaatagttgtctactggtaccagcagctcccagaaacggcccccaagctcctcatctataggaatgatcagcggccctnagggatacctgaccgattctctggctcgaagtctggctccgtcggcctcccgtggcccatcgagtgggcctccggtccgaggatgaggctgaatattacgtgtgcgtaggtttgggatcgccgtagtcgtggtaggtcggtccgtacgggtggttccgggcgggtagggaccaaggcgtcggtacccgtccgtaggtccacgcccgaacggcctcggcccccttggtcctacccg

SEQ ID NO: 82937 - DNA, 856 bp, Homo sapiens
  misc_feature: GYAE6OF01A2WJR.25.23.C01.1.454.CMB.1.raw
  modified_base (203)..(203): a, c, t, g, unknown or other
  misc_feature (203)..(203): n is a, c, g, or t
  modified_base (230)..(230): a, c, t, g, unknown or other
  misc_feature (230)..(230): n is a, c, g, or t
tcagactgtacagtcacgaccggtgctcgatttagtacacgtgattagggattggggagcttcagctgtggtagagaagacaggattcaggacaatcctccagcagtcggcccggccctccctcctccctcctccaccctcctcactcactgtgcgacgggtccgtcgggcccagtctgtcgctcgactcacgcccaccctcnggtcgtccggtccggggacccccgggngacggtacgggtcctcctacttccttcgtttcgttcggtagggacgccgacgtccgttaccggaacggttaacggttaaaagtttaacggttttcgtacttacgtcggtaccagaccacgaccctacccgaacggaaccccggtccccaacgtcctcctactactacgtaagtacggtaactcggactaccgaccggcccgggtacccctaggaaccgggtacttaccgacgtaaccgttactttcccgtacgttcggtaccgtaccggtacgttcccgtccggtccccgttccccggtcccggtccccgttcccggtacgggtacccctaggtccgggtaccggggttcccgggtaccccggttaccggggacgtaaggggtacgtcggaacggttactttaaaggtaactttacggttccggtggtaagttccgggtttagggttcgggaaccttcgggaaccgtttacggtcggtacggggttaccggttccggggtacccggttaggggttccgggtaaccggggacgggtaaccggaccctaggtccgtacccgggtaacccgttcgggtaacgggtcccacccgggtaccccgacgttcccccgtcccggttacccccgg

SEQ ID NO: 82938 - DNA, 612 bp, Homo sapiens
  misc_feature: GYAE6OF01BQQN8.25.23.C01.1.454.CMB.1.raw
  modified_base (199)..(199): a, c, t, g, unknown or other
  misc_feature (199)..(199): n is a, c, g, or t
  modified_base (226)..(226): a, c, t, g, unknown or other
  misc_feature (226)..(226): n is a, c, g, or t
  modified_base (340)..(340): a, c, t, g, unknown or other
  misc_feature (340)..(340): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgtctgggancagctccgagtcggaaatagttgctactggtaccagcagctccagaaaccggccccaagctcctcatctataggaatgatcagcggccctcgagggactacctgaccgtattcnctggctcgaagtctggctcctcggccctccgtggccatcgagtcggggctcccgggtccgagggtatcggacggctaggaattagttacgtgtcgcgtaggtttgggatggcctaggtctgggtagttcggtacccggtagggttcggttcgggacgggacgggtacctaacggtccgtacgggacccgttccggttacgggttacccgaccgggtaccccgtaaacggggtcccttacccgggcccccccgttcggggtccctaaccccgg

SEQ ID NO: 82939 - DNA, 542 bp, Homo sapiens
  misc_feature: GYAE6OF01EC0T3.25.23.C01.1.454.CMB.1.raw
  modified_base (200)..(200): a, c, t, g, unknown or other
  misc_feature (200)..(200): n is a, c, g, or t
  modified_base (228)..(228): a, c, t, g, unknown or other
  misc_feature (228)..(228): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggancagctccgacgtcggaaattagtttgtctactggtaccagcagcctcccagaaaccggcccccaagcctcctcatctataggaatgatcagcgccctcagggatacctgaccgattctctggctcgaagtctggcctcctcggccctcctggcccatcagtcgggcctccggccgaggatggagctgaattattacgtgtgcgtagtttggatgcctagtcgtgagttcggtccggacggttgtcggcgggaggaccaagccgtggacccgtcgtaggcacgcccgaaggtcctcggcccccttggtcctaccg

SEQ ID NO: 82940 - DNA, 697 bp, Homo sapiens
  misc_feature: GYAE6OF01CXJ2D.25.23.C01.1.454.CMB.1.raw
  modified_base (186)..(186): a, c, t, g, unknown or other
  misc_feature (186)..(186): n is a, c, g, or t
  modified_base (237)..(237): a, c, t, g, unknown or other
  misc_feature (237)..(237): n is a, c, g, or t
  modified_base (307)..(307): a, c, t, g, unknown or other
  misc_feature (307)..(307): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctnagtgtctcgggacccccaggcaggagggtctccatctcttgttcgtgggancagctccggacgtacggaaattagtttgtctactggtaccagcagctccagaaccggccccaagcctccncatctagtaggaatgaatcacgccggccctagagggtactaccgtgaaccgtattccgtcgtcggctacgtaacgttcgtcggccttcccgtccggtcccttcccgtcggccctagtccgtacggtcgggtccgttcccgggtaccggaggtacgtgggacggtcgtagtaattacgttacgtggtacgtacgtagggttttacgggacttcggtaccgtaggttcgttagggtacggttcgggtacccgggttaccggggttcgggtttaccgggggacggggtaacggggtaacccgtaacgggtccgttaccgggtaccccggttaccggttaccgggtacccgtaacccggtaccccggtaaacgggtccccggttaacccccggg

SEQ ID NO: 82941 - DNA, 579 bp, Homo sapiens
  misc_feature: GYAE6OF01DRSN5.25.23.C01.1.454.CMB.1.raw
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
  modified_base (306)..(306): a, c, t, g, unknown or other
  misc_feature (306)..(306): n is a, c, g, or t
  modified_base (331)..(331): a, c, t, g, unknown or other
  misc_feature (331)..(331): n is a, c, g, or t
  modified_base (351)..(351): a, c, t, g, unknown or other
  misc_feature (351)..(351): n is a, c, g, or t
tcagactgtacagtcacgaccggtgctcgatttagtacacgtgattagggattggggagcttcagctgtggtagagaagacaggattcaggacaatctccagcatggccggcctcccctctcctcctcaccctcctcactcactgtgcagggtcctgggcccagtctgtgctgactcagccaccctcagtgtctgggacccccgggnagagggtctccatctcttgttctgggancagctccgacgtcggaaaataagtttgtctactggtaccagcagctcccagaaaccggccccaagctcctnatctataggatgatcagcggccctnaggactacctgaccgattcnctggctcgagtctggcctccgtcggccctcccgtggccatcgaggtcggctcccggtcgaggatgaggctagaatattactgtgcgtaggtttggatgccgtagttcgtaggtaggtcggtccggtaccgggttggttccgggacgggacgggtaaccgaaggtccgtcggacccgttccgtaacggtccaacggaccccgaaacgggtcccgtccggtaccccccgg

SEQ ID NO: 82942 - DNA, 593 bp, Homo sapiens
  misc_feature: GYAE6OF01EBAGR.25.23.C01.1.454.CMB.1.raw
  modified_base (192)..(192): a, c, t, g, unknown or other
  misc_feature (192)..(192): n is a, c, g, or t
tcagactgtacagtcacgaccggtgctcgatttagtacacgtgattagggattgggggagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggagcagctccgacgtcggaaatagtttgtctactggtaccagcagctccagaaaccggccccaagctcctcatctataggaatgatcagcggcctcagggatacctgaccgattctctggctcgaagtctggctcctcggcctccctggccatcagtcgggctcccgggtccgaggatggaggctagtaatattactgtgcgtaggtttggatcgcctagtcgtggaggttcggtcccggtacgggttggttaccgggcgggaacggggaccaaggccgtaggacccggttccgtaacgggtccaacggccccgaagggtcctccggtccccccgtcgggtaccctaccgttcccgttccggttccccgtcccccg

SEQ ID NO: 82943 - DNA, 565 bp, Homo sapiens
  misc_feature: GYAE6OF01B9XDM.25.23.C01.1.454.CMB.1.raw
  modified_base (191)..(191): a, c, t, g, unknown or other
  misc_feature (191)..(191): n is a, c, g, or t
  modified_base (214)..(214): a, c, t, g, unknown or other
  misc_feature (214)..(214): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttcngggagcagctccgacgtcggaaataagtttgtctactggtaccagcagctccagaaacggcccaagctcctcatctaataggaatgatcagcggtcctcagggatacctgaccgattctctggctcgaagtctggctcctcggcctccctggccatcgagtgggctccggtccgaggatgaggctgtaaatacttactggtagcgtaaggtttgggatcgcgtagtcgtgtaaggtcggtccggtacgggttggttcgggcgggtacgggaccgaagcgtcgtacccggtcgttaggtccacggcccgacggctaccgccccgtacgctacgtctccggttcccctacccg

SEQ ID NO: 82944 - DNA, 557 bp, Homo sapiens
  misc_feature: GYAE6OF01ES02G.25.23.C01.1.454.CMB.1.raw
  modified_base (206)..(206): a, c, t, g, unknown or other
  misc_feature (206)..(206): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggagcagctccgacgtcggaaataagtttgtctactggtaccagcagctcccagaaaccggcccccaagcctcctcatctataggaatgatcagcggccctcgagggataccgtgaccgtattctctggctcgaagtctgctcctcggcctcccgtggccatcgagtcgggctcccgggtcgaggatggaggctagaattattactgtgctaggtttggatcgcctagtctgagtcggtccgagggttgttcgggacggtacgggacctaaggcgtacggacccgtcgtagggtccacggaccccgaagggtcctccggtccccccg

SEQ ID NO: 82945 - DNA, 591 bp, Homo sapiens
  misc_feature: GYAE6OF01BK7VQ.25.23.C01.1.454.CMB.1.raw
  modified_base (219)..(219): a, c, t, g, unknown or other
  misc_feature (219)..(219): n is a, c, g, or t
  modified_base (399)..(399): a, c, t, g, unknown or other
  misc_feature (399)..(399): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccgggcagagggtctccatctcttgttctgggancagctcgacgtcggaaatagtttgtctactggtaccagcagctcccagaaaccggccccaagctcctcatctataggaatgatcagcggccctcgagggactaccgtgaccgtattctctggctcgaagtctggcctccgtcggccctcccgtggccatcagtgggcctccgggcgaggntggaggctagaatattactgtgctaggtttgggatcggcctaggttctggtaggttcgggtccggtagggtggttcgggcgggaggaccgaaggcgtacgaccggtccgtagggtccgacgacccgaacgggtccctccggaccccccgttcgggtacctaccgttccgttcccgttccccccgtacccccg

SEQ ID NO: 82946 - DNA, 642 bp, Homo sapiens
  misc_feature: GYAE6OF01ALS9U.25.23.C01.1.454.CMB.1.raw
  modified_base (206)..(206): a, c, t, g, unknown or other
  misc_feature (206)..(206): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccggnagagggtctccatctcttgttctgggagcagctccgacgtcggaaataagtttgtctactggtaccagcagcctcccagaaaccggcccccaagcctcctcatctataggaatgatcagccggccctcgagggactacctcgaccgtattctcgtggctcgaagtctcggcctccgtccggtccctcccgtcggcctacgtccgagggtccgggtcccgtcccgggtcccggaagggtacgtacgggacgggtcctaggtaaactttacgttaccgtggttcgaccgttaggtttgggactcgcccgtagttcgtaggtacggtcgggttcccggtacgggttcggttccggggacgggtacggggaccaagggtccgtcggacccgttccgtacggtccgacggaccccgtaagggccgtcccggtaccccccgg

SEQ ID NO: 82947 - DNA, 681 bp, Homo sapiens
  misc_feature: GYAE6OF01B9DR7.25.23.C01.1.454.CMB.1.raw
  modified_base (307)..(307): a, c, t, g, unknown or other
  misc_feature (307)..(307): n is a, c, g, or t
  modified_base (349)..(349): a, c, t, g, unknown or other
  misc_feature (349)..(349): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcgagggtccgtggcccgagtacgtgtgcttgactcagccaccctcagtgtctcgggacccccgggcaggagggtctccatctcttgttctgggagcagctccgacgtcggaaattagtttgtctactggtaccagccagctcccagaaaccggcccccaagcctccncatcctataggaatgactcgagccggccctgagggactaccncggaccattctcgtggctcgaagtcgtcggctccgtccggccctcccgtcgcctactcgaggtcgggcctccgggtccgagggagtcggaacggctagtaattactttacgtggttcgtcgttaggtttgggtactcgcccgtaagttcgtgggtacggttcgggtacccgtacggggttcgggttaccgggacggggtaaccggggaaccgtaacggtccggttaccgggtacccggttacccggttaccggggtaccctaaccgggacccccggtaaaccgggttccccgtacccggccccccccggtttacgggtccccttaaccccgg

SEQ ID NO: 82948 - DNA, 596 bp, Homo sapiens
  misc_feature: GYAE6OF01AJXDA.25.23.C01.1.454.CMB.1.raw
  modified_base (199)..(199): a, c, t, g, unknown or other
  misc_feature (199)..(199): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggagcagctccgacgtcggaaatagtttgtctactggtaccagcagcctcccagaaaccggcccccaagcctcctcatctaataggaatgatcagccggccctcagggatcctagaccgtattctctggctcgaagtctggctccgtcggccctccccgtggcccagtcgacggtcgggccgttcccgggtccggagggtacgttcggacgggtcctaggtaacttagtttaccgtggttcgcgttagggtttgggacgtcgccgtaggttcgtaggtaggttcggtccgggtacgggttggtccgggcggacggaccgaagcgtcgtaccgtcgtggccacgcccgtacggcctccggcccctggtcctccg

SEQ ID NO: 82949 - DNA, 626 bp, Homo sapiens
  misc_feature: GYAE6OF01DNE67.25.23.C01.1.454.CMB.1.raw
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccgggcagagggtctccatctcttgttctgggagcagctccgacgtcggaaattagtttgtctacgtggtaccagcagctacccagaaaccggccccaagcctctcatctataggaatgatcagcgccctgagggactacctgaccgtattcctctcggctcgtaagtctggccttccgtcggcctccctggcctagtcaggtcgggcctccgggtacgaggatggaggctagtaattagttaactggtgcgttaggtttgggattcgacctaggtcgtagggaggttcgggttacccgggtagggtttcggttacgggacgggtaccgggaccgaacggccgttacggacccggttacgtacgggtaccgacggaccccgaaggcccgttcccgcccccgttcgggtacctaccgtccgttcccgttccccgtacccccg

SEQ ID NO: 82950 - DNA, 828 bp, Homo sapiens
  misc_feature: GYAE6OF01CSSC3.25.23.C01.1.454.CMB.1.raw
  modified_base (228)..(228): a, c, t, g, unknown or other
  misc_feature (228)..(228): n is a, c, g, or t
  modified_base (241)..(241): a, c, t, g, unknown or other
  misc_feature (241)..(241): n is a, c, g, or t
tcagactgtacagtcacgaccggtgctcgatttagtacacgtgattagggtagtttgggggagcgtagtggtagaggaacgacacggattcgaggacaatcgtccaggcgatcggccggcctccctactccttcctcaccctcctacactctactcgtgcagggtcctgggcccagtctggtgcgtggactctagtccacctcgagggtcgtcgtcgggacccccggnacgtaggggtccnccagtccttcgttggttctgggactcagccgtccgtacgtcggaaattagttcgtactacggtcggtaccagcacgcgtaccgagtaaccggccccaagcctccatatactagtaggaatggactcgacgccggacctcgaacgggactaccgtcggaccgtaagttccgtacgttcggacctacggtaacgttccgtacgggaccttaccccggtaccgggccccttacccggtacgggacccaagtttccggtaacgggttccgggtcccggtaccccgggtaaccggtaacgggaacgttcgggtaacgggtaccgttaagggtaaaccgttaacggtttaaccggtacgggtacggtacgtttacgggttttagggtaacctttcggtaccgtagggttaccgtaagggtacgggttaccgggttacccggtaacgggttcgggttacccgggacggggtaccgggtaacccggaacggtccggttaccgggtaccccggttaccggtaaccgggttaccgaacccggtacccggtaaaccggtcccgttacccggtaccccccgtcggtacccgttaccccg

SEQ ID NO: 82951 - DNA, 626 bp, Homo sapiens
  misc_feature: GYAE6OF01DX65K.25.23.C01.1.454.CMB.1.raw
  modified_base (210)..(210): a, c, t, g, unknown or other
  misc_feature (210)..(210): n is a, c, g, or t
tcagactgtacagtcacgaccggtgctcgatttagtacacgtgattagggattggggcagcttcagctgtggtagagaagacaggattcaggacaatctccagcatggccggcctccctctcctcctcaccctcctcactcactgtgcagggtcctgggcccagtctgtgctgactcagccaccctcagtgtctcggggaccccccgggnaggagggtctccatctcttgttctgggagcagctccgacgtcggaaataagtttgtctactggtaccagcagctcccagaaccggccccaagcctcctcatctataggaatgatcagccggccctcgagggactaccgtgaccgtattctcgtcggctacggaagtcgtggcctcccgtccggtccctcccgtggcccattccgaggtcgggccgtcccgggtccggaggactgggacggtcctaggtaaacttactttacgtggtgtcgttagggtttcgggattcgccgtaggttcgtaggtagggttcgggtcccggtagggttcggttacggggcgggtaacgggacccgaaggtccgttacggacccggttccgttacgggtaccgacgccccggaaggtcccgtccccgg

SEQ ID NO: 82952 - DNA, 553 bp, Homo sapiens
  misc_feature: GYAE6OF01EO5SN.25.23.C01.1.454.CMB.1.raw
  modified_base (191)..(191): a, c, t, g, unknown or other
  misc_feature (191)..(191): n is a, c, g, or t
  modified_base (310)..(310): a, c, t, g, unknown or other
  misc_feature (310)..(310): n is a, c, g, or t
  modified_base (385)..(385): a, c, t, g, unknown or other
  misc_feature (385)..(385): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggagcagctccgacgtcggaaatagtttgtctactggtaccagcagctccagaaacggccccaagctcctcatctataggatgatcagcggcctnagggatacctgaccgattctctggctcgaagtctggctcctcggcctcctggccatcagtcggctcggtcgaggntgaggctgaatattactgtgctaggtttggattcgcctagtctgaggttggtccggtagggttgttcgggcgggagggaccaaggcgtggaccggtcctagggtcaggacccgaagggcctcggccccccgttcggtacctaccgttccgttcgttccccctaccccg

SEQ ID NO: 82953 - DNA, 647 bp, Homo sapiens
  misc_feature: GYAE6OF01EIVRH.25.23.C01.1.454.CMB.1.raw
tcagactgtacagtcacgaccggtgctcgatttagtacacgtgattagggattggggacaggattcaggacaatctccagcatggccggcctccctctcctcctcaccctcctcactcactgtgcagggtcctgggcccagtctgtgctgactcagccaccctcagtgtctgggacccccgggcagagggtctccatctcttgttctgggagcagctccgacgtcggaaataagtttgtctactggtaccagcagcctccagaaaccgccccaagctcctcatctataggatgatcagccgccctcgagggactacctgaccgtattctcgtggctcgaagtcgtgcctccgtcggtccctcccgtggccatcgaggtcgggcctccgggtcgaggatggaggtctagtaattagttacgtgtcgtcgtaggtttgggattcggccgtagttcgtggtaggttcgggtacccggtagggttcggtccggggacgggaacgggaaccaacggtccgtacggtacccgttcgtacgggtccgaaccggtacccgaacgggtccctccggtcccccccgttacgggtccctaacccgttccggtttccccggttaccccccgtcccccgtttcccgtcccgttaacccgg

SEQ ID NO: 82954 - DNA, 544 bp, Homo sapiens
  misc_feature: GYAE6OF01A6BSJ.25.23.C01.1.454.CMB.1.raw
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggcagagggtctccatctcttgttctgggagcagctccgacgtcggaaataagtttgtctactggtaccagcagctccagaaacggcccccaagctcctcatctataggaatgatcagcgccctcgagggatacctgaccgattctctggctcgaagtctggcctccgtcggcctccctggccatccagtcgggctccggtccgaggatggaggctggaactattactgtgcgtagtttggatgcctagtctggagtgggtccgtacggtgttccgggcggtacgggaccaaggctcggacccgtcgttacggtcacgcccaagggcctcggtccccccgg

SEQ ID NO: 82955 - DNA, 662 bp, Homo sapiens
  misc_feature: GYAE6OF01AGXGB.25.23.C01.1.454.CMB.1.raw
  modified_base (465)..(465): a, c, t, g, unknown or other
  misc_feature (465)..(465): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggcagagggtctccatctcttgttctgggagcagctccggacgtacggaaataagtttgtcttactggtaccagcagcctacccagaaaccggcccccaagcctcctcatctataggaatgatcagccggccctcgagggactaccgtgaaccgtactttcgtcgtacggccttacggaacgttccgtcggtcccttcccgtcccggtcccttccccgtcgggccctagtcgagggtcgggccctcccgggtcgaagggtnttagggacggtcgtagaattagtttacgtggtgtacgtaggtttagggatccggccgtagttcgttggacgggtttcggtacccgggtagggttcggttccggggacgggtacggggaaccaaggtccggtcggtaccccggttcgtacgggtaccgaccggaccccggtaacggcccgttacccggtccccccggg

SEQ ID NO: 82956 - DNA, 175 bp, Homo sapiens
  misc_feature: GYAE6OF01AEOFD.25.23.C01.1.454.CMB.1.raw
  modified_base (171)..(175): a, c, t, g, unknown or other
  misc_feature (171)..(175): n is a, c, g, or t
tcagactgtacagtcacgaccggtgctcgatttagtacacgtgattagggattgggggaagaggaagactgacggtccccaggagttcaggtgctgggcacagcggccctgggctgcctggtcaaggctacttccactgtacagtctgagcgggctggcaaggcgcatagnnnnn

SEQ ID NO: 82957 - DNA, 938 bp, Homo sapiens
  misc_feature: GYAE6OF01D37UF.25.23.C01.1.454.CMB.1.raw
  modified_base (215)..(215): a, c, t, g, unknown or other
  misc_feature (215)..(215): n is a, c, g, or t
tcagactgtacagtcacgaccggtgctcgatttagtacacgtgattagggattggggacgacttcagctgtggtagagaagacaggattcaggacaatctccagcatggccggcctccctactcctcctcacctcctcactcactgtgcgaggtccgtcgggccagtctgtcgactgactcgacgccacctcgagtcgtccgtacgggacccggngtaacggtcggtcctaccgtattccgttcgtttcggttcggtacgggactccgtaacgtccgtaccggtaacggtacggtaaaagtttacggtttcgtacttacggtaggtaccagacgtacgtacctaaccgaacggtaacccggcccctaaggtcctacctacgtacttacgtaacggtaacggaacttcgtacgttacggaaccggtcccggtacccgttaacggaacggtaaccttaccgtaacggtaaccgttagttccgtacgtcggtaacttaacgggtacgttcgtacggtaccgttccggtaccgggtaccttaccgggttcgaaccgttacgtacggaccggggttccggttacccggttaccccgggtagtaaacggttcgtacggggttaaccggttaacttaaacgggttaaaccttttacggggtttaacccgtggtttaacccgggttaccggttaacggggtttcccgggaattcccggggtaccgtttaaacggggtttccgtaacggggttaccgggttacccgggttaaaccgggtttcggggtacccggttccggggaaaacgggtttaccccggtaaccttaagggttaccccggttccggggtaaaacccccggtttacggttaaaccgggggtacccctaaaacccgggggttaaccccgttcccgggttccccgggttaaccccgggtttacccccggg

SEQ ID NO: 82958 - DNA, 714 bp, Homo sapiens
  misc_feature: GYAE6OF01EATSO.25.23.C01.1.454.CMB.1.raw
  modified_base (210)..(210): a, c, t, g, unknown or other
  misc_feature (210)..(210): n is a, c, g, or t
  modified_base (239)..(239): a, c, t, g, unknown or other
  misc_feature (239)..(239): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagcccaccctcagtgtcgtcgggaccccccgggnaggagggtctccatctcttgttctgggancagctccgacgtcggaaattaagtttgtctactggtaccagcagctaccaagaaccgccccaagcctcctcatcagtaggatgatcagccgcctcgagggactaccgtgaccgtattcgtcgtggtcctacggtaacgtcgtcggcccttccgtccggtcccttcccgtcggcctacgtccgtagggtcgggtcccgttcccgggtaccgagggacgttcgggaggtcgttaagtaaactttacgtttacgtaggttcgtaccgttagggtttggggaacttcggacccgtacggttcgtcgggtaagggttccgggttacccggtacggggtttcgggttccgggggaccggggtaaaccgggggtaaccctaagggacccggtttaccgggaaccccggtttaccggtaaccgggttaccgaacccgggtaaccccggtaaacgggtccccgtcccgggttaccccccccggg

SEQ ID NO: 82959 - DNA, 605 bp, Homo sapiens
  misc_feature: GYAE6OF01E5JII.25.23.C01.1.454.CMB.1.raw
  modified_base (242)..(242): a, c, t, g, unknown or other
  misc_feature (242)..(242): n is a, c, g, or t
tcagactgtacagtcacgaccggtgctcgatttagtacacgtgattagggattgggggggaagctcagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggcagagggtctccatctcttgtctgggancagctccgacgtcggaaatagtttgtctactggtaccagcagctcccacgaaacggcccccaagctcctcatctataggaatgatcacgccggccctcgaggactaccgtgaccgatttctcgtcgctcgaagtctggctccgtcggtccctcccgtggccctagtccgtaggtcggggtccttcccgggtccggagggagttcggaggatagaaattatttacgtgtgcgtaggtttgggatggcctaaggtctggaggttcggtcccggacgggtttaggttccgggaggggacggggacccgaaacggtcgttcggtaaccccgggttccttaagggtccgaaccggccccgtaaacggg

SEQ ID NO: 82960 - DNA, 597 bp, Homo sapiens
  misc_feature: GYAE6OF01BB60W.25.23.C01.1.454.CMB.1.raw
  modified_base (200)..(200): a, c, t, g, unknown or other
  misc_feature (200)..(200): n is a, c, g, or t
  modified_base (228)..(228): a, c, t, g, unknown or other
  misc_feature (228)..(228): n is a, c, g, or t
  modified_base (330)..(330): a, c, t, g, unknown or other
  misc_feature (330)..(330): n is a, c, g, or t
  modified_base (340)..(340): a, c, t, g, unknown or other
  misc_feature (340)..(340): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggancagctccgacgtcggaaatagtttgctactggtaccagcagctcccagaaccgccccaagctcctcatctataggaatgatcaggcgccctgagggataccngaccgattcnctggctcgagtctggctcctcggcctccgtggcccatcgaggtcgggcctccggtccgaggactggaacggctagaacttacttacgtggtacgtgtaggtttgggattcggcctaggtccgtaggtacgggttcgggttaccggtacgggttggttccggggacgggaagggtacccaaggtccgtacgggtacccgttcggtacgggtccacggacccgtaaggtccctcccggcccccgttcgggtcctacccg

SEQ ID NO: 82961 - DNA, 766 bp, Homo sapiens
  misc_feature: GYAE6OF01D2FPW.25.23.C01.1.454.CMB.1.raw
  modified_base (221)..(221): a, c, t, g, unknown or other
  misc_feature (221)..(221): n is a, c, g, or t
  modified_base (295)..(295): a, c, t, g, unknown or other
  misc_feature (295)..(295): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctcgggacccccgggcagagggtctccatctcttgttcgtgggancagcctccgacgtcggaaattagtttgtctactggtaccagcagcctcccaagaaaccggcccccaagcctccncatctataggaatgatcgacgccggccctcgagggtactaccgtgaccgtattcctcgtcgggacttacggaacgtcgtggtcccttccgtcccggtcccttcccgtgggccctacgttccgtagggttccgggcccgtttcccggggtccggtaaggtacgtacgggacgggtctaagggttaaacttacgtttaacgtcggtcggtaccggttaagggttttggggaacgttcggtacccgtaggtttccgtagggtaacgggtttccgggttacccgggtaacgggggttttcgggttaccgggggaccgggtaacgggggaacccgtaacgggtcccgttaaccgggtaccccggttacgtaacgggtcccgtaaccggggaccccgtaaacgggtcccgtaccccggtccccccggtttaccggtaccctaccgtttcccggttccccgttcccccgtaccccccg

SEQ ID NO: 82962 - DNA, 817 bp, Homo sapiens
  misc_feature: GYAE6OF01EKOUW.25.23.C01.1.454.CMB.1.raw
  modified_base (217)..(217): a, c, t, g, unknown or other
  misc_feature (217)..(217): n is a, c, g, or t
tcagactgtacagtcacgaccggtgctcgatttagtacacgtgattagggattgggggggaagctcagcttcagctgtggtagagaagacaggattcaggacaatctccagcatggccggcctccctctcctcctcaccctcctcactcactgtgcagggtcctgggcccagtctgtgctgactcagccaccctcagtgtctcggggacccccgggnaggagggtctccatctcttgttctgggagcagctccgacgtcgaaataagtttgtctactggtaccagcagctcccagaaaccggccccaagctcctcatctataggaatgatcagccggccctcgagggactaccgtgacccgatttcctacgtggccttacggaagttccgtcggcccttccccgttcccggggtccccttcccccgttcgggacccctaacgtttcccgtaaacggggttcggggtccccgtttacccccgggggttaccccgggaaggggtacgttacggggaaccgggtccgttaacgggtaaaatttaaccgttttaaccgttgggtttccggtacggtttaaggggttttttacgggggaactttcgggtacccccgtaagggtttcccggttagggttaaccggggtttcggggttaccccggggtaacccgggggttttggggtttaccccggggggaacggggggaaaccgggggttaaccccgaaaacgggggtccccgttaaccggggtaacccccggtttaccccgggttaaaccgggggtcccgtaaacccgggaccccccggttaaaaccggggg

SEQ ID NO: 82963 - DNA, 778 bp, Homo sapiens
  misc_feature: GYAE6OF01CG520.25.23.C01.1.454.CMB.1.raw
tcagactgtacagtcacgaccggtgctcgatttagtacacgtgattagggattgggagggctttgttggagaccctgtccctcacctgcagtgtctctggtggctccgtcagtgcttattactggagctggatccgccagtccgccgggaggggactggagtggattgggcgtatatatacgaatggattaaccacctacaacccctccctcaagagtcgagtcaccatatcagcggacacgtccagggatcaggtgttcctgcatctgacttctgcgactgccgcggacacggccctatactactgtgccagagattcggactgcgacgtatttttcggagtaattattatctttagtgtcttttgactattggtggggtcccgaaaggggaccgtaacgggtcaacccggttctccgtttcgacgtcccttcccaacccgaaacggggtccccctaacgttcccgggttcccctttccccccccgttcggggccccctaaacccccccttccccgtttacccccaaaacgggtaacccgtacccgtaaccccgttcccgggttaccgggggggacccaacccggaaccgggtccccgggggtacccccgttccggggggcccgttccgggtccccgtacgggggttaccccggaaaacggggtacccgtttaaccccggtttacccctaacccggttacggttaaccccgtaaggtttcccgttacgggaaccggggtaccgggggtcccggttacggggccggtaaacccggggg

SEQ ID NO: 82964 - DNA, 578 bp, Homo sapiens
  misc_feature: GYAE6OF01B8UC7.25.23.C01.1.454.CMB.1.raw
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
  modified_base (293)..(293): a, c, t, g, unknown or other
  misc_feature (293)..(293): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggancagctccgacgtcggaaatagtttgtctactggtaccagcagctccagaaccggccccaagctccnatctataggaatgatcagcgccctcgagggatacctgaccgattctcgtggctcgaagtcgtggcctccgtcgccctcccgtggccctatcgacggtcgggccgtccgggtccgaggagtggaggtctagaattattacgtgtgcgtagtttggatgcctagttctggtagtcgggtaccgtacgggtgttcggggcggacgggaccgaaggtcgtacggacccgttccggtacgggtcccaacggcccgtaacgggcctccggccccccgtggtcccgtacccg

SEQ ID NO: 82965 - DNA, 686 bp, Homo sapiens
  misc_feature: GYAE6OF01C0I8X.25.23.C01.1.454.CMB.1.raw
  modified_base (214)..(214): a, c, t, g, unknown or other
  misc_feature (214)..(214): n is a, c, g, or t
  modified_base (315)..(315): a, c, t, g, unknown or other
  misc_feature (315)..(315): n is a, c, g, or t
tcagactgtacagtcacgaccggtgctcgatttagtacacgtgattagggattgggagggctttgttggagaccctgtccctcacctgcagtgtctctggtgctccgtcagtgcttattactggagctggatccgccagtccgccgggagggactggagtggattgggcgtatatatacgaatggattaaccacctacaacccctcctacaagngtcgagtcaccatatcagcggacacgtccgagggactcgaggtgttcctgcatctgtacttctgcgactcgccgcggaccacggccctatactactcgtcnccagacgtagttcggactcgcgtacgttagttttcggaagtaatttatttattctttgtgttcttttgactagtggtggggaccgaagggacgtacggtcgaccgttctcgttcgacgtccctaccgaccgaacgggtccctacgttcccggttacccttcccccgttcgggaccctacccccgttcctaccgaaacgtacgtaccgtacccgttcgggtaccggggccaaccgggtcggacccgggtcccgtcggggcccttcgggccgttaccgggtaccgtaaaccgggtacccttacccgttacccgtacgttcgttaacccgtacggttaccgtacggacggtccggggtactgggacgaaccggg

SEQ ID NO: 82966 - DNA, 612 bp, Homo sapiens
  misc_feature: GYAE6OF01COBL8.25.23.C01.1.454.CMB.1.raw
  modified_base (192)..(192): a, c, t, g, unknown or other
  misc_feature (192)..(192): n is a, c, g, or t
  modified_base (200)..(200): a, c, t, g, unknown or other
  misc_feature (200)..(200): n is a, c, g, or t
  modified_base (211)..(211): a, c, t, g, unknown or other
  misc_feature (211)..(211): n is a, c, g, or t
  modified_base (220)..(220): a, c, t, g, unknown or other
  misc_feature (220)..(220): n is a, c, g, or t
  modified_base (222)..(222): a, c, t, g, unknown or other
  misc_feature (222)..(222): n is a, c, g, or t
  modified_base (226)..(226): a, c, t, g, unknown or other
  misc_feature (226)..(226): n is a, c, g, or t
  modified_base (232)..(232): a, c, t, g, unknown or other
  misc_feature (232)..(232): n is a, c, g, or t
  modified_base (237)..(237): a, c, t, g, unknown or other
  misc_feature (237)..(237): n is a, c, g, or t
  modified_base (310)..(310): a, c, t, g, unknown or other
  misc_feature (310)..(310): n is a, c, g, or t
tcagactgtacagtcacgaccggtgctcgatttagtacacgtgattagggattggggcagcgttcagctggtggtagagaagacaggattcaggacaatctccagcatggccgcctccctctcctcctcaccctcctcaactcacgtgtgcagggtcctgggccctagtctgtgctgactcacgcccacctnagtcgtcncgggacccggnaggcggtcncntctntgtcgnggacncagctcgacgtcgaaatagttgtctacgtgtacctagcagctccagaaccgcccctaagctcctcgactctanaggaactgaactcgacggcgtccgtcgaaggtactaccgtgaccgtatctgtggctacgtaagtctacgtctcgtccggcctccgcggtcccaagccgaggtcggccgtccggtacgagacgtggaacggtctaacggtaattacgtacttggtaacgtcgtaagggtttggaacgttcgaccgagttcgagggtacgttacgggcccggtagggttccgggtacgggacggaacgggtaacccgagtcgttacgaccccgtcggtaacgggtcaacgggtcccaaagggtcctaccccggg

SEQ ID NO: 82967 - DNA, 554 bp, Homo sapiens
  misc_feature: GYAE6OF01EZFME.25.23.C01.1.454.CMB.1.raw
  modified_base (227)..(227): a, c, t, g, unknown or other
  misc_feature (227)..(227): n is a, c, g, or t
  modified_base (451)..(451): a, c, t, g, unknown or other
  misc_feature (451)..(451): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccggcagagggtctccatctcttgttctgggancagctccgagtcggaaataagtttgtctactggtaccagcagctcccagaaaccggcccccaagcctcctcatctataggaatgatcagccggccctgagggactacctgaccgtattctctggctcgaagtctggcctcctccggcctcccgtggccctatcgaggtcgggcctccgggtcgagggatggaggctagaattagttactgtgcgtaggtttggntgcctagtcgtgtaggtcggtcgtaggtgttcgggcggacgggaccagcgtcggacccgtcgtcggtcacggacccgaggcctaccggcccctggtcctaccg

SEQ ID NO: 82968 - DNA, 655 bp, Homo sapiens
  misc_feature: GYAE6OF01E177M.25.23.C01.1.454.CMB.1.raw
  modified_base (230)..(230): a, c, t, g, unknown or other
  misc_feature (230)..(230): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctcggggacccccgggcagagggtctccatctcttgttctgggancagctccgacgtcggaaattaagtttgtctactggtaccagcagcctcccagaaaccggccccaagcctcctcatctataggaatgatcgagccggccctcgagggactaccgtgaccgtattctcgtggctcggaagttccgtggtcctccgtccggcccttcccgtcggccatcgtaggtcgggtccgtccgggtccggagggtacgtacggacggtcgtagtaacgttacgttacgtgtcgtacgtaggtttgggtacgtcgtccgacgttttttttcgaggttacggttcgggtccggtacgggttcgggttaccgggcggggtaacgggtaccgtaacggtcgtaccggtacccggtccggttacggtacgaccggacccgtaacggtccgtcccggtcccccgtccggtcccgtacccg

SEQ ID NO: 82969 - DNA, 652 bp, Homo sapiens
  misc_feature: GYAE6OF01CT1VA.25.23.C01.1.454.CMB.1.raw
  modified_base (273)..(273): a, c, t, g, unknown or other
  misc_feature (273)..(273): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggcaggacgggtctccatctcttgtctgggagcagctccgagtcggaaatagtttgtctactggtaccngcagctccagaaaccggccccaagctcctcatctataggaatgatcagccgcctgaggatacctgaccgattctctggctcggaacgtcgtgccttccgtcggcctcccgtgccatcgagtcggctcccgggtccgaggtactggaggtcctaggtaaattacgttaaccgtgttacgtcgtaggtttacggtacggtacgtccgtacgtacgttgtacgggtacggttccgggtacgggttacgggttaccggggtacggggaccggggtaaacccgggaaggtaccggttccggtaaccccggggtacccggtttaacggtacccggtaaccggtaaccccggtaaccggtaccgggtccccggttccccccccggg

SEQ ID NO: 82970 - DNA, 691 bp, Homo sapiens
  misc_feature: GYAE6OF01B84HL.25.23.C01.1.454.CMB.1.raw
  modified_base (240)..(240): a, c, t, g, unknown or other
  misc_feature (240)..(240): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtcctcggggacccccgggcaggacgggtctccatctcttgttcgtgggancagctccggacgtacggaaataagtttgtctacgtggtaccagcagcctcccaacgaaaccggcccccaagcctcctcatctaagaggaatgactcgacgccggccctcgagggtactaccgtgaccgtatttcctctggcctacgaacgtctcgggtcctcccgtccggcccttcccgtcggccctatccgtacgggtcgggtcccgttcccgggtaccggaggacgttacggacggtacttagaaactttacgtttaccgtggtcgtacgttagggttttcgggattcggaccctaggttcgtacggtacggtcggggttaccggtacgggttcgggttaccgggcggggtaacgggacccgtaaagggtccggttccgggtaccccggttaccgttaacgggtaccgtaaccggaccccgaacgggtcccgtccccgggtaccccccg

SEQ ID NO: 82971 - DNA, 575 bp, Homo sapiens
  misc_feature: GYAE6OF01E1CSF.25.23.C01.1.454.CMB.1.raw
  modified_base (207)..(207): a, c, t, g, unknown or other
  misc_feature (207)..(207): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggnagagggtctccatctcttgttctgggagcagctccgacgtcggaaattaagtttgtctactggtaccagcagctccagaaccgcccccaagctcctcatctataggaatgatcagccggccctcgagggactacctgaccgtattctctggctcgaagtctggcctccgtcgccctcccgtggccatcgagtcgggcctcccggtccgaggatggaggtctagtaattattacgtgtgcgtaggtttggatcgccgtagttgtggagttcgggaccgtagggttggttccgggaggacgggtaaccgaaggccgtcggtacccgtcggtacggtcctacggaccccgtagggtccctccggtcccccg

SEQ ID NO: 82972 - DNA, 691 bp, Homo sapiens
  misc_feature: GYAE6OF01BY1MN.25.23.C01.1.454.CMB.1.raw
  modified_base (171)..(171): a, c, t, g, unknown or other
  misc_feature (171)..(171): n is a, c, g, or t
  modified_base (192)..(192): a, c, t, g, unknown or other
  misc_feature (192)..(192): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctnagtgtcgtcgggacccccggnaggagggtctccatctcttgttctgggagcagctccgacgtacggaaatagtttgctactggtaccagcagcctccagaaaccggccccaagcctcctcatctataggaatgatcgagccgcctgaggactacctgaccgtattctcgtggctacgtaagtcgtcggcctcccgtccggtccctccgtcggtaccctagtaccgtaacgggttccgggtccgttcccgggggttacccggaagggtacggttcgggacgggtactaggtaaactttacgttaacgttggttacggtacgtaagggttttgggacttcggacctaggtccgtggtacggtcgggtaccggagggttcggtcgggacggtacggacgtaaggtcgtaccggaacccggttcgtaacgggtccgaccggtacccggtaacgggtcccctcccgggccccccggttaacggtccctaacccggttccgttccccggttccccccgttaccccg

SEQ ID NO: 82973 - DNA, 626 bp, Homo sapiens
  misc_feature: GYAE6OF01B50V4.25.23.C01.1.454.CMB.1.raw
  modified_base (213)..(213): a, c, t, g, unknown or other
  misc_feature (213)..(213): n is a, c, g, or t
  modified_base (312)..(312): a, c, t, g, unknown or other
  misc_feature (312)..(312): n is a, c, g, or t
  modified_base (331)..(331): a, c, t, g, unknown or other
  misc_feature (331)..(331): n is a, c, g, or t
tcagactgtacagtcacgaccggtgctcgatttagtacacgtgattagggattggggggaagctcagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccggnagaggtctccatctcttgttctgggagcagctccgacgtcggaaatagtttgtctactggtaccagcagctccagaaccgccccaagctcctcatctanaggatgatcagccggcctnaggtactacctgaccgtattcctctggctcgaagtctggcctcgtcggtccctcccgtcggccatcgtagtcgggcgttcccgggtcggagggtatggaggtcctaggtaattacgtttaacgtggtgtacgttagggttttgggaagttcggacccgtaggttcctggtacgggttcgggtacccgggtaacgggttcgggttccgggacggggtaacggggtaacccgaacggtcccggttacggaaccccggtttacccgttaagggtcccaacgggtcccccgtaaacggg

SEQ ID NO: 82974 - DNA, 617 bp, Homo sapiens
  misc_feature: GYAE6OF01EFXVR.25.23.C01.1.454.CMB.1.raw
  modified_base (220)..(220): a, c, t, g, unknown or other
  misc_feature (220)..(220): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccgggcaggagggtctccatctcttgttctgggancagctccgacgtcggaaattagtttgtctactggtaccagcagctccagaacggccccaagctcctcatcataggaatgatcagcggccctcgagggatacctgaccgtattctctggctacgagtctggcctccgtcggccctccgtggcccatcgaggtcgggcctccgggtcgaggtatggacggcttagaattattacgtgtcgacgttggtttaggatcgcctaggtctggtacggtcgggttaccggagggttcggttcgggacgggacgggaccaacggccgtacggacccggttaccgttaacgggtccgaacggacccgaacgggtcccgtacccggtcccccccgttcgggtaccctaccgttccgttccgttcccccctacccccg

SEQ ID NO: 82975 - DNA, 923 bp, Homo sapiens
  misc_feature: GYAE6OF01BK7EZ.25.23.C01.1.454.CMB.1.raw
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgccctgactcagcctgcctccgtgtctgggactcctggacagtcggtcaccatctcctgcactcggaaccagcccgtgactagtttggtgtactttaattaaacttaattcggttccttcccgttcgggttaccccaaaacaaacccaaccccgacgggaccgaaaccgggaccccccaaaaaccttccaacttacctaatttttaacgtaggtaacttggtacctacgttacgtaacgttcccggccccttcgtacgggttaacgttttcgttcgggttccggtcctttccgtcgtttcgggtcctttacccgtaaacggttccgttacgggacctaaacccgttcccgggtacccctttaccccgtacggtaccccttaacgttcccggttcccgggggtacccttaccccggaacggggtccgttagggaaccgggaaccgggtaacggggttacctttaaccgtttttaaacgtttacgttttacggtactttaactttttaccaaacgtttaaaccgtaacgggtaaaccgtaacccgtaaacccgttaaaacgtaccgggtttacccgtttacgggggtttaccgggttttacccgggggtaccgggggtaaaccgggggttaaaccccgttaaaaggggtttacccggttaaccccggtttaccccgggttaccggggttaacccgaacccggtaaccccggtaaccgggtacccgttacccccggttacccccccgggttcgggttaaccccccg

SEQ ID NO: 82976 - DNA, 682 bp, Homo sapiens
  misc_feature: GYAE6OF01DZFJ6.25.23.C01.1.454.CMB.1.raw
  modified_base (207)..(207): a, c, t, g, unknown or other
  misc_feature (207)..(207): n is a, c, g, or t
  modified_base (236)..(236): a, c, t, g, unknown or other
  misc_feature (236)..(236): n is a, c, g, or t
  modified_base (395)..(395): a, c, t, g, unknown or other
  misc_feature (395)..(395): n is a, c, g, or t
tcagactgtacagtcacgaccggtgctcgatttagtacacgtgattagggattggggcagcttcagctgtggtagagaagacaggattcaggacaatctccagcatggccggcctccctctcctcctcaccctcctcactcactgtgcagggtcctgggcccagtctgtgctgactcagccacctcagtgtctcggggacccccggnaggaggtctccatctcttgttcgtgggancagcctccgacgtacggaaattagtttcgtactactggtaccagacagcctacccaaggaaaccggcccccaagtcctcctacactactaagtaggaatgatcacgccggacctcgaggactaccgtcgaccgtacttctcgtcggactacgaagttcncggtcctccgtacccggtccctcccgtggaccctacgtaccgtacgggttcggggtccccttccggggtaccgagggtaccgttggacgggtctaggttaaacttacgttttacgtggttcgggtacgttaaggttttggggacttcggtaccgtaggttccgtagggtacggttcgggtcccggtagggttccgggtcggggaccggggaacggtaaccagggtccgtaacgggtaccccttacggtacgggtacccacggaaccccggacggtcccgtaccccgg

SEQ ID NO: 82977 - DNA, 807 bp, Homo sapiens
  misc_feature: GYAE6OF01AFU5T.25.23.C01.1.454.CMB.1.raw
  modified_base (218)..(218): a, c, t, g, unknown or other
  misc_feature (218)..(218): n is a, c, g, or t
tcagactgtacagtcacgaccggtgctcgatttagtacacgtgattagggagttggggagcttcagctgtggtagagaagactaggattcaggacaatctccagcaatggccggcctccctctccctcctcgacccttcctcactcacgttgtgcagggtccttgggcccagtctgtgctgactcagccacccgtcagtgtcggtgggacccccgggnaggacgggtcctccgagttccttcgttgttcgtgggacgcgagcctccggacgttccggtaaaataacgtttcgcttacgtggtaaccagcagcctacccgacgaaacccggcccccaaggcctccctacgacttccgtaagtacggtaaagtcgaacgtcgacggccggtaccccgttaggtaacgggtacttaccgtacggtaacccgtaactttccgtacggttacggtaccttacggtaacggttcgttacgggtccctttcccggtaccgggtccccttccccggtacgggtccctaacgttccgtaacgggttccgggtacccgttaccccggggtaaccggaacgggtacgtagggaacggttccgtttaaggtaaacttttacgttaccgttggttacgtacggtttaaggttttcgggacgttcggaccgttaaggttccgtaggtaacggttcgggtacccggtacgggtttcggttaccgggacgggtaacgggacccgtaaggtccgttacgggtaccccgttacggtaacgggtccgtacgggtacccggtacggtcccgttcccgggtacccccg

SEQ ID NO: 82978 - DNA, 721 bp, Homo sapiens
  misc_feature: GYAE6OF01E1XFE.25.23.C01.1.454.CMB.1.raw
  modified_base (182)..(182): a, c, t, g, unknown or other
  misc_feature (182)..(182): n is a, c, g, or t
  modified_base (203)..(203): a, c, t, g, unknown or other
  misc_feature (203)..(203): n is a, c, g, or t
  modified_base (226)..(226): a, c, t, g, unknown or other
  misc_feature (226)..(226): n is a, c, g, or t
  modified_base (230)..(230): a, c, t, g, unknown or other
  misc_feature (230)..(230): n is a, c, g, or t
  modified_base (255)..(255): a, c, t, g, unknown or other
  misc_feature (255)..(255): n is a, c, g, or t
  modified_base (299)..(299): a, c, t, g, unknown or other
  misc_feature (299)..(299): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcgagggtcctgggcccagtctgtgctgactcacgccaccctnagtgtcgtcgggacccccggnagagggtctccatctcttgttcnggancagctccgacgtcggaaattagttnctactggtaccagcagctaccaagaaaccggccccaagctcctnatctaataggaatgaatcagccggcctgagggactacctgaccgattctcgtggactacgaagtctggcctcctcggccctaccgtggcctagtccgtaggtcgggtaccgttcccgggtaccggtaagggtagtcgggaaggtccgttaaggtaaactttagtttaacccgttggttacggtaccggtttaaggggtttttacggggaacttaccggtcccgttaaggttccggttaaggggtaaccggtttcggggtaaccccgggttaaggggttcggtttaccggggaccggggaacgggtaaacccgtaaacggtcggtacccggtaacccggttaccggttaacgggtacccgaaccgtaacccccggaagggttcccctacccgggtccccccgttcggtacccgttaaccccgg

SEQ ID NO: 82979 - DNA, 739 bp, Homo sapiens
  misc_feature: GYAE6OF01B6MBX.25.23.C01.1.454.CMB.1.raw
  modified_base (219)..(219): a, c, t, g, unknown or other
  misc_feature (219)..(219): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctcgggacccccggcaggagggtctccatctcttgttctggancagctccgacgtcggaaattagtttgtctactggtaccagcagcctacccgaagaaaccggcccccaagcctcctcatctaatagaatgatcgagccggccctacgagggtactaccgtgaccgtattccgtcgtgcgtcgaagtcgtcggtcctccgtccggtccttcccgtcggaccactcgtacggtcgggccgttaccgggtcggaggactgggacggtaccgtagtaaacgttacttacgtcgtcgtacgttagggttcggaacgtgtacccgtaaggttccgtagggtaggttccggggtacccgggtacgggtttcgggtaccgggcggggtaacgggaccgtaaacgggtccgtacgggtaccccggttaccggttacgggtaaccgtacccgggtaacccccggtaaacgggaccccgtttacccccgggtaccccccccggttacgggttaaccccccttaccccggtttcccgttaccccccggttttcccccccgtaaacccccccgg

SEQ ID NO: 82980 - DNA, 654 bp, Homo sapiens
  misc_feature: GYAE6OF01D71X5.25.23.C01.1.454.CMB.1.raw
  modified_base (364)..(364): a, c, t, g, unknown or other
  misc_feature (364)..(364): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtctcggggacccccgggcagacgggtctccatctcttgttctgggagcagctccgacgtcggaaaattagttgtctacgtggtaccagcagcctaccaacgaaaccggcccccaagcctcctcatctagtaggaatgatcacgcggccctagaggtactacctgaccgtattcnctcgctacgaagtcgtgctcctcggtccctaccgtcgccatcgaggtcgggccgtccggtccggaggtagcgacgggtctaggtaattacttacgttggtcgtacgttagggtttacgggtatcggtaccgtacggttcgtacggtacggtcgggttacccggtaacggggttgggtttacccggggacgggtacggggaaccctaagggtcccgtacggtaccccgggttccgtaacgggttccggtaacccgacccggtaaaccggtcccgtacccggtcccccccgg

SEQ ID NO: 82981 - DNA, 789 bp, Homo sapiens
  misc_feature: GYAE6OF01ENADT.25.23.C01.1.454.CMB.1.raw
  modified_base (229)..(229): a, c, t, g, unknown or other
  misc_feature (229)..(229): n is a, c, g, or t
tcagactgtacagtcacgaccggtgctcgatttagtacacgtgattagggattgggggagagaagacaggattcaggacaatctccagcatggccggcctccctctcctcctcaccctcctcactcactgtgcagggtcctgggcccagtctgtgctgactcacgcccaccctcagtgtccgtccggggacccccggcaggacgggtcctccatctcttgtcgtgggancagctccgacgtacggaaattagttgtctacgtggtaccagcagcctacccgaacgaaacccggccccaagcctacctcactctaagtacggaatcggactacgacggcccggtacccctaggacgggtaccttaccgtacggtaacccgttactttccgtcggtcgggtacctaccggtaacgttccggtcgggtcccttccccgtcccgggtccccctttcccggtacggtaccctacgtacggtacgggttcgggtcccgttacccggggtaccggaaggtacgtagggacggtaccgttaagtaactttaacgtttacgtcggttacgtacggtttaaggggtttgggacttccggtaccgttaacggttcgtacgggtaacgggttccggggttacccggtaggggtttcgggttaccgggggacggtaaccgggtaccgtagtccggtaccggtacccggttacgtacgggtcgaacccggacccgtagggccccgtccccggtacccccgggttcgtaccctaacccgtttccgttccccgtccccctacccg

SEQ ID NO: 82982 - DNA, 639 bp, Homo sapiens
  misc_feature: GYAE6OF01DG8IM.25.23.C01.1.454.CMB.1.raw
  modified_base (191)..(191): a, c, t, g, unknown or other
  misc_feature (191)..(191): n is a, c, g, or t
  modified_base (222)..(222): a, c, t, g, unknown or other
  misc_feature (222)..(222): n is a, c, g, or t
  modified_base (342)..(342): a, c, t, g, unknown or other
  misc_feature (342)..(342): n is a, c, g, or t
  modified_base (403)..(403): a, c, t, g, unknown or other
  misc_feature (403)..(403): n is a, c, g, or t
tcagactgtacagtcacgaccggtgctcgatttagtacacgtgattagggattgggggagagaagacaggattcaggacaatctccagcatggccggcctcctctcctcctcaccctcctcactcactgtgcagggtcctggcccagtctgtgctgactcagccaccctcagtgtctcgggacccccgggnagacgggtctccattctccttgttctgggancagcctccgacgtacgaaattagttgtctacgtgtaccagcagctccaggaaaccgccccaagcctcacactctaagtagatgatcaagccggcctacgagggacttaccgtgaaccgtnttcctcgtcggctaccggtaagtccgttgcccttcccgtcggccctccgtacgcctatcgnggtcgggtcctaccgggtcggaggacgtggacggctaggtaattattaccgtggtacgcgttaggtttagggactgccgtagttcgtagtgtcgggtcccggtagggtcggtcgggacggtacgggacgaacggtctcggaccgttacgacggtacgtaccggacccgttaaggccccgtaccggccccccgtttcggtccctacccggttcctttcccgggtcccccttcccccg

SEQ ID NO: 82983 - DNA, 853 bp, Homo sapiens
  misc_feature: GYAE6OF01BK6HL.25.23.C01.1.454.CMB.1.raw
  modified_base (237)..(237): a, c, t, g, unknown or other
  misc_feature (237)..(237): n is a, c, g, or t
tcagactgtacagtcacgaccggtgctcgatttagtacacgtgattagggattggggagctgtggtagagaagacaggattcaggacaatctccagcatggccggcctcctctcctcctcaccctcctcactcactgtgcagggtcctgggcccaatctgtgctgactcacgcccaccctcagtcgtcgtcggggacccccggcaggacgggtctccatcttcttgttcgtgggacncagtccgtccgacgtacggtaaaattagtttgtacttacgtcggtaaccagcagcctacccgaacggaacccggaccccaagccctcctactaattcctaagtaaggaactcgtaactcgacggtacccggccctacggaacgggtacttaacccggtacgtaaccggttacttccgtcgtcggtacctagtaacgttcgtcggtcccttccgtcccgtcccttacccgtgtaccctacgtaccggtacgggttccgggtacccgtacccgggttaccggaagggttacgtacggggtaacgtacggtttaacggttaaactttacgtttaccgttaggtacggtttaccggtaggggttttacggaaccgttacggtacccggtacggtttaccggtagggttacccggggttccgggttacccggggttacggggtttaccggggttaccgggggaaccggggtaaacgggtaacccggtaacgggttcccggttaaccggggttaaccccggtacgggtttaaacccgggtacccgtaacccggggttaccccgtaaacgggttcccccgtaaccccggttcccccggttaacccgggttccttaaccccggg

SEQ ID NO: 82984 - DNA, 683 bp, Homo sapiens
  misc_feature: GYAE6OF01BNQ1A.25.23.C01.1.454.CMB.1.raw
  modified_base (194)..(194): a, c, t, g, unknown or other
  misc_feature (194)..(194): n is a, c, g, or t
  modified_base (223)..(223): a, c, t, g, unknown or other
  misc_feature (223)..(223): n is a, c, g, or t
  modified_base (290)..(290): a, c, t, g, unknown or other
  misc_feature (290)..(290): n is a, c, g, or t
  modified_base (386)..(386): a, c, t, g, unknown or other
  misc_feature (386)..(386): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtccgtggcccagtcgtgtgactgactcagccaccctcagtgtctcgggacccccgggnagcgggtctccatcctcttgtctgggacncagctccgacgtcggaaatagtttgtctactggtaccagcagctccagaaaccggcccaagctcctnatctatagaatgactcacgcggccctgagggactaccgtgaccgtattcctcgtcggactacgtagtcgtcggccttccgtccggtacccttccgnggccctagtcgtacggtcggtccgttccgggtaccggaggtacttcggacggtactagtaaacttacgttacgtgtacgtcgttagggtttcggaacgtcgtacccgtaggttccgtaggtacgggttccgggtacccggtagggttcggttccgggacgggtacgggtaaccacggtccgtaaccggtcccggttaccgttacggacccggtaacgaccccggtaagggtccccgtcccggtaccccccggttcggtacccgtaaccgttcccgttaaccgttcccccgtaccccg

SEQ ID NO: 82985 - DNA, 769 bp, Homo sapiens
  misc_feature: GYAE6OF01CF5R9.25.23.C01.1.454.CMB.1.raw
  modified_base (199)..(199): a, c, t, g, unknown or other
  misc_feature (199)..(199): n is a, c, g, or t
  modified_base (226)..(226): a, c, t, g, unknown or other
  misc_feature (226)..(226): n is a, c, g, or t
tcagactgtacagtcacgaccggtgctcgatttagtacacgtgattagggattggggagctgtggtagagaagacaggattcaggacaatctccagcatggccggcctcctctcctcctcaccctcctcactcactgtgcagggtcctgggcccagtctgtgctgactcagccaccctcagtgtctgggacccccgggnaggagggtctcatctcttgtctgggancagctccgacgtacggaaataagtttgtctacgtcggtaccagcacgctaccaacgaaccggccccaagcctcacatctactaggaatgatcgaggccgaccctgagggtactaccgtgaccgtacttcgtcgtcggtcgtacgtaagtccgtgggtcccttccgtcccggtccccttcccggtcggaccctaacgtccgtacgggtcgggtcccggttccccgggtacccggtaagggtacgtacgggaacgggtaccgtaaggtaaacttacgtttaacgttcggtcgtacggttaggttttacgggtacgttcggacccgtaaggttccgttacgggtaacgggtttccgggttacccgggttacggggtttacgggtttcccgggggacggggtaaccggggaacccgtaaacgggtacccggttacgggttacccccggttaccgggttaccgggtaaccgtaacccgggtaaccccggtaaaccggggtcccgtaccccgggttaccccccgttaccgggttcccgtttaaccccgg

SEQ ID NO: 82986 - DNA, 620 bp, Homo sapiens
  misc_feature: GYAE6OF01D16FX.25.23.C01.1.454.CMB.1.raw
tcagactgtacagtcacgaccggtgctcgatttagtacacgtgattagggattgggggagagaagacaggattcaggacaatctccagcatggccggcctcctctcctcctcaccctcctcactcactgtgcagggtcctgggcccagtctgtgctgactcagccaccctcagtgtctcgggacccccgggcaggagggtctccatctcttgttctgggagcaggctccgacgtcggaaataagtttgtctactggtaccagcagcctcccacgaaaccggcccccaagcctcctcatctataggaatgatcgagccggccctcagggactaccgtgaccgtacttctctcggctacgagtcgtggcctccgtccgcctcccgtcgccatcgagtcgggccgtcccgggtaccggaggacgtggacgggacttgtaaattactttacgtgtgtcgttaggttgggtatcgcgtagtcgtggaggtcggtacggtacgggttggttccgggcgggacgggaccacggcgtacgaccgtccgtagggtcgacggacccgaacggcccgttaccggccccccgttcggttacccacccgtccttcccgtcccccttacccccg

SEQ ID NO: 82987 - DNA, 671 bp, Homo sapiens
  misc_feature: GYAE6OF01ALZ4O.25.23.C01.1.454.CMB.1.raw
  modified_base (210)..(210): a, c, t, g, unknown or other
  misc_feature (210)..(210): n is a, c, g, or t
  modified_base (244)..(244): a, c, t, g, unknown or other
  misc_feature (244)..(244): n is a, c, g, or t
  modified_base (507)..(507): a, c, t, g, unknown or other
  misc_feature (507)..(507): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagcccaccctcagtgtccgtcggggacccccggngagacgggtcctccattctcttgttcgtgggacncagcctccggacgtacggtaaatagtttcgtactacgtcggtaccagcacggcctacccgaacggaaaccccggcccccaaaggtccctcctacacttacctaagtaacggtaatcgatccgacggccggaccctggaacgggtactaccgtacgaccgtattccgcgtacggtctacgtacgtcgtacggtccctccggtcccggtcccttcccgcggccctacgtcggtacgggtcggtcccgtcccggtacggaggtcgngacggtctaggtatacgttcgtggtcgtcgggttggactcgtaccgtagttccgtaggtacggtcggtaccggcgggttacgggtcggacgggacgggacgtaacgtcggtaccggtaccggttcgtaaggcgaaccgaccgtacgccgtccgtccccggtacg

SEQ ID NO: 82988 - DNA, 722 bp, Homo sapiens
  misc_feature: GYAE6OF01D19GP.25.23.C01.1.454.CMB.1.raw
  modified_base (194)..(194): a, c, t, g, unknown or other
  misc_feature (194)..(194): n is a, c, g, or t
tcagactgtacagtcacgaccggtgctcgatttagtacacgtgattagggattggggagagaagacaggattcaggacaatctccagcatggccggcctcctctcctccacaccctcctcactcactgtgcagggtcctgggcccagtctgtgctgactcacgccaccctcagtcgtcgtcggggaccccgggnaggacggtctcatctcttgttcgtgggagcagctccgacgtacggaaattagtttcgtctacgtacggtacagcacgcctacccgaacgaaacccggcccccaagcctcctcatctagtaggaattgactcgacgccggtcccacgagggtactaccgtagaccgtattccgtgtcgacgtacgtacgttcgtcgtccgtcctcggcccttccgtcggcctacgtcgacgggttccggccgttcccgggtacggaaggtacgtggtacggtacttaagtaacgttacgttacgtgggttcgtacggtttaagggttcgggagtccgtacgttacggtcgttacgggtacgggtttccgggtaccggttacgggggttccgggttaccggggaacgggtacggacgtacggtacccgtacggtaccccggttacgtaccgggaccgtaaccggaccccggtacggtcccgttccccggaccccgttcggtacccgtacccgtttcccgttccccgtccccggttacccc

SEQ ID NO: 82989 - DNA, 760 bp, Homo sapiens
  misc_feature: GYAE6OF01CDJ7Y.25.23.C01.1.454.CMB.1.raw
  modified_base (208)..(208): a, c, t, g, unknown or other
  misc_feature (208)..(208): n is a, c, g, or t
  modified_base (238)..(238): a, c, t, g, unknown or other
  misc_feature (238)..(238): n is a, c, g, or t
tcagactgtacagtcacgaccggtgctcgatttagtacacgtgattagggattggggagcttcagctgtggtagagaagacaggattcaggacaatctccagcatggccgcctccctctcctcctcaccctcctcactcactgtgcagggtcctgggcccagtctgtgctgactcagcccaccctcagtgtcgtcggggacccccggnaggagggtctccatctcttgttcgtgggancagcctccggacgtacggaaattagtttgtctacgtggtaccagcacgcctacccgaacggaaacccggccccaagcctcctcactctaataaggatgatcgagccggccctacgagggtactaccgtgaccgtatttctcgtcggtcctacggaacgttcgtacgggtcccttcccgtccgggtccccttcccggtacggccctaagttccggacggggttccgggacccttccccggggtacggaagggtagtacgggaacggtccttaaggtaaactttacgtttaacgtggttacggtaccgttaagggttttgggaaccgttcggtaacccgttaggttaccggttagggtaacgggttccgggttacccgggttagggttcgggttacccgggggacgggtaacggggaaccctaagggtcccggttaccggggtaaccccgtttacccggttaacgggtcccgtaaaccggggacccccgtaaacggggtccccgttcccccgggtaccccccgg

SEQ ID NO: 82990 - DNA, 846 bp, Homo sapiens
  misc_feature: GYAE6OF01DR4DW.25.23.C01.1.454.CMB.1.raw
  modified_base (215)..(215): a, c, t, g, unknown or other
  misc_feature (215)..(215): n is a, c, g, or t
  modified_base (254)..(254): a, c, t, g, unknown or other
  misc_feature (254)..(254): n is a, c, g, or t
tcagactgtacagtcacgaccggtgctcgatttagtacacgtgattagggattggggagcttcagctgtggtagagaagacaggattcaggacaatctccagcatggccggcctccctctcctcctccaccctcctcactcactgtgcgagggtcctgggcccagtctgtgctgactcacgcccaccctcagtcgtccgtcggggacccccgggngaggacgggtcctccattccttcgttgttcgtagggacncgacggcctaccggacgtacggtaaaattagtttgtccgtacgtacggtaccagcacgcctaccccgaaggaaaccccgccccaagcctcctactacttactaagtaggtaatcggactccgaacggcccggtaccctacggaacgggtaaccttaacccggtcgtaacccggttacttttcccgtaccggttcggtacccgtaaccggtaacggtttccgtccggggttcccctttccccgggttccccggttcccccggttcccccggttcggggaccccttaaccggttccggtacggggggttcccggggttaccccgtttccccggggtaccgggtaacgggtacggttaccgggaacgggtaccgttaaggtaaacgttttacgtttaccgttacgggtttacggtaccggtttaaggggttttcgggaacgtccggtacgttacggttcggtacgggttacggttccggggtacccgggttacgggtccgggttaccggggacggggtacggaccgtaacgccggttacccggtaccgtaccgtacggtccgaccgaacccgtcgggtcccgtcccggtcccccg

SEQ ID NO: 82991 - DNA, 801 bp, Homo sapiens
  misc_feature: GYAE6OF01BUE1M.25.23.C01.1.454.CMB.1.raw
  modified_base (222)..(222): a, c, t, g, unknown or other
  misc_feature (222)..(222): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtcgtcgggacccccgggcaggagggtctccatctcttgttctgggancagctccgacgtacggaaattagtttgtctactggtaccagcagcctaccacgaaaccggccccaagcctcctcactctataggatgatcgacgccggccctacgacgggtactacctcgtaaccgtattcctcgttcggcttacgtaacggtcgtcgggtccttcccggtcccgggtccctcccgtcgggaccctacgttccggacggtcggggtcccgttacccggggtccggaagggtacgtacggggtaacggtcgttaacggtaaatttacgtttaaccggttggttcggtaaccgttaagggttttaccgggtacgtaccggtacccgttaaggttcgtacggttacgggttacgggttaccccgggtaacggggtttcgggttaccggggacggggtacggggtaacccgtaaggtccgttaaccggggtacccgttacccggttaacgggtcccgtaacccggtaacccccgggtaaacgggccccgtttaacccgggtccccccccggttacgggttaccccgttaccggtttaccccgttccccgggtttaaccccccctaacccccgg

SEQ ID NO: 82992 - DNA, 776 bp, Homo sapiens
  misc_feature: GYAE6OF01BPEE0.25.23.C01.1.454.CMB.1.raw
  modified_base (191)..(191): a, c, t, g, unknown or other
  misc_feature (191)..(191): n is a, c, g, or t
  modified_base (223)..(223): a, c, t, g, unknown or other
  misc_feature (223)..(223): n is a, c, g, or t
  modified_base (367)..(367): a, c, t, g, unknown or other
  misc_feature (367)..(367): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccacctcagtgtcgtcgggacccccggnaggaggtctccattctcgttgttcgtgggacncagcctcgacgtacgtaaattagtttgactacgtcggtacagcacgtcctacccgaaaggaacccggcccctaagcctacctacaacttactaagtacggaatcggactcgacgccgcctagacggtactcgacgtactcttcncgtcggctacgtacgttcgcggtacctccggtcccggtcccttaccgtcggtacctcgttaccggtagggtccggggtcccttacccgggtacggtaggtacggtacgggacgtacttaaggtaaactttacgttcgtaggacggttacggttagggttcggaacctcggtacccgttaggttcggtacgggttagggttacccggggttaccggggtaagggttttccggggaaccgggacgggggtaacgggtaaccctgggggttaccccttaacgggtccccgggttaacggtacgggtacccgtaaccccgggaccgttacccgggcccgtttaccccccgggccccggttttacgggacccctttaacccggttccccgttacccccgttccccccgttaccg

SEQ ID NO: 82993 - DNA, 712 bp, Homo sapiens
  misc_feature: GYAE6OF01CJAQM.25.23.C01.1.454.CMB.1.raw
  modified_base (294)..(294): a, c, t, g, unknown or other
  misc_feature (294)..(294): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctcgggacccccgggcagagggtctccatctcttgttctgggagcagctccgacgtacggaaattaagtttgtctactggtaccagcagctccagaaacgccccaagctctcatctanaggatgatcagcggccctcgagggactaccgtgaccgtacttctacgtcggctacgaagtctggcctccgtcggtccctcccgtcggcctagtcgaggtcgggccgttcccgggtaccggaggtacgtggacggctaggtaaattacttacgtagttcgacgttagggtttgggaatcggtccgtaagttccgtaggtaacggttcgggttacccggtacggggttgggtttaccggggacggggaacggggtacccgtaaagggtccgtacgggtaacccccggttaccgggttaacgggttaccgaacccgggtaaccccggaaacggggttccccgtccccggtacccccccggtttaccggggtacccctaacccggtttccccggtttcccggttcccccccggttacccccg

SEQ ID NO: 82994 - DNA, 679 bp, Homo sapiens
  misc_feature: GYAE6OF01ACI26.25.23.C01.1.454.CMB.1.raw
  modified_base (230)..(230): a, c, t, g, unknown or other
  misc_feature (230)..(230): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctcgggacccccgggcaggagggtctccatctcttgttctgggancagctccgacgtcggaaatagttgtctactggtaccagcagctcccagaaccgccccaagctcctcatctataggatgatcgacgcggccctcgagggtactacctcgaccgtattcctcgtggtctcgtaagtcgtcggtcctcccgtcggaccccttcccgtggaccctagtccgacggtcgggccgttaccgggtccggtaggacgtggacggtcttaggtaactttacgttacgtggttacgcgttagggtttgggtactcgtaccgtacgttcgtcggtacggttcgggttacccggtacgggttacgggttccggggacgggtacgggtaacccgacgggttacccgtacggtacccggttccgttaacgggtcccgaaccgggtaccccgtaaaccgggtcccgttaaccccggtcccccccgttagggtcccttaccccgg

SEQ ID NO: 82995 - DNA, 721 bp, Homo sapiens
  misc_feature: GYAE6OF01CW6W0.25.23.C01.1.454.CMB.1.raw
  modified_base (228)..(228): a, c, t, g, unknown or other
  misc_feature (228)..(228): n is a, c, g, or t
tcagactgtacagtcacgaccggtgctcgatttagtacacgtgattagggattggggagctgtggtagagaagacaggattcaggacaatctccagcatggccggcctcctctcctcctcaccctcctcactcactgtgcgagggtccgtgggccagtctgtgctgactcacgcccaccctcagtcgtcgcgggaccccggcgaggacggtctccatctcttgttcgnggagcagctccgacgtacggaaattagtttcgtctactcggtaccagacagcctaccgaacgaaaccggtcccccaagcctacctacgtactaccgtaagtaaggtaacttgaactcgaacggccgccgtacgacgggtactaccgtagaccgttacttcgtcgtacgggactacggtaacgtcgttccgggccttcccgtccgggtacccttccggtacggacctacgttacgacgggttccgggtcccgtccgggtacgaaggtgtacggaagggtcctaaggtaaacgtttactttacgtaggtcgacggttaggtttagggacgtcggtcccgtaaggtccgtaggtacggttacgggtacccggtacggttcgggtacgggacgggtaacgggaaccctaagggacccgttaccggtacggtacccgtaagggtaccgaccggaaccggtaccggccgacccggtaccccggtggtaaccgttacccg

SEQ ID NO: 82996 - DNA, 674 bp, Homo sapiens
  misc_feature: GYAE6OF01BYQFD.25.23.C01.1.454.CMB.1.raw
  modified_base (232)..(232): a, c, t, g, unknown or other
  misc_feature (232)..(232): n is a, c, g, or t
  modified_base (269)..(270): a, c, t, g, unknown or other
  misc_feature (269)..(270): n is a, c, g, or t
  modified_base (357)..(357): a, c, t, g, unknown or other
  misc_feature (357)..(357): n is a, c, g, or t
  modified_base (405)..(405): a, c, t, g, unknown or other
  misc_feature (405)..(405): n is a, c, g, or t
tcagactgtacagtcacgaccggtgctcgatttagtacacgtgattagggattggggagcttcagctgtggtagagaagacaggattcaggacaatctccagcatggccggcctccctctcctcctccaccctcctcactcactgtgcagggtcctggcccagtctgtgctgactcagccaccctcagtgtctgggacccccggcagagggtctccatctcttgttctggancagctcgacgtcggaaatagtttgtctactggtaccnncagctaccgagaaaccggcccccaagcctcctcatcctagtaggaatgactcacgcggccctgagggtactaccgtgaccgatttcncgtcgctacgaacgttcgtggcctccgtccggccctcccgtcggaccngtccgagtcgggcctcccgggtcgaggtactcgacggtacgtacggaattacgttacgtggttacgaccgttagggttttcgggattcggaccgtaggttacgttaggtacggttcgggtacccggttacggggttcggtttcccggggaacggggtaacgggtaacccgtaagggtccggttacgggaaccccggtttccgttaaaccggggtacgtaacccgggacccccggtaaacgggtccccgttaaccccggtcccccccggg

SEQ ID NO: 82997 - DNA, 772 bp, Homo sapiens
  misc_feature: GYAE6OF01CTWM0.25.23.C01.1.454.CMB.1.raw
tcagactgtacagtcacgaccggtgctcgatttagtacacgtgattagggattgggggagagaagacaggattcaggacaatctccagcatggccggcctccctctcctcctcaccctcctcactcactgtgcagggtcctgggcccagtctgccctgactcagcctgcctccgtgtctgggacctcctggacaggtcggtcaccatcctcctgcacgtcggaaccagccgtgactagttggtcgtacttaagtaacttagtcgttcctcccgtacggtaccccaaccaaccacccgacggaccaaccggacccccaaactcatctatttactgatcgtcagtccagtccgtccctcgtggtagttcgtcggtcgtccttctcgtcggtctaccgtacgtctcggacctaaccgtccggtccctcccgtacgtacccgacttccggtccggggtcctccgacgggtcgtacgggacggtacggtacggttaaccttacgtttagttaacgtttcgtacttactttactaacgttacgaacgtacgtaaacccaaccgtaacgtacggttaccggttggggttacgggttacggggacgggtaaaccgggtaaccggtaaccgggttaccggtaaccccggttcccgggttaaccggtacccggaacccgggtaacccgggttacccgggtacccggttacccccgggttaccccccgttacccgggttacccttaccccggttacccggtttccccccgttaacccccccgg

SEQ ID NO: 82998 - DNA, 582 bp, Homo sapiens
  misc_feature: GYAE6OF01B3OOX.25.23.C01.1.454.CMB.1.raw
  modified_base (171)..(171): a, c, t, g, unknown or other
  misc_feature (171)..(171): n is a, c, g, or t
  modified_base (191)..(191): a, c, t, g, unknown or other
  misc_feature (191)..(191): n is a, c, g, or t
  modified_base (317)..(317): a, c, t, g, unknown or other
  misc_feature (317)..(317): n is a, c, g, or t
  modified_base (410)..(410): a, c, t, g, unknown or other
  misc_feature (410)..(410): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctnagtgtctgggaccccccggnagagggtctccatctcttgttctgggagcagctccgacgtcggaataagtttgtctactggtaccagcagctcccacgaaacggcccccgaacgctcctcatctataggaatgatcagcggccctnagggatacctgaccgattctctggctcgaagtctggcctcctcggcctccctggccatcgaggtcgggctccggtccgaggatgagctgaatnttactgtgctaggtttgggatcgctagtctggtacgtgggtcccggtacggttgggtttccggacgggcgggaccctagggctcggtaccgtccgtacggtcgaccgacccggacggtcgtcccggcccccgttcgggtacccacgtttccgttcccggttccccgtccccc

SEQ ID NO: 82999 - DNA, 686 bp, Homo sapiens
  misc_feature: GYAE6OF01CAZKU.25.23.C01.1.454.CMB.1.raw
  modified_base (229)..(229): a, c, t, g, unknown or other
  misc_feature (229)..(229): n is a, c, g, or t
  modified_base (271)..(271): a, c, t, g, unknown or other
  misc_feature (271)..(271): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagcccaccctcagtgtcgtcgggcccccggaggaggtctccatctcttgttcgtgggancagcctccgacgtacggaaattagtttgtctacgtggtaccngcacgcctacccaaggaaacccggcccccaagcctcctcactctaataggatgatcgacgccgccctagacggactaccgtcgaccgtattcctcgtggtctacgtaacgtcgtcggccttcccgtccggtcccctccgtcggcctacgtcgacggtcggtccgtcccgggtacggaggtagttcggacggtactaggtaacttacgttacgttcggtacgtcggttaagggtttcgggaagtccgtaccgtaagttcgtacgggttacggtccgggttacccggtaacgggttcgggttccggggacgggtacgggaacccgtacggtcggtacccgggtacccgttcggtacggcccgaccgtaccccggtacgggtccccgtacccgtccccccggtggttcccgtaccccg

SEQ ID NO: 83000 - DNA, 715 bp, Homo sapiens
  misc_feature: GYAE6OF01C9BXL.25.23.C01.1.454.CMB.1.raw
  modified_base (173)..(173): a, c, t, g, unknown or other
  misc_feature (173)..(173): n is a, c, g, or t
  modified_base (192)..(192): a, c, t, g, unknown or other
  misc_feature (192)..(192): n is a, c, g, or t
  modified_base (219)..(219): a, c, t, g, unknown or other
  misc_feature (219)..(219): n is a, c, g, or t
tcagactgtacagtcacgaccggtgctcgatttagtacacgtgattagggattggggagagaagacaggattcaggacaatcgtccagcgatggccggcctccctctcctcctcaccctcctcactcactgtgcagggtcctgggcccagtctgtgctgactcagccaccctnagtgtctgggacccccggnagagggtctccatctcttgttctggancagctccgacgtcggaaatagtttgctactggtaccagcagctccagaacggccccaagctcctcatctataggaatgatcagcggccctgaggactacctgacgattctctgctcgaatctaggcctccgtcgcctcccgtggccagtcgagtcggccttccggtccgaggatggacgtctagaattacttacgtgtcggtacgttaggttttacgggagttcgacccgtaaggttccgtaggtaaccgggttcggggttaccccggtaacggggtttcgggttcccggggacggggttaaccgggaacccgtaacgggtcccgttaccggtaaccccggttacccggtaacggggttaccccggtaacccgggacccccggtaaaacggggtcccccgttaaccccgggtccccccccggtttaccggggttaaccccctaacccggttttcccccgttaccccgggttttaacccccccccttaaccccccgg

SEQ ID NO: 83001 - DNA, 804 bp, Homo sapiens
  misc_feature: GYAE6OF01C4X5T.25.23.C01.1.454.CMB.1.raw
  modified_base (191)..(191): a, c, t, g, unknown or other
  misc_feature (191)..(191): n is a, c, g, or t
  modified_base (215)..(215): a, c, t, g, unknown or other
  misc_feature (215)..(215): n is a, c, g, or t
  modified_base (220)..(220): a, c, t, g, unknown or other
  misc_feature (220)..(220): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctcgggacccccggnaggagggtctccatctcttgttcngggancagcctcgacgtacggaattagtttgctacgtggtaccagcagcctacccaaggaaaccggccccaagcctcctacatctataggaatgatcagccgccctcgagggactacctgaccgtattctctggctcgaagtcgtcggtccttcccgtccggcccttcccgtcgggccctaacgttccggaaggttccggggcccgttcccggggtcccggaagggtacgttacgggacgggtaccttaggtaaactttacgttaaccgttaggttacggtacggttaacggggttttcgggacgttcggtacccgtaaggtttccgtacgggttacgggttccggggttacccgggtacggggttttccggggttaaccgggggaccggggttaacggggacccgttaaacgggtccggttaaccgggtacccccgggttaccggttaaccggggtacccgtaacccggacccccgggtaaacggggttcccccgttaccccggggtacccccccggtttacccgggttacccttaaccccggttttccccggttaccccggtttccccccccgggttaacccccccg

SEQ ID NO: 83002 - DNA, 662 bp, Homo sapiens
  misc_feature: GYAE6OF01BQDX0.25.23.C01.1.454.CMB.1.raw
  modified_base (212)..(212): a, c, t, g, unknown or other
  misc_feature (212)..(212): n is a, c, g, or t
  modified_base (316)..(316): a, c, t, g, unknown or other
  misc_feature (316)..(316): n is a, c, g, or t
  modified_base (560)..(560): a, c, t, g, unknown or other
  misc_feature (560)..(560): n is a, c, g, or t
tcagactgtacagtcacgaccggtgctcgatttagtacacgtgattagggattgggggagcttcagctgtggtagagaagacaggattcaggacaatctccagcatggccggcctccctctcctcctcaccctcctcactcactgtgcagggtcctgggcccagtctgtgctgactcagccaccctcagtgtccgtcggggaccccccgggnaggagggtctccatctcttgttcgtgggagcagctccggacgtacggaaatagtttgtctactggtaccagcagcctaccaggaaaccggcccccaagcctccncatctataggaatgatcgacgccggccctgaagggactaccgtcgaccgtattcctcgtcggactacggaacgtcgtcgggtaccctcccggtcccggtcccctccccgtagggcccctagtccgagggtccgggtcccgtacccgggtcggaaggtatcggaggtctaagtaaactttacgttacgtgtacgcgttagggtttcgggatcggacgtagttcgtaggtggttcgggtacccggngggtttcccggtacggggccgggtaagggacccgagtcgttaccgggacccgtacccgttacggggaccacggaccccgaggtcccgtcccggtccccccgg

SEQ ID NO: 83003 - DNA, 793 bp, Homo sapiens
  misc_feature: GYAE6OF01C8CW7.25.23.C01.1.454.CMB.1.raw
  modified_base (191)..(191): a, c, t, g, unknown or other
  misc_feature (191)..(191): n is a, c, g, or t
  modified_base (224)..(224): a, c, t, g, unknown or other
  misc_feature (224)..(224): n is a, c, g, or t
  modified_base (277)..(277): a, c, t, g, unknown or other
  misc_feature (277)..(277): n is a, c, g, or t
tcagactgtacagtcacgaccggtgctcgatttagtacacgtgattagggattggggagagaagacaggattcaggacaatctccagcatggccgcctcctctcctcctcaccctcctcactcactgtgcagggtcctgggcccagtctgtgctgactcagccaccctcagtgtcctcggggacccccggnaggacgggtcctccctatccttcgtttgttcgngggagcacgctccgacgtacggtaaattagtttcgtactacgtggtaccagcngcctacccgaacgaacccggacccccaagtccctacctactactactaagtaggaattgaatcacgccggccgtacgacgggtactaccgtcggaacctattcctcgtcggtactacggtaacgtccggtcgtaccttcccggtccgtcccctcccgtcgggaccctaacgtccggtacggggttccgggtaccggttcccggggtaccggtaggtaggttacggacgggtactaggtaaacttacgtttaacgtgggttacgtacggttaagggtttcgggactcggtaccttagggttcgtacgggttaacggtccgggttacccgggtaacgggtttacggttaccggggggacgggtaaccgggtaccggaacggttcccggttacggtacccccggttacgtaacgggcccggttaaccggaccccggtaacgggtccccgtaccccgggttacccccggttccggttaccgttaccgttacccggttccccgttcccccggttaaccccc

SEQ ID NO: 83004 - DNA, 638 bp, Homo sapiens
  misc_feature: GYAE6OF01BS62U.25.23.C01.1.454.CMB.1.raw
  modified_base (221)..(221): a, c, t, g, unknown or other
  misc_feature (221)..(221): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtcgtcgggacccccgggcagagggtctccatctcttgttctgggancagctccgacgtcggaaatagtttgtctactggtaccagcagcctacccgaacgaaaccggcccccaagcctcctcgatctataggaatgatcacgccggccctgagggactacctgaccgtattctcgtcggctacgaagtcgtcggcctccgtccggtcccttcccgtggacctagtccgtaggtcgggcctcccggggtcgagggtactcgggaggtctaggtaattacttacgtgtcgtcgttaggtttggattcgcctagtctaggcgtgggtcccgtaggggttcgtcggggacggtacggtaaccaggtccgtacgtcccggtacgttacggcgaacccggacccggtaacggcccgttccccggacccccgttggtacccctacttcccgttcccgtacccccctcccg

SEQ ID NO: 83005 - DNA, 663 bp, Homo sapiens
  misc_feature: GYAE6OF01AHZ40.25.23.C01.1.454.CMB.1.raw
  modified_base (200)..(200): a, c, t, g, unknown or other
  misc_feature (200)..(200): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggagcagctccgacgtcggaaatagtttgtctactggtaccagcagctcccagaaaccggcccccaagcctcctcatctataggaatgatcacgccggccctcgagggactaccgtgaccgtattcgtctcggctcgaagtctcggtctccgtccggcccttcccgtggcccactcgtacggtcgggccgttcccggggtccgagggtacgttgggacgggtcgttaggaaactttaacgtttaacgtggttacggaccgttaggttttggggattcggaccgtaggttccgttggtacgggttcgggttcccggtacggggttacggttccggggacgggacggggtacccgaaggtcccgtcggtacccggttccgtacggtaccgacggaccccgtaacgggccctacccggtccccccgttcgggtccctacccg

SEQ ID NO: 83006 - DNA, 704 bp, Homo sapiens
  misc_feature: GYAE6OF01ES7G5.25.23.C01.1.454.CMB.1.raw
  modified_base (209)..(209): a, c, t, g, unknown or other
  misc_feature (209)..(209): n is a, c, g, or t
  modified_base (234)..(234): a, c, t, g, unknown or other
  misc_feature (234)..(234): n is a, c, g, or t
  modified_base (277)..(277): a, c, t, g, unknown or other
  misc_feature (277)..(277): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctggggcccagtctgtgctgactcagccaccctcagtgtcctcgggacccccgggnaggagggtctccatcctcttgttcngggagcagctccgacgtcggaaatagtttgtctactggtaccngcagctcccagaaccggcccccaagctcctcatcataggaatgatcagccggccctcgagggactacctgacccgtattcctcgtggctacggaagtcgtcgggccttccgtcggccctcccgtcgggccattccgaggtcgggtccgttcccggtaccggaggtacgtggaacgggtctaggtaattacgtttaacgtcgttacgtaccgtagggtttttcgggaagttcgggaccccgtagggtttaccctaggggtaaccgggtttccggggttaccccgggtacggggtttcggggtttcccggggaccgggggtaacgggggtaaccctaaacgggtcccggttacgggtacccccggttcccggttacgggttacccgaacggaccccccgaaaggggtccctacccggtcccccccgggg

SEQ ID NO: 83007 - DNA, 762 bp, Homo sapiens
  misc_feature: GYAE6OF01BI3DD.25.23.C01.1.454.CMB.1.raw
  modified_base (187)..(187): a, c, t, g, unknown or other
  misc_feature (187)..(187): n is a, c, g, or t
  modified_base (210)..(210): a, c, t, g, unknown or other
  misc_feature (210)..(210): n is a, c, g, or t
  modified_base (243)..(243): a, c, t, g, unknown or other
  misc_feature (243)..(243): n is a, c, g, or t
tcagactgtacagtcacgaccggtgctcgatttagtacacgtgattagggattggggagcttcagctgtggtagagaagacaggattcaggacaatctccagcatggccgcctccctctcctcctcaccctcctcactcactgtgcgagggtcctgggcccagtctgtgctgactcacgccaccctnagtcgtcgtccgggacccccggnaggacggtcctccatcttcttgttcgtgggacncagccgtaccggacggtacggtaaaattagtttgtccttacgtcggtaccagcagtcctacccgaacgaaaaccccggccccctaagtcctacctactactaccgttaagtaaggtaactggaaccttaccgaacggtccccggtcccgtacggtaacgggtacctaacccgtacgaacccgttactttccgtacgtcggtccgtacggtaacgttccgtacggtcccttcccggtcccggtccccttccccggtcggtcccgtacgtaccggtacgggttccgggtccgttccccgggtacggacggtagtcggacgtcgtaagtaacttacgtttacgtggtcgtagttagggtttcgggacgtcgtccgtagttcggttacgggacgggttcgggtacccgggttgggttacgggttccggggaaccggggtacgggtaacccgtaacgggtccgttcgggtaacccgttcggtaacgtccgaccggtacccgacggtcccgtacccgtcccccgg

SEQ ID NO: 83008 - DNA, 633 bp, Homo sapiens
  misc_feature: GYAE6OF01DYBGF.25.23.C01.1.454.CMB.1.raw
  modified_base (200)..(200): a, c, t, g, unknown or other
  misc_feature (200)..(200): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctcgggacccccggnagagggtctccatctcttgttcgtgggagcagcctccgacgtacggtaaattaagttgtctactggtaccagcagcctaccaagaaaccgcccccaagcctcctcatctagtaacggatgactcacggccgcctacgagggtactaccgtaggaccgtattctcgtggcctacgaagtccgtggcctcccgtccgtccctcccgtgcccatcgtacggtcggccgtccggtcgaggctggacgtcgtagtaattagttacgtgtcgtacgttaggtttacggacgtcgaccgtagtcggttgtacgggttccggttccggtacggttcgggttacgggacgggaacggtaccgaacgtccggtacgtaccggtccgtacggaccgtaccgaacccgtagggcccgttacccgccccgttcggtccttacccgg

SEQ ID NO: 83009 - DNA, 840 bp, Homo sapiens
  misc_feature: GYAE6OF01AZ3UZ.25.23.C01.1.454.CMB.1.raw
  modified_base (171)..(171): a, c, t, g, unknown or other
  misc_feature (171)..(171): n is a, c, g, or t
  modified_base (193)..(193): a, c, t, g, unknown or other
  misc_feature (193)..(193): n is a, c, g, or t
tcagactgtacagtcacgaccggtgctcgatttagtacacgtgattagggattggggagagaagacaggattcaggacaatctccagcatggccggcctccctctcctcatcaccctcctcactcactgtgcagggtcctgggcccagtctgtgctgactcagccaccctnagtcgtcgtcgggacccccggnaggacgggtcctccgattcgtcttgttacgtgggagtcagcctccgacggtacggaaaattaggtttcgtcttacgtcgggtaccagtcgaacggtcctacccgaagtaaaaccccgggtcccccgaaaggtccctaccgtactaccgttaccgttaagttaaacgggaacttcgtaactccgaacgggtcccggtaccctacggaacgggaacttaccgtcgaaccggtattccgtcacgggtcctacggtaacgttccgtccgggtcttccccggtccggtcccttccccgtacgggtaccctacgtaccggtacgggttccggggtcccggttcccgggtaacccgggagggtacgttaccgggacgggttaccgttaggtaaacgtttacggttacgttcgggttacgtcgggttaacgggtttttcgggaacgtttcgggtacccgttaacgggtttcggtgggttaaccggttcccgggggttacccggtagggggtttacgggttccgggacggggtaaccggtaacggtaccggttcggtacccggtaccgggttaccgtacggttcggaaccggtaacccggtcggtaccgtccccggtaccccggtgtacccctcggtcccgttcccgtaacccccg

SEQ ID NO: 83010 - DNA, 665 bp, Homo sapiens
  misc_feature: GYAE6OF01BIE02.25.23.C01.1.454.CMB.1.raw
  modified_base (185)..(185): a, c, t, g, unknown or other
  misc_feature (185)..(185): n is a, c, g, or t
tcagactgtacagtcacgaccggtgctcgatttagtacacgtgattagggattggggacaggattcaggacaatctccagcatggccggcctccctctcctcctcaccctcctcactcactgtgcagggtcctgggcccagtctgtgctgactcagccaccctcagtgtctcgggacccccgggnaggagggtctccatctcttgttctgggagcagctccgacgtcggaaataagtttgtctactggtaccagcagctcccagaaaccggccccaagctcctcatctataggaatgatcagccggccctcgagggactaccgtgaccgtattcctcgtcggctcgaagtcgtggcctcccgtccgggccccttcccgtcggcctagtccgaggtcgggcctcccggtccggagggtacgtgaggtctagaacttattacgtggtgtacgtaggtttgggatcggtcctaggttcgttaggacggttcgggtcccggtaacgggttcgggttaccggggacggggtaacgggaccaaggtccgtacgggacccgttccggtacgggtccacggaccccgaagggtccctaccggtccccccgttacgggtccctaaccgttcccgttacccgttaccccctaccccttcccgtacccttaaccgg

SEQ ID NO: 83011 - DNA, 519 bp, Homo sapiens
  misc_feature: GYAE6OF01E0N21.25.23.C01.1.454.CMB.1.raw
  modified_base (220)..(220): a, c, t, g, unknown or other
  misc_feature (220)..(220): n is a, c, g, or t
  modified_base (334)..(334): a, c, t, g, unknown or other
  misc_feature (334)..(334): n is a, c, g, or t
  modified_base (391)..(391): a, c, t, g, unknown or other
  misc_feature (391)..(391): n is a, c, g, or t
tcagactgtacagtcacgaccggtgctcgatttagtacacgtgattagggattggggaggagaagacaggattcaggacaatctccagcatggccggcctccctctcctcctcaccctcctcactcactgtgcagggtcctgggcccagtctgtgctgactcagccaccctcagtgtctgggacccccgggcagagggtctccatctcttgttctgggancagctccgacgtcggaaatagtttgctactggtaccagcagctcccagaaacggcccccaagctcctcatctataggaatgatcagcggccctcagggatacctgaccgattcnctggctcgaagtctggctcctcggcctccctgcccatcagtggcctccggtcgaggntgaggctgaatattacgtgtgctaggtttggatgcctagtctggagtggtccgagggtcgttcggcggagggaccagctgaccgtctaggtcagccaggctcgcccctgtcactctcgtcccctaccc

SEQ ID NO: 83012 - DNA, 785 bp, Homo sapiens
  misc_feature: GYAE6OF01CR4QW.25.23.C01.1.454.CMB.1.raw
  modified_base (193)..(193): a, c, t, g, unknown or other
  misc_feature (193)..(193): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtcgtcgggacccccgggnaggacgggtctccattctcttgttcgtgggagcagctccgacgtacggaaattaagtttgtctacgtggtaccagcacgtcctacccgaagaaacccggccccaagtcctcctacattctaagtaaggaatgactcgacgccggccctacgagggtactaccgcgtaaccgtattcctacgtggacctacgtaagtcgtcgggtcctcccgttccggcccttcccggtcgggtaccctacgttcggacggttccggggtcccgttccccggggtaccgggtaacgggtacgttcgggaacgggtccgttaaggtaaactttaagtttacgtggtacggttacggttagggttttacggacgttcggacccgtagttacgttgggtaacggttccgggtacccgggttacggggttcggggttaccgggacgggggtaaccggtaccggtaacgggtccggttaccggtaacccgggttccggttaacggggacccgacccgggtaaccccggtaacgggtccccgttacccggtccccccgttacgggttacctacccgtttacccgttccccggttcccccggtacccccg

SEQ ID NO: 83013 - DNA, 662 bp, Homo sapiens
  misc_feature: GYAE6OF01CAFMK.25.23.C01.1.454.CMB.1.raw
  modified_base (230)..(230): a, c, t, g, unknown or other
  misc_feature (230)..(230): n is a, c, g, or t
  modified_base (297)..(297): a, c, t, g, unknown or other
  misc_feature (297)..(297): n is a, c, g, or t
  modified_base (351)..(351): a, c, t, g, unknown or other
  misc_feature (351)..(351): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagcccaccctcagtgtctcggggacccccggaggagggtctccatctcttgttctgggancagctccgacgtacggaaattagtttgctactggtaccagcagctccagaaccgccccaagcctccncatctataggaatgatcagccgccctcgaagggactaccgtgaccgtattctcncggtctcgaagtctgggcctccgtccggcctcccgtggccatcagggtcggccgtccgggtccgaggagtgaggtctgaacttagttaacgtggtacgtcgtagggttttgggacgttacgtccgtaggttccgtagggtcgggttcgggttaccccggttacggggttacggtttcccggggtaccggggaacggggtaacccgtaacgggtaccgtcgggtaaccccggttacccggttacgggtccgacccggtaccccggtaagggacccccgttccggcccccccgttcgggtcccgttaccccgg

SEQ ID NO: 83014 - DNA, 824 bp, Homo sapiens
  misc_feature: GYAE6OF01AUJ9O.25.23.C01.1.454.CMB.1.raw
  modified_base (134)..(134): a, c, t, g, unknown or other
  misc_feature (134)..(134): n is a, c, g, or t
  modified_base (227)..(227): a, c, t, g, unknown or other
  misc_feature (227)..(227): n is a, c, g, or t
  modified_base (240)..(240): a, c, t, g, unknown or other
  misc_feature (240)..(240): n is a, c, g, or t
  modified_base (296)..(296): a, c, t, g, unknown or other
  misc_feature (296)..(296): n is a, c, g, or t
tcagactgtacagtcacgaccggtgctcgatttagtacacgtgattagggattgggagagaagacaggattcaggacaatctccagcatggccggccctccctcctcctccctcacccctccctcactcgtacncgtgtcgagggtccggtcggtccgacgtacgtcggtcgactaggactccagccaccctcagtgtcctgggaacccccgggcagagggtctccntctcttgttacgngggaggcacgtcgtccgaacggtacgaaactaagttttctcgtacctgggtacccncgacacgccgtaccccgacggaaacccggaccccccgaacgtcctcccttccgataccttactaaggaactgactcgacggccgggtccccttaccgaagggtacgttaacccctacggtaacccgttactttccgtcgtgggtcctaccggtaaacggtcccttcggggtccccttcccgtttccccgggccccgttccctttccgggaacctacccgtacggtacgggttccggggtacccggttcccgggtcccggttacgggaacgttagtacgggtacttcggtaaacttacgtttacgtaggttccggcgttacgggtttacgggtctacggtcgtacggtccgtaggtacgggttcggttacccgggacgggtttcggtccggggtcgggtaaccggggaccgaacggtccggtacgtacccggttacccgtacgggtcccgtacggaccccggtacggtaccccgccgttccccccggtcggttaccctaccggttcccttccgttccccccgtaccccg

SEQ ID NO: 83015 - DNA, 704 bp, Homo sapiens
  misc_feature: GYAE6OF01D1V2D.25.23.C01.1.454.CMB.1.raw
  modified_base (235)..(235): a, c, t, g, unknown or other
  misc_feature (235)..(235): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggcagagggtctccatctcttgttctgggancagctccgacgtacggaaattaagtttgtctacgtggtaccagcacgcctacccgaacggaaaccccggccccccaaagcctcctactatctaagtaaggaatgactcgacggccggccctacgagggtactaccgtcgaccgtatttctcgtggctacgtaacgtcgtcggtccttccgtcggcccttcccgtcggccctagtccgacggtcgggcccgttcccgggtacgaggtagtcggacgtctagtaattacgttacgtggtgtacgttagggtttgaactcgaccgtagttcgttgggaggttccgggtaccggtacggggttcgggtaccggggaccggggaacggggaacccgtaagggtcccggttaccgggtaaccccgggtttcccggtaacggggttacccgaacccgggtaccccggtaaaccggggtcccccgttccccgggtaccccccccggg

SEQ ID NO: 83016 - DNA, 663 bp, Homo sapiens
  misc_feature: GYAE6OF01BRFAU.25.23.C01.1.454.CMB.1.raw
  modified_base (210)..(210): a, c, t, g, unknown or other
  misc_feature (210)..(210): n is a, c, g, or t
  modified_base (239)..(239): a, c, t, g, unknown or other
  misc_feature (239)..(239): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctggcccagtctgtgctgactcacgcccaccctcagtgtccgtcggggacccccggnagagggtcctccatctcttgtcgtgggancagcctcgacgtacggaaaattagtttcgtctacgtggtaccagtcagcctaccgaacggaaacccgcccccgaaagcctacctacacttaccgtaataacggaattgactcgacggccggacccctagagggtaaccttaccgtcggtaacccgtacttcgttccgtcggtaccgtacggtaacgtccgtacggtccgttcccgacccggtcccttccgtcggcctaacgtcgaggtcgggcctaccgggtcgaggtatcgtatcggcctagtaattcgttagtgcgtactagggtttggacttcggaccgtagttcgtacggtaggttccggtaccggtgggtttcggtacgggacggacggtaaccgaacggtccgtacggtccgttacggtcgacgtacggaccctgggccccgtacccg

SEQ ID NO: 83017 - DNA, 763 bp, Homo sapiens
  misc_feature: GYAE6OF01AO9DG.25.23.C01.1.454.CMB.1.raw
  modified_base (222)..(222): a, c, t, g, unknown or other
  misc_feature (222)..(222): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctcggggacccccgggcaggagggtctccatctcttgttctgggancagctccgacgtcggaaattaagtttgtctactggtaccagcagcctccaagaaaccggccccaagcctcctcatctaataggaatgatcacgcggccctgagggactaccgtgaaccgtattcctcgtcggctacgtaagtcgtcggtcctcccgtcggcccttcccgtcgggaccctacgttccgacgggttcggggtacccgttcccggggttacccggaagggtacgttacggggacggttacccgttaaggtaaaacgtttacgtttaaccgttgggttacgtaccggtttagggttttcggggaacttccgggtacccgtaaggttccgttaacgggtacgggtttaccgggttaccccgggttacggggttcggggttaccggggacgggtaaccgggaccgtaacggtccggtaccggtacccggtacccgttacgggtcacccgggacccgtaacgggtcccgttacccgggtacccccccgttcgggttacccacccggtttcccgttcccggttccccccttaacccccg

SEQ ID NO: 83018 - DNA, 723 bp, Homo sapiens
  misc_feature: GYAE6OF01C6KCP.25.23.C01.1.454.CMB.1.raw
  modified_base (201)..(201): a, c, t, g, unknown or other
  misc_feature (201)..(201): n is a, c, g, or t
  modified_base (229)..(229): a, c, t, g, unknown or other
  misc_feature (229)..(229): n is a, c, g, or t
  modified_base (308)..(308): a, c, t, g, unknown or other
  misc_feature (308)..(308): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctcgggacccccgggnagagggtctccatctcttgttctgggancagctccgacgtcggaaatagtttgctactggtaccagcagcctcccaagaaaccggcccccaagcctcctcatctaanaggaatgatcgagccggccctgagggactaccgtagaccgtatttcgtctgggtcctacggtaacgttccgtcgggccttacccgtcccgggtcccttccccggttgggaccccaagttccgaacgggttcggggtcccgttacccggggttccggaagggtacgtcggtacggtacgtaggtaaattacgtttaaccgtggttacgtacgtttaacgggttttaggggtactcgggtacccgttacgtttacgttcgggtaacgggtttccggggtcccggttaacggggttcggtttaccgggggaccgggtaacggggtaccctaaggtccgtacgggaccccggtttacgtacgggtaccgaacggtacccgaaacgggtccttaccccggtccccgtggttcctacccgg

SEQ ID NO: 83019 - DNA, 700 bp, Homo sapiens
  misc_feature: GYAE6OF01B4GXX.25.23.C01.1.454.CMB.1.raw
  modified_base (171)..(171): a, c, t, g, unknown or other
  misc_feature (171)..(171): n is a, c, g, or t
  modified_base (194)..(194): a, c, t, g, unknown or other
  misc_feature (194)..(194): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctnagtgtccgtcggggacccccggnaggacgggtctccattcttctttgttcgtgggacgcagcctccggacgtacggaaaattagtttgtctacgtggtaccagcagcctacccgaacgaaaccggcccccaagcctcctcatctaagtaggaatgatcgacgccggcctggacggactaccgtcgaaccgtacttcgcgtacgcgtacgaagtctggcctccgtccggtccctcccgtcggaccctacttaccggacggttcggggtccgttcccggggtaccggagggtacgtcggaacggtcttaagtaaacttacgttacgtggtacgtacggttagggtttcggattcggccttaggtccgtaggtcgggtcggtaccgggtagggttcgggtacgggacgggaacggacctaacggtccggttaccgacccgttacgtacggtaccgacgggaccccgacggtcccgtacccggcccccgttcggtaccctacccgtttcccgttcccggttcccccgtccccg

SEQ ID NO: 83020 - DNA, 984 bp, Homo sapiens
  misc_feature: GYAE6OF01AOGSV.25.23.C01.1.454.CMB.1.raw
tcagactgtacagtcacgaccggtgctcgatttagtacacgtgattagggagttggggagcttcagctgttggtagagaagacaggattcaggacaatctccaggctatggccggccctccctcctacctccctccaccctcctcactcactgtgcagggtcctggggcccagtcgtagtagctgactctacgccaccctcagtcgtccgtcggggacccccgggcgacggtacgggttcctacccgtacttccgttccgtttcggtttccgttagggggaacgtccggtaacgggtccggttacccgggtaaccgggttaaccgggtaaaaacgtttaaacggtttttccggttacctttaaccggttaccgggttaaacccgaaacggtaccgtaacggtaccccgttaacccccggaaaaccgggtaaaacccccgggaccccccctaaaagggtcccctttaaccccgtaaccgaacttaccgttaaacgtaacgggtaaacttacggtaacttaccgaacgggtccccgggtaccccgtaacggaacggggtaacttacccgtaccggtaaacccgtaacttttaccgtaccgttacggtaccgtttaaacggtaacggttaccggtaccgggtacccgttacccggtacccgggtaccccgttaccccgtacgggtaccctaacgttaccggtaacgggttaccgggttaccccgttcccggttaccggtaagggtacgttacgggacggttacttaaggtaactttaacgttacggttcggtacggtacggttaaggggtttcggtaacgttccggttaccgtaaggtttcgttagggtaccggtttcgggtaaccggttacgggttcgggtaccggggtacgggtaacggtaccgtaacgtccggtaccggtaccccggttagtaacccggtaccgaaccgggacccgtaacgggtcccgttacccggtacccccg

SEQ ID NO: 83021 - DNA, 624 bp, Homo sapiens
  misc_feature: GYAE6OF01ESUNZ.25.23.C01.1.454.CMB.1.raw
  modified_base (210)..(210): a, c, t, g, unknown or other
  misc_feature (210)..(210): n is a, c, g, or t
  modified_base (244)..(244): a, c, t, g, unknown or other
  misc_feature (244)..(244): n is a, c, g, or t
  modified_base (370)..(370): a, c, t, g, unknown or other
  misc_feature (370)..(370): n is a, c, g, or t
  modified_base (439)..(439): a, c, t, g, unknown or other
  misc_feature (439)..(439): n is a, c, g, or t
tcagactgtacagtcacgaccggtgctcgatttagtacacgtgattagggattgggggagcttcagctgtggtagagaagacaggattcaggacaatctccagcatggccggcctccctctcctcctcaccctcctcactcactgtgcagggtcctgggcccagtctgtgctgactcagcccaccctcagtgtcctcggggacccccggnaggagggtctccatccttcttgttcgtggggacncagcctccgacgtcggaaattaagtttgtctactggtaccagcagcctaccaagaacccggccccaagcctcctcatactataggaatgatcagcgcctcgagggactaccgtgaccgtattctcnggctcgaacgtcgtcgcctccgtcggtccctccgtgccatcgaggtcgggccttccgggtacgacggtntcggacggtctacggtaattacgttacgtggtacgtcgttaggtttgggacgtcgacgttagttcgtaggcgttcgggtccgtacgggttcggttacgggccgggtacgggaccgtaaggccgtacggtacccggttaccgcgggtaccgaccggtacccggaacggccctccgggtaccccccg

SEQ ID NO: 83022 - DNA, 727 bp, Homo sapiens
  misc_feature: GYAE6OF01E3SWG.25.23.C01.1.454.CMB.1.raw
  modified_base (202)..(202): a, c, t, g, unknown or other
  misc_feature (202)..(202): n is a, c, g, or t
  modified_base (232)..(232): a, c, t, g, unknown or other
  misc_feature (232)..(232): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagcccaccctcagtgtctcggggacccccggnaggagggtctccatctcttgttcgtgggancagcctccgacgtacggaaattagtttgtactactggtaccagcagcctcccgaagaaaccggcccccaagcctcctcatctagtaggatgatcgacggccggccctcgacggtactaccgtcgaccgtattccgtcgtcggctacggaacgtcgtcgggtccttcccgtcccggtcccttacccgtcgggaccctagtccgtacgggtccgggtcccgttcccggggtacccggagggtacgtcgggacgggtacgtaaggtaatttacgtttaaccggttcggtacgtaccggtttagggttttacgggacgttcggcccgttaaggttccgtagggtacggttcggggttacccgtacggggtttcggttaccggggacggggtaaccgggtaccgaacggtccggtacggtaccccggttccgtagggtacccgaccggtaccccggtaacggtcccgttacccggtccccccgttgggtccctaccccgg

SEQ ID NO: 83023 - DNA, 733 bp, Homo sapiens
  misc_feature: GYAE6OF01AQYED.25.23.C01.1.454.CMB.1.raw
  modified_base (219)..(219): a, c, t, g, unknown or other
  misc_feature (219)..(219): n is a, c, g, or t
  modified_base (302)..(302): a, c, t, g, unknown or other
  misc_feature (302)..(302): n is a, c, g, or t
  modified_base (374)..(374): a, c, t, g, unknown or other
  misc_feature (374)..(374): n is a, c, g, or t
  modified_base (380)..(380): a, c, t, g, unknown or other
  misc_feature (380)..(380): n is a, c, g, or t
  modified_base (573)..(573): a, c, t, g, unknown or other
  misc_feature (573)..(573): n is a, c, g, or t
tcagactgtacagtcacgaccggtgctcgatttagtacacgtgattagggattggggagcttcagctgtggtagagaagacaggattcaggacaatctccagcatggccgcctccctctcctcctcaccctcctcacctcactgtgcacgggtcctcgggcccagtctgtcgctagactccacgcccaccctgagtcgtccgtaccggggacccccggngtacggacgggttcctccgcttccgttcgttacggttcgtgggactcgacgtccgtaccggtaacggtacgtaattacgttcncttacgtcggacagtccacgccctaacgaaccgaaccccgacccagtcctacctactatacgtagtacgtancgtacnccgacgccgtacgtacggacgtacctcgtacgtaccttcgtactcggtagtaccgtacgtcgtcgtccgtcccgtccgtccgacccgttcgacgtaccgtcgacggtcgggtcccgtacgggtcccggtaagcggttagacgtacgtacgttaagttacgtttaccggtgtacggtttcgaaaggtttcgggnttaccccgagtacggttcgtagggtccggtaccgggttacggcgggttaggtcccgggggttaaacggcccggttaaaccggcgtaccgggttacgtcccggttaccggaaccgttaccggacccgtacgtacccgggccttaccccggtcccgttaccg

SEQ ID NO: 83024 - DNA, 733 bp, Homo sapiens
  misc_feature: GYAE6OF01CAHYX.25.23.C01.1.454.CMB.1.raw
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcacgccaccctcagtgtcgtcggggacccccgggcagagggtcctccatctcttgttctgggagcagcctccgacgtcgaaatagtttgtctactcggtaccagcacgcctacccgaagaaacccggcccccaagtcctaccctcaactctaagtacggaatcgactcacggccggccctacgaggactaccgtcgaccgttacttcgtaccgtggccttagtaacgtcgtcggtccttcccgtacccgtccccgttccgtacgggcctaacgttcgacggttccgggacccgttccccgggtcggaacgggtacgtggaccggtactagtaaactttagttacgtggtcgtacggttaggttcgggaacttcggaccgttaggttaccggttcgggtaacggtccgggttacggttaccgggttcggggttaccgggaccggggtaacgggaacccgtaagggtcccgttaccggtaacccgggttacccgtacgggtacccgaaccggaccccggtacggtacccgtcccccggtccccccggttaggttcccttaccccgg

SEQ ID NO: 83025 - DNA, 728 bp, Homo sapiens
  misc_feature: GYAE6OF01CIMKD.25.23.C01.1.454.CMB.1.raw
  modified_base (200)..(200): a, c, t, g, unknown or other
  misc_feature (200)..(200): n is a, c, g, or t
  modified_base (230)..(230): a, c, t, g, unknown or other
  misc_feature (230)..(230): n is a, c, g, or t
  modified_base (396)..(396): a, c, t, g, unknown or other
  misc_feature (396)..(396): n is a, c, g, or t
tcagactgtacagtcacgaccggtgctcgatttagtacacgtgattagggattggggagctgtggtagagaagacaggattcaggacaatctccagcatggccggcctcctctcctcctcaccctcctcactcactgtgcagggtcctcgggccagtctgtgctgactcagccacctcagtcgtcgtcggggaccccggnagacggtctcatcttcttgttcgagggacnctacgctcgacgtacggtaaattagtttgactacgtcggtaccagctaacgcctacccgaaacggaacccggccccaacgtcctacctacgtaataccgttaaagtaggaacttacgaactaccggaaccggcccggtacccttaaccgggaaggttaacctaccncgggtaaccctagttttccacggttcggaccgtacggtaacgtcgttcgggcctcccggttccgccttaccccgtggcctagtcccgaggtcggtccgtccgggtacgaggtactggtacgtacgtagtaacttattaccgtgtacgcgttaggttaggacgtcggaccgtggttcgtaggtcgggttacggtaccgggtcgggttcgggtaccggggaacggaccgggaacgtaacggtccggtacggtacccggttaccggtagggtacccctaaggaccccggtaacgggttccgtaccccggtcccgttaccgggtccttaaccccgg

SEQ ID NO: 83026 - DNA, 740 bp, Homo sapiens
  misc_feature: GYAE6OF01CRWX1.25.23.C01.1.454.CMB.1.raw
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctcgggacccccgggcaggagggtcctccatctcttgttctgggagcagctccgacgtacggaaataagtttgtctactggtaccagcagctcccaagaaaccggcccccaagcctcctcatctataggaatgatcagccggccctcgagggactaccgtgaccgtattctcgtcggctcgaagtctggcctccgtcggccctcccgtcggctactcgaggtcgggccctccgggtccgaggacgtggaggtctgtaaacgtttacttacgtggtacggtacgttagggtttacgggagttcggacccgtaggtcgttagggtacgggttcgggtaccccgggttaaggggttcgggtttaccggggaaccgggggtacggggtaacccgtaaacgggtcccggttaccgggtaaacccccgttccgggtttaaccgggtacccggaacccgggttaacccccgggaacgggtacccccggttcccggggtacccccccccgtttcgggtaaccccgttacccgttttcccggtacccccggtttccccccgttacccccccgg

SEQ ID NO: 83027 - DNA, 659 bp, Homo sapiens
  misc_feature: GYAE6OF01A1JWC.25.23.C01.1.454.CMB.1.raw
  modified_base (186)..(186): a, c, t, g, unknown or other
  misc_feature (186)..(186): n is a, c, g, or t
  modified_base (209)..(209): a, c, t, g, unknown or other
  misc_feature (209)..(209): n is a, c, g, or t
  modified_base (237)..(237): a, c, t, g, unknown or other
  misc_feature (237)..(237): n is a, c, g, or t
  modified_base (342)..(342): a, c, t, g, unknown or other
  misc_feature (342)..(342): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctnagtgtctcggggaccccccgggnagagggtctccatctcttgttctgggancagctccgacgtcggaaatagtttgtctactggtaccagcagctccagaaccggccccaagcctcctcatctataggatgatcagccgccctagaggactaccgngacctattctctgggctacggaagtcgtcggccttcccgtccggtccctcccgtcggcccatcgaggtcgggcctcccgggtcgaggtacgtggaggtcgtagtaattacttacgtggtcgtacgttagggtttcgggatcgtaccgtaggttcgttaggacggttcggggttacccggtagggtttcgggttaccggggaccgggggtaacggggtaaccccgtaagggtccggttaccgggtaccccggtttacccggtacgggtacccggacccggtaacccggaacgggtcccgttccccggtacccccccgg

SEQ ID NO: 83028 - DNA, 702 bp, Homo sapiens
  misc_feature: GYAE6OF01A01CP.25.23.C01.1.454.CMB.1.raw
  modified_base (223)..(223): a, c, t, g, unknown or other
  misc_feature (223)..(223): n is a, c, g, or t
  modified_base (261)..(261): a, c, t, g, unknown or other
  misc_feature (261)..(261): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctcggggacccccgggcaggagggtcctccatctcttgttctgggancagctccgacgtcggaaatagtttgtctactggtaccngcagctcccagaaaccggccccaagcctcctcatctataggatggatcagccggccctcgagggactacccgtgaccgtattcctcgtggctcgaagtctcggctcctcggcctccctggccatcgaggtcgggccgtccgggtcgaggtagtggacggctaggaaacttattacgtgtacgacgttagggtttgggactcggcctaggtcgtaggtacgggttcgggtcccggtacggggttcgggtttaccggggaccggggtaacggggacccgtaagggtcccgttacgggtaccccggttacccggttaacgggtcccgtaaccgggtacccccggtaaacgggtcccccgttaccccgggtccccccccggttacggggttacccctaacccgttttcccgtttaccccggtttccccccccgttaaccccccgg

SEQ ID NO: 83029 - DNA, 671 bp, Homo sapiens
  misc_feature: GYAE6OF01BMPSI.25.23.C01.1.454.CMB.1.raw
  modified_base (206)..(206): a, c, t, g, unknown or other
  misc_feature (206)..(206): n is a, c, g, or t
  modified_base (209)..(209): a, c, t, g, unknown or other
  misc_feature (209)..(209): n is a, c, g, or t
  modified_base (214)..(214): a, c, t, g, unknown or other
  misc_feature (214)..(214): n is a, c, g, or t
  modified_base (233)..(233): a, c, t, g, unknown or other
  misc_feature (233)..(233): n is a, c, g, or t
  modified_base (302)..(302): a, c, t, g, unknown or other
  misc_feature (302)..(302): n is a, c, g, or t
tcagactgtacagtcacgaccggtgctcgatttagtacacgtgattagggattggggcagcttcagctgtggtagagaagacaggattcaggacaatctccagcatggccggcctccctctcctcctcaccctcctcactcactgtgcaggtcctgggcccagtctgtgctgactcagcccaccctcagtgtctgggacccccggnagnggtcnccatctcttgttctgggancagctccgacgtacggaaattagttgtctactggtaccagcagtctccagaaccgccccaagcctcctnactctataggatgatcgagcgccctgacgggactaacctgaccgtattctctggctacgaacgtctcggcctcccgtcggtccctcccgtcggcctacgtcgaggtccgggtccgtccgggtaccggaggtacgtcggacggtcctagtaacgttacgtttacgtggttacgtacgttaagggtttaggtacgtcgtacccgttagtcggttcggtaaggttccggggttcccggtaacgggttcggttaccgggggaccgggtaacggggtaaccccgtaacgggtcccgtacggttaacccccgggttaccgtaaccgggttacccaaccgggtcccccggaaaggggtcccgttaaccccccgggg

SEQ ID NO: 83030 - DNA, 751 bp, Homo sapiens
  misc_feature: GYAE6OF01D8YGY.25.23.C01.1.454.CMB.1.raw
  modified_base (223)..(223): a, c, t, g, unknown or other
  misc_feature (223)..(223): n is a, c, g, or t
  modified_base (724)..(724): a, c, t, g, unknown or other
  misc_feature (724)..(724): n is a, c, g, or t
tcagactgtacagtcacgaccggtgctcgatttagtacacgtgattagggattggggcagcttcagctgtggtagagaagacaggattcaggacaatctccagcatcggccgcctccctctcctcctcaccctcctcactcactgtcgcgacgggtccgtcgggcccagtctgtgctcgactcacgcccacctcgtagttcgtccggtccggggaccccgggnagggtacggttcctcctagttcctttcgtttacgttcggagggacgcgacggtccgtaccggtaacggttaacggtaaagtttaacggtttcgtaccgttaacggtacggtaccaggccaacgtcccgtaacccgaacggtaaaccccgacccccgtaagtcccttaccctactaacgtaccgttaagtaaggtaactgtaccgtaccgacggtcccgccgtaggaacggtaacctaccgtacggtaactcgttcctcggtcgtaccgtacgtacggtcgtccggtccttacccggtcccgtcccttccggcggtccctaggtccggtacgggtccggtccccggtacgggacggtagtacggtggacgtactagttaagttcgttacgtggacgtcggttagggttcgacgttccgcgttagttcgaggtacggtcgggtccgtcggggttcgccgggtagggaaccgtctaccgggtcgtaccggtcccgtaggtaccncgaaccggcccgtccggcccgtccccg

SEQ ID NO: 83031 - DNA, 605 bp, Homo sapiens
  misc_feature: GYAE6OF01DCO45.25.23.C01.1.454.CMB.1.raw
  modified_base (304)..(304): a, c, t, g, unknown or other
  misc_feature (304)..(304): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctggcccagtctgtgctgactcagccaccctcagtgtctcgggacccccgggcagagggtctccatctcttgttctggagcagcctccgacgtacggaaattagtttgtctactggtaccagcagctccacgaaaccggcccccaagctcctcatactataggaangatacgagccggccctacagggactacctgaccgcttactctggctcgaagtctcggctccctcggccctcccgtcggcctatcgtagtcgggcgtcccgggtccgaggagtcgacgggaccgtaagttatacgttgtggacgtaggtttacggagtcgtccgtagtcgtggtaggtcgggtccggtacggttcgggtccgggaggggacggaccgaagcgtacgacccgtcgtaggaccgagaccccgagtccgtcccgccccgtcggtcctaccttcgtccgttccccgtcccgtcccg

SEQ ID NO: 83032 - DNA, 770 bp, Homo sapiens
  misc_feature: GYAE6OF01CU35C.25.23.C01.1.454.CMB.1.raw
tcagactgtacagtcacgaccggtgctcgatttagtacacgtgattagggattggggcagcttcagctgtggtagagaagacaggattcaggacaatctccagcatggccggcctcctctcctcctcaccctcctcactcactgtgcgacgggtcctgggcccagtctgtcgctgactcacgcccacctcagtcgtccgtccggggacccccgggacaggacggtctcctacttccttcttcggttcgagggcgcacgctccggtacgtaggtaaaacttaggtttacgtccgtagttacggtaaccagacgacgaccgtaccccgaacggaaaccccggacccccaaaggtccccttacctacctaactttacgtaaaggtacggtaaatcggaacttaccgacggtcccggccttacgggacgtaaccttacgtacgaccgttacttcgtcgtacggtacctacggtaacgtccgtcggtccctccgttcccgggccctccgttacggacctctacggttacgggtccgggtcgtttacccggggacgagggtacgtagcgggtacttaacggtattacgtttactggtacgtacggtttagtacgggctaacgggtcttaacggtctaacggggttcgggtacggttaccgggcggtttacccggggacgggacgggtacccgggtaaacacccggttcggtaaacccgggcccgtacggttaaggtacccggaacccgtaccggtacgtccccgggtttacccccc

SEQ ID NO: 83033 - DNA, 777 bp, Homo sapiens
  misc_feature: GYAE6OF01AJY25.25.23.C01.1.454.CMB.1.raw
  modified_base (182)..(182): a, c, t, g, unknown or other
  misc_feature (182)..(182): n is a, c, g, or t
  modified_base (207)..(207): a, c, t, g, unknown or other
  misc_feature (207)..(207): n is a, c, g, or t
  modified_base (245)..(245): a, c, t, g, unknown or other
  misc_feature (245)..(245): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcgagggtcctgggcccagtctgtgctgactcacgccaccctnagtcgtcgtaccggggacccccggnaaggcgggtcctccagttccttctttgttccgtgggancgacgcctccgacggtacggaaacttagtttcgtctacgtcggtaaccagccgagtcccgtacccgaaacggaaaccccggcccccaagtccctaccctactaagttccgtaagtaaggaaacttcgaagtaccggacggtcccggccctaacgggaacgggtacctacccggtacgacccggttattcccgcgtacgggtcttaacggagtccgtcggtcctcccggccgtccctaccggtcaccgtacgttccgggacgggttccggggtacccggtttcccggggaccggtaaggggtactacggggtacgtaccggttaaagtaacgtttaacgttcggtcggttagtacggttagggttttgaccgttcgaacggttacgttggtacggtacgggttcgggtacccgttaggggttcggtaccggggcgggtaacggaccgtaacggtcggtaccgggtacgttaccggtacggtacccgacgtaccggtaccggtccctaccccgggtcctacggtcctaacccgg

SEQ ID NO: 83034 - DNA, 721 bp, Homo sapiens
  misc_feature: GYAE6OF01AKSD7.25.23.C01.1.454.CMB.1.raw
  modified_base (357)..(357): a, c, t, g, unknown or other
  misc_feature (357)..(357): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtcgtcgggaccccccgggcaggacgggtctccatctcttgttctgggagcagctccgacgtacggaaatagttgtctactggtaccagcacgctcccaagaaacccggcccccaagcctcctcactctagtaggaatgatcgaggccgccctgagggactaccgtagaccgtnttccgtctcggctcgagtcgtcggacctcccgtccggccctcccgtcggcctacgtccgtacggtcgggtcccgttccccggggtaccggacgggtacgtcggacgggtcctaagtaacttacgtttacgtggtacggtaccgtttagggtttcgggtacgtcgtaccgttacggtcgttacgggtacggggttccggggttacccgggtaccggggttacgggttcccgggggtacggggaacgggtaacccgtaacgggtaccggtaccggtacccggttacggttaccgggtacccgaccggacccggtaaccgggtcccgttacccccggtccccccgttacggttcccgttaaccccgg

SEQ ID NO: 83035 - DNA, 784 bp, Homo sapiens
  misc_feature: GYAE6OF01CPQZD.25.23.C01.1.454.CMB.1.raw
  modified_base (220)..(220): a, c, t, g, unknown or other
  misc_feature (220)..(220): n is a, c, g, or t
  modified_base (232)..(232): a, c, t, g, unknown or other
  misc_feature (232)..(232): n is a, c, g, or t
  modified_base (256)..(256): a, c, t, g, unknown or other
  misc_feature (256)..(256): n is a, c, g, or t
  modified_base (412)..(412): a, c, t, g, unknown or other
  misc_feature (412)..(412): n is a, c, g, or t
tcagactgtacagtcacgaccggtgctcgatttagtacacgtgattagggattgggggggaagctcagcttcagctgtggtagagaagacaggattcaggacaatctccagcatggccggcctccctctcctcctcacccctcctcactcactgtgcgagggtcctgggcccagtctgtgctgactcagcccaccctcagtgtcgtccgggacccccggnaggacgggtccnccattctcgtttgttcgtgggacncagcctacggacgtacggtaaattagtttgtactacgtacggtaccagcacgtcctacccgaacgaaaccccggcccccaaggtccctacctacattacctaagtaaggaatagactcgacggcccgccgtacgacggtactaccgtcgaaccgtnttaccgtcgtcggtctacgtaacgttccgtcgtacccgtacccgttccggtaccccgttcccgtacgggtacccctaggtaccgttacgggtccgggtccgttaccccggggtccgaacggggtatcgggtaacggcgttaagttaacgtttacttaccggttacggttcgaaccggtttagggtttacgggacgttccggtaccgttacggttacggttacgggttacgggttaccgggtttaacccggggtcgggtttaccggggttaccggggaaccgggggaccggttaaccccggaaacggttcccgtaccggggttaaccccgtttaccgtaccggggttaccaccgggtacccccgttaacgggg

SEQ ID NO: 83036 - DNA, 799 bp, Homo sapiens
  misc_feature: GYAE6OF01C2U3B.25.23.C01.1.454.CMB.1.raw
  modified_base (219)..(219): a, c, t, g, unknown or other
  misc_feature (219)..(219): n is a, c, g, or t
  modified_base (250)..(250): a, c, t, g, unknown or other
  misc_feature (250)..(250): n is a, c, g, or t
  modified_base (255)..(255): a, c, t, g, unknown or other
  misc_feature (255)..(255): n is a, c, g, or t
  modified_base (338)..(338): a, c, t, g, unknown or other
  misc_feature (338)..(338): n is a, c, g, or t
tcagactgtacagtcacgaccggtgctcgatttagtacacgtgattagggattgggggggaagctcagcttcagctgtggtagagaagacaggattcaggacaatctccagcatggccggcctccctctcctcctcaccctcctcactcactgtgcagggtcctgggcccagtctgtgctgactcacgcccaccctcagtgtcgtcggggacccccggnaggacgggtcctccatctcttgttctgggancagcnccgacgtacggaaattagtttgtctactggtaccagcagcctacccaagaaccggcccccaagcctctcatctatagaatgancacgcgcctacgaggactaccgtgaccgtacttctcgtcggtctacgtaagtcgtcggtcctcccgttccgggtaccccttcccgtcgggaccctaacgttccgaagggttccggggtacccgttaccccggggtacccggaaggggtagttcgggaacgggtcgtttaaacggtaaattttaaccgtttaccggtaggttaaccggtaccggttaaacggggttttttcggggggaattccgggaaccccgttaagggtttccgttaaggggtaaccggggtttcccggggttaccccgggttaacgggggtttccggggtttaaccggggggaacccgggggtaaacgggggtaaaccccgtaaaacggggtcccgtttaacccgggtaacccccgggttttaacccccggtaaaggggtttaaccccaacccggggtaccccccggtaaaaccggggg

SEQ ID NO: 83037 - DNA, 715 bp, Homo sapiens
  misc_feature: GYAE6OF01CW8V9.25.23.C01.1.454.CMB.1.raw
  modified_base (206)..(206): a, c, t, g, unknown or other
  misc_feature (206)..(206): n is a, c, g, or t
  modified_base (232)..(232): a, c, t, g, unknown or other
  misc_feature (232)..(232): n is a, c, g, or t
tcagactgtacagtcacgaccggtgctcgatttagtacacgtgattagggattggggagcttcagctgtggtagagaagacaggattcaggacaatctccagcatggccgcctccctctcctcctcaccctcctcactcactgtgcagggtcctggacccagtctgtgctgactcacgccaccctcagtgtctcgggacccccggnagaggtctccatctcttgtctgggancagctccgacgtcggaaataagtttgtctactggtaccagcagctccagaaccggccccaagctcctcatctataggatgatcagcgcctcgaggactaccgtgaccgtattctcgtggctacgaagttcgtcggtcctcccgtccggtccctacccgtcggaccctacgtccgtaacggttccggggtacccgttccccgggtaccggaacgggtacggttcggacgggtaccgttaaggtaaacgttaacgtttacgtttaggtacggtaccgttagggttttacgggacttaccggtacccgtaggttccgttgggtaacgggtttccgggttacccgggtacggggttcgggtttacccgggggacggggtaacgggaacccggtaacgggtccggttaccggtaaccccgggttacccgttaacgggtacccgaaccggacccccggtaaacgggtcccgtcccggttacccccccgg

SEQ ID NO: 83038 - DNA, 731 bp, Homo sapiens
  misc_feature: GYAE6OF01E4OKL.25.23.C01.1.454.CMB.1.raw
  modified_base (213)..(213): a, c, t, g, unknown or other
  misc_feature (213)..(213): n is a, c, g, or t
tcagactgtacagtcacgaccggtgctcgatttagtacacgtgattagggattgggggagcttcagctgtggtagagaagacaggattcaggacaatctccagcatggccggcctccctctcctcctcaccctcctcactcactgtgcagggtcctcgggcccagtctgtgctgactcacgccaccctcagtgtccgtcggggacccccgggngaggacgggtcctccattcttcttgttcgtgggagcagccgtccggacgtacggtaaattagttgtctacgtcggtaccagcacgcctaccgaacggaaacccggacccccaagcctcctcacttctaagtaggtaactgactcgacgccgtcctacggacggtactaccgtacgaaccgtacttcgtcgtcggtctacgtacgtcgtacgtccctccgtccgtccctccgtcggacctcgtcgtaggtccgggtcccgtccgggtaccgagggtagtacgggacgtacgtaagttaacttacgtttaccggtgtacgtacgttaggggtttcgggactccggtaccgttaggttcggttacgggttcgggttaccgggttaccgggtacgggtttcggggttaccgggggaccggggaaacggggaccctaaagggtcccgttaaccgggtaccccggttaccgtaacgggaccaaccgggaccccggtaacgggtcccttcccccgggtaaccccg

SEQ ID NO: 83039 - DNA, 607 bp, Homo sapiens
  misc_feature: GYAE6OF01CXI0N.25.23.C01.1.454.CMB.1.raw
  modified_base (249)..(249): a, c, t, g, unknown or other
  misc_feature (249)..(249): n is a, c, g, or t
tcagactgtacagtcacgaccggtgctcgatttagtacacgtgattagggagttggggggggaagctcagcttcagctgtggtagagaagacaggattcaggacaatctccagcatggccggcctccctctcctcctcaccctcctcactcactgtgcagggtcctgggcccagtctgtgctgactcagccaccctcagtcgtcgtcgggacccccggcaggagggtctccatctcttgttcgtgggancagctccgacgtcgaaattagttgtctactggtaccagcagctcccaagaaccggccccaagcctcctcatctataggatgatcgagccgcctgaggtactaccgtgaccgtatttctcgtggtcctacgtaagtcgtcggccttccgtccggtccctcccgtcggcctagtccgaggtcgggccgtcccgggtccggaggacgtggacggtctagtaattcgttacgtgtcgtacgttaggtttgggatcgccgtagtcgtaggtcggtcggtaccgggtaggttcgggttccgggacgggacgggaccaacggtccgtacggtacccggttcgacggtcccgacggcccgtacggg

SEQ ID NO: 83040 - DNA, 771 bp, Homo sapiens
  misc_feature: GYAE6OF01AODLG.25.23.C01.1.454.CMB.1.raw
  modified_base (211)..(211): a, c, t, g, unknown or other
  misc_feature (211)..(211): n is a, c, g, or t
  modified_base (243)..(243): a, c, t, g, unknown or other
  misc_feature (243)..(243): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagcccaccctcagtcgtcgtcggggacccccgggnaggacgggtctccatctcttgttcgtgggacncagcgtccggaacggtacggtaaattaagtttgtacctacgtcgggtaccagccacggtccctaccccgaaggaaaaccccgggccccccaaggtcctaccctacaacgttacctaagtaagggaattcgactacgacggccgtccctaggacgggtactacccgtacggaccgttattccgtcgtcggtcgtacgtaacgttccgtcggtcccttccccggttcccggtccccttacccgtcgggaccctaggttacccggtaggggttcccgggtacccgttccccggggttaaccggaacggtacgttacgggaacggttcgttaagtaactttacgtttaccgtgggtacgtacggtttagggtttcgggaacttcggtaccgtaggttacgtggtacgggttccgggtcccggtagggttcggttaccggggacggggtaacggtaccgtacggccgttccggaccccgtacggttaccggtaaccggaccgacccgtacggtccccgtcccggtacccccgg

SEQ ID NO: 83041 - DNA, 793 bp, Homo sapiens
  misc_feature: GYAE6OF01DFLCL.25.23.C01.1.454.CMB.1.raw
tcagactgtacagtcacgaccggtgctcgatttagtacacgtgattagggattggggagagaagacaggattcaggacaatctccagccatggccggcctcctctcctcctcaccctcctcactcactgtgcagggtcctgggcccagtctgtgctgactcacgccaccctcagtgtcgtcgggacccccgggcaggagggtctccatctcttgttcgtgggacgcagcctcgacgtacggtaaattagtttcgtctacgtcggtaccagacctagccctacccgaaacggaaaccccggacccccaaagtcccttacccactaacttccgtaagttaacggaaacgtcgtacgccgaacggtccggtaccctcggaacgggtacctaccgtcgaccgttacttccgtcgtacggtaccttacggtaacgttccgtcggtcccgttcccgttcccgggcccttcccgtacggcctacgtacggtcggttccgggccgttcccggggtacggacggtacgttacgggacggtacgttaaggttaacttaacggtttactcggttaacgggtcgttttaacggggttcggggacttaccgggtcgttaacgggttcgttacgggtaacgggttccggggttacccgggttagggtttcgggtaccggggtacgggaacgaccggcggtacgttacggtacccggtagttcggaccgtaaccggccggtaacgtcccccgtcccgtacccccggttcgtaacgttcccgttaacccgttcccgtccccccgtaccc

SEQ ID NO: 83042 - DNA, 881 bp, Homo sapiens
  misc_feature: GYAE6OF01CXCB9.25.23.C01.1.454.CMB.1.raw
tcagactgtacagtcacgaccggtgctcgatttagtacacgtgattagggattgggggagagaagacaggattcaggacaatctccagcatggccggcctccctctcctcctcaccctcctcactcactgtgcagggtcctgggcccagtctgtgctgactcacgccaccctcagtgtccgtcggggacccccgggcaggacgggtcctccatctcgttgttcgtggggagcagccttaccggacggttaccggaaaatttaacggttttcgtaccttaacgtcgggttaacccaggaccacggtccttaccccgaacggaaaaccccggccccccaaaggtccctaccctacctaacttcgtaaacgtaagggaaacttcggaacttccgaacgggccccggtaccccgttacggaaggggtaccttaacccgtacggaaccccgttattacccgtcgtcgggtaccttacggtaacggttccgttacggcccttcccgtccggtcccctcccgtacgggccctaagtccgtacgggtcgggtcccgttcccggggtaccggaacgggtacgtgggtacggtacgttaaggtaaacttacgtttaacgtcggttcggtacgtttagggtttacgggacgttaccggtaccgtaggttccggttagggtacgggttaccgggttacccgggttacggggttacgggttccgggggaacggggtaaccggggtaccgtaacggtccggtaccggtacccgggttaccggtaccgggtaccgaacccggacccggtaaaccgggtcccgttaccccggtccccccggtttacggtaccccgttacccgttcccggtttccccggttccccccgttacccccgg

SEQ ID NO: 83043 - DNA, 686 bp, Homo sapiens
  misc_feature: GYAE6OF01BOZLH.25.23.C01.1.454.CMB.1.raw
  modified_base (211)..(211): a, c, t, g, unknown or other
  misc_feature (211)..(211): n is a, c, g, or t
  modified_base (243)..(243): a, c, t, g, unknown or other
  misc_feature (243)..(243): n is a, c, g, or t
  modified_base (407)..(407): a, c, t, g, unknown or other
  misc_feature (407)..(407): n is a, c, g, or t
tcagactgtacagtcacgaccggtgctcgattttagtacacgtgattagggagttggggcagcttcagctgtggtagagaagacaggattcaggacaatatccagcatggccgccctcctctcctcctcaccctcctcactcactgtcgcagggtcctgggcccagtctgtgctgactcagccacctcgagtcgtcgtcgggaccccgggnagacggtctcctatcgtcttgttcgtgggacncaagcctccgacggttacgtaaattagtttgtactacgtcggtaccagcaacgcctaccgaacggaaacccggcccccaagtcctcctacgactctaagtacgggaaattcggaactccgacggcccggtaccgtaggaacgggtacttacccgtgaacccgtnttccgtcgtcggactacggaactcggtcggccttccgtccggtcctcccgtacggcctacgtcgagggtcggtcccgtccggtacggaggacttgggacgtcgttaagtaacttacgttagttacggtagtacgttaggtttggggaatcgggtacctaggttcgtaggtacggtcgggtacggtacgggttcgggtacgggcggaacgggtctaacggtcgtaccggtaccgttaccggtacggtacccaccggtacccgtacggtcccgttccccgg

SEQ ID NO: 83044 - DNA, 790 bp, Homo sapiens
  misc_feature: GYAE6OF01CC8Y1.25.23.C01.1.454.CMB.1.raw
  modified_base (338)..(338): a, c, t, g, unknown or other
  misc_feature (338)..(338): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctcgggacccccgggcaggacgggtcctccactctcttgttctgggtacgcgagtcctccggacgtacggaaattaacgtttgtactacgtggtaccagccaggtcctcccgaacggaaacccggccccccaagtcctcctacactcgtaactaaggagtgnttcgacggccggtccacgtagggacttaccctggaccctacttcgtcgttcgggaccttcggaagtttccgtgtcccgtcccgcggtttcccccgttcggaccactcgtaccggtcgggtcgtacccgggtcggacggtgtacggacgtccgtagtaacgttacttaacgtgttacggttagacgttttagggtacgttacggtaccggtacggttaccggtagggttaccggtttacggggtaccccggggtacggggttaccgggtttacccgggggcggttaacccgggggtaccgaaccgggtaccgggttacccggtacccgggttacggttacccgggaccggtacccggtacccggtaaacccgggtcccgtacccgggttaccccccggtcccggttaccccgggttacccttaccccgtttccggttccccccctaacccccg

SEQ ID NO: 83045 - DNA, 746 bp, Homo sapiens
  misc_feature: GYAE6OF01E3M3R.25.23.C01.1.454.CMB.1.raw
  modified_base (206)..(206): a, c, t, g, unknown or other
  misc_feature (206)..(206): n is a, c, g, or t
  modified_base (234)..(234): a, c, t, g, unknown or other
  misc_feature (234)..(234): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggancagctccgacgtcggaaataagttgtctactggtaccagcagctccagaaccggcccccaagctcctcatctataggaatgatcacgccggccctgagggtactaccgtcgaccgtattcctcgtcggcctacgtaagttcgtcggccttcccgtccggtccccttccccgtcgggaccctagttaccgagggttcggggtcccgttccccggggttacccggaaggggtacgttacgggacgggtccgttaaggtaaactttacgttttaccgtagggttcgtaccgttaggggtttttacggggacttaccgggtcccttaaggtttccggttagggttaacgggttccgggggttaccccgggtaacgggggtttcgggtttacccgggggaccggggtaaacggggaaccccgtaaagggtcccgttcgggtaaccccggttaccgttaacgggtacccgaacccggtacccccggaacggggtcccctcccgggtacccccccccgg

SEQ ID NO: 83046 - DNA, 820 bp, Homo sapiens
  misc_feature: GYAE6OF01A7KF5.25.23.C01.1.454.CMB.1.raw
  modified_base (210)..(210): a, c, t, g, unknown or other
  misc_feature (210)..(210): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcacgggtcctcgggcccagtctgtcgctgactcacgcccaccctcaggtcgtcgtccggggacccccggngacggagggtcctccattccttcgtttggttcgtgggacgcacgtccgtccggtacggtacggtaaaattaagttttcggtaccttacgttacggtaacccaggtccgtacgtacccgttacccgaaacggaaaccccgggacccccaaacggtcccttacccgttacaaccgtttcgtaaagtaacggtaatacgaactacgacggcccgtccgtagaacgggtactaccgtacgaccgtactttcgtcgtacggactacggtaacgttccgtcggtcctcccggtcccggtcccttaccggtccgacctacgtccgggacggttccgggtaccgttccgggtaccgtagggacgtacggacggttaccgtaaggtaactttacgttaccggttggtacgtacgggtttacggtacggttaacggtcgttaccggttacggtcggttacgggttaccggggtacccggtaccgggttaccggggttacgggtacccggggacgggtaaccgggaaaccgtacggtaccggtcggttaacccgggtacggtacggaccgtaccggaccggttaccggcccgtacccggtccccgggtgtcccgtacccgg

SEQ ID NO: 83047 - DNA, 779 bp, Homo sapiens
  misc_feature: GYAE6OF01DT7VE.25.23.C01.1.454.CMB.1.raw
  modified_base (210)..(210): a, c, t, g, unknown or other
  misc_feature (210)..(210): n is a, c, g, or t
  modified_base (247)..(247): a, c, t, g, unknown or other
  misc_feature (247)..(247): n is a, c, g, or t
tcagactgtacagtcacgaccggtgctcgatttagtacacgtgattagggattggggagctgtggtagagaagacaggattcaggacaatctccagcatggccggcctcctctcctcctcaccctcctcactcactgtgcgagggtcctgggcccagtctgtcgctgactcacgcccaccctctaggtcgtcgtccggggacccccgggnaggtacgggtcctccattcttcgtttgttcgcgggancgtacgccgtaccggacggtacggtaaatttaggtttcgtactactacggtaccaggcaggtcctacccgaacgaacccggccccaagtcctcctgaacttacgaagtacggtaacttgacacgtacggccggtccctaggacggtaactaccggtacgaccgttaacttccgtacgtcggtactacggtagtccgtcgtccttaccggtcccgtcccgtacccggtgaccctacggtccgtagggtccgggtccggttcccgggacgggtacggtacggacgggtacggtacgttaaggtaactttagttacggtacgttcgtacgggtttacgggtttggaccggtcgtaaccgttcggttcgtacgggtcggttaccgggttcgggttacgggttaccggggtacggggaacgggtaccgggtaaccggtaacggtccggtacccgggttaccggtacggttaccggacccggacgggaccccgtaaccgggcccgtccccggttaccccggtcgtcccgttaccccgg

SEQ ID NO: 83048 - DNA, 814 bp, Homo sapiens
  misc_feature: GYAE6OF01BP3Y8.25.23.C01.1.454.CMB.1.raw
  modified_base (192)..(192): a, c, t, g, unknown or other
  misc_feature (192)..(192): n is a, c, g, or t
  modified_base (222)..(222): a, c, t, g, unknown or other
  misc_feature (222)..(222): n is a, c, g, or t
  modified_base (262)..(262): a, c, t, g, unknown or other
  misc_feature (262)..(262): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctcgggacccccgggnaggacgggtctccatctcttgttctgggancagctccgacgtcggaaattagtttgtctacgtggtaccngcagctccaagaaccggccccaagctcctcatctagtagaatgactcacggccggccctacgagggtactaccgtcgaccgtattcgcgtcggcctcgaagtcgtcggtcctccgtcggcccttccgacggccactcgtacgtcgggaccttcccgggtccgaggtacgttaggaacgggtcgttaaggtaaacgtttaacgtttaccgtcggtttacgggtacggtttaaacggggttttcgggacgttttacccgggaccgtttacgggtaccgtttacgggggtagggttttacccgggggttacccgggttaaccgggggtttcgggggttttaacccggggcgggggtaaaccggggtaacccgtaaacgggttacccggttacccgggttaaccccgggtttacccgggttaccggggtcccgttaaacccgggaacccccggtaaacggggttccccttacccccgggtaaccccccgtttccggggttaccccttaaccccgtttacccggtttaccccgggttccccccctttaaccccccgg

SEQ ID NO: 83049 - DNA, 755 bp, Homo sapiens
  misc_feature: GYAE6OF01EPKPT.25.23.C01.1.454.CMB.1.raw
  modified_base (214)..(214): a, c, t, g, unknown or other
  misc_feature (214)..(214): n is a, c, g, or t
  modified_base (234)..(234): a, c, t, g, unknown or other
  misc_feature (234)..(234): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtcgtcggggacccccgggcaggagggtccnccatcttcttgttctgggancagcctccgacgtacggaaattagtttgtacttactcggtaaccagcacgtcctacccgaaggaaacccggccccctaagccttaccctcagtacctaagtaacggaatgatccgacggccggtccctagacgggtactaccgacgtacccgtattccgtcgtcggactacggtaacgttcgtcggtcctcccgtaccggtccccttcccgtgaccctacgtccggtacggtccgggtacccgttcccgggtacggtacgggtagtgggaacgggtcgttaacggtaacgtttagtttaccgttggttcgtacggttagggtttcgggtatacggtccgtagttcggtagggtcggttaccggggttccggtacgggtcgggttaccggggaccggggtacgggtaacccgtaacgggtacggaccggttacccggttaccggttacggacccgtaaccgggaccccgtaacccggggtcccgtacccccggtccccccggttcggtcccgtttaccccgg

SEQ ID NO: 83050 - DNA, 681 bp, Homo sapiens
  misc_feature: GYAE6OF01EDAD0.25.23.C01.1.454.CMB.1.raw
  modified_base (209)..(209): a, c, t, g, unknown or other
  misc_feature (209)..(209): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagcccaccctcagtgtcgtcgggacccccgggnaggagggtctccatctcttgttcgtgggagcagcctccgacgtacggaaattaagtttgtctacgtggtaccagcagcctaccaagaaaccggcccccaagcctcctcactctagtaggatgatcgacgccgccctgaggtactaccgtagaccgtattctcgtcggctacgacgtcgtcggtccttccgtcccggtcccttcccgtcgggtaccctacgttccgtacggggttccggggtacccgttccccggggtaccggaacgggtagtacgggacgggtcgttaacggtaaatttacgtttacgttggttcggtaccgttaggggttttcgggacttcggaccgttaggttacgttaggtacgggttcggtaccgggtacgggttcgggtacgggcgggaacggggacctaaggcgttacggacccggttcgtacggtcacgacccgaggtcccgtcccggtcccccg

SEQ ID NO: 83051 - DNA, 614 bp, Homo sapiens
  misc_feature: GYAE6OF01A1WNQ.25.23.C01.1.454.CMB.1.raw
  modified_base (179)..(179): a, c, t, g, unknown or other
  misc_feature (179)..(179): n is a, c, g, or t
  modified_base (198)..(198): a, c, t, g, unknown or other
  misc_feature (198)..(198): n is a, c, g, or t
  modified_base (201)..(201): a, c, t, g, unknown or other
  misc_feature (201)..(201): n is a, c, g, or t
  modified_base (224)..(224): a, c, t, g, unknown or other
  misc_feature (224)..(224): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctggcccagtctgtgctgactcagccaccctnagtgtctcgggaccccggnagnggtctcatctcttgttctgggancagctccgagtacggaaattagttgtctacgtggtaccagcacgctacccaagaaccgccccaagcctcctcatctataggatgatcgacgccgcctacgacgggtatcctgaccgtattctcgtcgctacgactcgtacgtctccgtccgcctccgtgaccctatcgagtcggcgtccggtaccgaggtacgtcggacggtactaggtaacttcgttaacgtcggtagtcgtaacgggtttcggaacgtcgtaccgtacgttcgtagtaggttcggtacgtacgggtcgtcgggtacggacggtaccgtaaacggtcgtaccggtacggtacgttacggtccgaccgtaccgtaaacgccgttacccggtccccgtgttcccgtacccg

SEQ ID NO: 83052 - DNA, 747 bp, Homo sapiens
  misc_feature: GYAE6OF01E514L.25.23.C01.1.454.CMB.1.raw
  modified_base (207)..(207): a, c, t, g, unknown or other
  misc_feature (207)..(207): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcgagggtcctgggcccagtctgtgctgactcacgcccaccctcagtcgtcgtcggggacccccgggnaggacgggtcctccattcttcttgttcgtgggagcagctaccgacgttacggtaaattagtttgtactacgtcggtaaccagcacgcctacccgaaggaaaccccggccccaagccttacctacatacgtaagtaggaactgacgtcgacggccggtaccctacgaagggtacctaccgtcgaaccgtatttccgtcgtacggtacgttacgaacgtttccgtcggtacccttcccggtcccggtccccttcccgtacggccctacgtcgggtacgggtcggggtacccgttcccggggtacgagggtagtacgggacggtcttaagtaatttacgttacgtggtacgtacgttagggtttgggaactcggaccgtagttcggacgggtagggtccgggttacggttcgggttcgggttaccgggacggggtaaccgaccgtacggtccggtaccggtacccggttaccgtacgggacccgaacccggacccggtaacgggtccctacccccgggtcccccggttacgtcccgttcccgg

SEQ ID NO: 83053 - DNA, 810 bp, Homo sapiens
  misc_feature: GYAE6OF01DNK5R.25.23.C01.1.454.CMB.1.raw
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcacgcccaccctcagttgtcgtccggggacccccgggcaggacgggtcctccacttccttctttcgttcgtaggggacgcgacgtccgtaccggtaacggtacggtaaaatttacgttttcgtacttaacgtcggtaaccagaccgtacgccctacccgaaacggaaaacccggcccccaaagtccctacccgtactaattacctaagtaacggtaatacgaactcgaacggtccggtccctacggaacgggtacctacccgtagtaccgtacgtttctcggtcggtctaacgtaacggtttccgtcgggtcccttcccggtccggtccccttcccggtcggtaccctacgtcgtagggttccgggtaccccggtacccgggtaccggaacgggtacgttaacgggtacttaagttaacgttaacgtttaacggttcggtacggtaccggtttagggtttacggggacttccggtaccgtaggttcggttacgggtaacgggtttcggggtaccgggttacgggttcgggttaccgggacgggaaccgggtaccgacggtccggtaccgtaacccggttacgacggtaccaccggtacccggacggtcctacccggtccccgttcgtacccgtcgttcccg

SEQ ID NO: 83054 - DNA, 795 bp, Homo sapiens
  misc_feature: GYAE6OF01EEHGW.25.23.C01.1.454.CMB.1.raw
  modified_base (193)..(193): a, c, t, g, unknown or other
  misc_feature (193)..(193): n is a, c, g, or t
  modified_base (220)..(220): a, c, t, g, unknown or other
  misc_feature (220)..(220): n is a, c, g, or t
  modified_base (224)..(224): a, c, t, g, unknown or other
  misc_feature (224)..(224): n is a, c, g, or t
tcagactgtacagtcacgaccggtgctcgatttagtacacgtgattagggattggggagagaagacaggattcaggacaatctccagcatggccgcctcctctcctcctcaccctcctcactcactgtgcagggtcctgggcccagtctgtgctgactcacgccacctcgagtcgtccgtcggggaccccggnacggaggtcctcatcttcttgttacgnggancagctccgtaagtacgtaaaattagtttgtcgtacgtcggtaccaggctacgcctaccgaacggaaacccggccccaagtcctacctacgtactacgtaagtaaggaactcggtactaccgacggcccgtaccctagaacgggtaaccttaccgtggaaccttatttccgtacggttcggaccttaacggtaacgttccgtcgggtccttcccgtcccgtcccgttcgtccggaacctcgttcggtacgggttccgggtccgttacccggggtacggaacgggttcgtacgggtacgttacgtaaagttaacgtttaaccggtttgtacggtacggttaccggttaagggttttcggaacgttcggaacccgttaggtcgtaacggttcgggttacccgggtacccggttaaggggtccgggttaccggggacggggtaaccggaactaccggggtcgttacccggtaaccgtaccgtacgggtccgtaaccgacccggtacgggtccccgtaccccgttcccgggtactaccgttacccgtttcccgttaccccgtcccccggttaaccc

SEQ ID NO: 83055 - DNA, 840 bp, Homo sapiens
  misc_feature: GYAE6OF01ADDSZ.25.23.C01.1.454.CMB.1.raw
  modified_base (211)..(211): a, c, t, g, unknown or other
  misc_feature (211)..(211): n is a, c, g, or t
  modified_base (222)..(222): a, c, t, g, unknown or other
  misc_feature (222)..(222): n is a, c, g, or t
  modified_base (245)..(245): a, c, t, g, unknown or other
  misc_feature (245)..(245): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgactgactcagcccacctcagtcgtccgtcggggacccccggnagacgggtccnccagttcctcttgttctgggacncgagccgtccggacgtacggaaattagtttcgcttaacgtcggtacctagccacgtcctacccgaaacggtaaaccccggcccccctaaggtcccttccctacgaacttacgttaacgtaaggaaacttcggtactacgaacggccggtaaccccttaggaaccgggtacttaccccggtacggtaacccggttactttccgttccggttacgggacccgttaaccggtaacggtttccgtaccggttccccgttccccggttacccggggtccccctttccccgggtaacgggaccctacggttaccggaacggggttccggggtaccccgttacccggggtaccgggacgggtacgtacggacgggtaccttaagtacgttaactttacggtcgttaggaccggtttagggttacgggtaccttacgggtccttacggttacggtacggttacgggtccggttaccggggtacgggttcgggttaccgggcggggtaaacccggtaccgtacgggtaccgttccggtacccggtacggttaacccggcgaacccggtaacccgttccggacccgttccccggtaacccccggg

SEQ ID NO: 83056 - DNA, 708 bp, Homo sapiens
  misc_feature: GYAE6OF01CEXUJ.25.23.C01.1.454.CMB.1.raw
  modified_base (182)..(182): a, c, t, g, unknown or other
  misc_feature (182)..(182): n is a, c, g, or t
  modified_base (203)..(203): a, c, t, g, unknown or other
  misc_feature (203)..(203): n is a, c, g, or t
  modified_base (229)..(229): a, c, t, g, unknown or other
  misc_feature (229)..(229): n is a, c, g, or t
  modified_base (234)..(234): a, c, t, g, unknown or other
  misc_feature (234)..(234): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcgagggtcctgggcccagtctgtgctgactcacgccaccctnagtcgtcgccgggaccccggngacggaggtctcattctcttgttcgngggancagctcggacgtacggtaaattagtttgtactacgtacggtaccagcacgccacccgaacgaaacccggaccccaagcctacctacacgttactaagtaggaactagtactacgacgcccggtacctacggaacggtactaccgtagaccgtacttctcggtacggcttacggaacttcgtcgtccttccgcgtccctccgtcgccagttcggaggtccggaccgttccggacggacggatcggtacgagtagtaacttacgttgtagtcgagttacgggtttggaagtcgtcgtagtcgtagggtacggttcgggtacgtagggtccgggtacgggaaccgggtacgggtaacccgtaggtacccggttacccggacccggtttcccgggttacgggacccgtaacccggggtacccctaaccgggggtcccctacccccggttaccccggttacggttcccgtaacccccgg

SEQ ID NO: 83057 - DNA, 842 bp, Homo sapiens
  misc_feature: GYAE6OF01CX4BW.25.23.C01.1.454.CMB.1.raw
  modified_base (222)..(222): a, c, t, g, unknown or other
  misc_feature (222)..(222): n is a, c, g, or t
  modified_base (304)..(304): a, c, t, g, unknown or other
  misc_feature (304)..(304): n is a, c, g, or t
  modified_base (312)..(312): a, c, t, g, unknown or other
  misc_feature (312)..(312): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccacctcagtcgtcgtcggggaccccgggcaggagggtctccatctcttgttctgggancagctccggacgtacggaaattaagtttcgtctacgtggtaccagcacgcctacccgaagaaaccggcccccaaagcctccncatctaanaggaatcgatcacggccggccctaggacgggactaccgtacggaccctagttcctcgtcggtaccttacggaagtttccgtacgggtcccttcccggtcccgggttcccctccccggttacgggacccttagttacccggtaagggttcccggggtaccgttccccgggggttaacccggaacgggttaccggttagggtaacgggtacgttaacggttaaacgtttaacgtttaaccggttggtttacgacggtttaaggggttttcggggaacgttaccgggtacctacggtttacggttcgggtaacgggtttcgggggttaacccgggttacggggttcgggtttaccggggggaaccggggtaacgggaaccggtaacggtaccggttaccggtaaaccccggtttcggtaaccggggttacccgaaccgggtaacccgtaaaccggggtccccgttacccgggtacccccggttccgggttacctacccggtttcccggttcccggttccccccgtacccccgg

SEQ ID NO: 83058 - DNA, 725 bp, Homo sapiens
  misc_feature: GYAE6OF01CT7M9.25.23.C01.1.454.CMB.1.raw
  modified_base (194)..(194): a, c, t, g, unknown or other
  misc_feature (194)..(194): n is a, c, g, or t
  modified_base (223)..(223): a, c, t, g, unknown or other
  misc_feature (223)..(223): n is a, c, g, or t
  modified_base (248)..(248): a, c, t, g, unknown or other
  misc_feature (248)..(248): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctcggcccagtctgtgctgactcacgccaccctcagtcgtcgtcgggacccccggnaggacggtctccatctcttgttctgggancagctacgagtacggaaattagttnactacgtggtaccagcagcctaccgaagaaaccggcccaagcctcctcatctagtaggatgatcgacgccgccgtagacggactaccgtggacctacttcgcgttcggactacggtaacgtcgtcggcctttcccggccggtcccctccggtggtaccctaacgtcggacggttccgggtcccgttacccggggacgtaaggacgtcggggaacggtctaaggttaaacttacgtttaaccggtggtcggtaacggttaccgggttttagggaactttccgggaccttagggttccgtagggtacggttccggggtacccggtaggggttccgggtccgggaacgggtacggtaaccgaacgtcgtaccggtacccggtacggtaacgggtccaccgggaccctaacgggtcccctcccgggtacccccgttaggtacccttacccggttcccgttcccggtccccccgtaaccccg

SEQ ID NO: 83059 - DNA, 807 bp, Homo sapiens
  misc_feature: GYAE6OF01DAMHJ.25.23.C01.1.454.CMB.1.raw
  modified_base (212)..(212): a, c, t, g, unknown or other
  misc_feature (212)..(212): n is a, c, g, or t
  modified_base (248)..(248): a, c, t, g, unknown or other
  misc_feature (248)..(248): n is a, c, g, or t
tcagactgtacagtcacgaccggtgctcgatttagtacacgtgattagggattggggagctgtggtagagaagacaggattcaggacaatctccagcatggccggcctccctctcctcctccaccctcctcactcactgtgcgagggtcctcgggcccagtctgtcgctgactcacgcccaccctcgagtcgtccgtccggggacccccggnacggacgggtcctcctacttccttctttcggttcgngggacgcgacgtcctaccggtaaccggtaacgggtaaaattaacggttttcgtaccgttacgtacggtaaccacggacacgtaccctaccccgaaaccggaaaaccccggaccccccaaaggtcccctacctaccctaattaccgtaagttaaacggaactacgaacgtccgaccggacccggtcccgtaaccgaagggtaaccctaaccgtaccgggaacccttactttccggtaccggtacggtaccctaaccggttaacgtccggtccgggtcccttccccggtccgtcccctaccgtcggacctacggtcgtacgggccgggtccgtcccgggacggagtcgtaggacgtactaagtaacttagtcgtaggtcgtacggttagggtcggtacgtcgtcgtaggttcggagggtacggttccgggtccgggtacggttccggggtcgggaccggaacggtaccacgggtccgtacggtacccgggtccggttacgaccggacccggtacccggtaccggtccgttacccccggccccggttagtcccttaccccgg

SEQ ID NO: 83060 - DNA, 672 bp, Homo sapiens
  misc_feature: GYAE6OF01B4FY3.25.23.C01.1.454.CMB.1.raw
  modified_base (180)..(180): a, c, t, g, unknown or other
  misc_feature (180)..(180): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctnagtgtctcgggacccccgggcaggagggtctccatctcttgttctgggagcagctccgacgtcggaaattagtttgtctactggtaccagcagctacccagaaaccgccccaagcctcctcatctatacggatgatcagccgcctgagggtactaccgtcgacctattcctcgtcggctacgaagtctcggcctcctcggccctccgtggcccagtccgaggtcgggtaccgttcccgggtacggtacgggtagtcggaggtaccttaggaaatttacgttacgtcggtagtacggtaggttttagggacttcggccgtaggttccgtagggtacggttcgggtacccggtacggggttcggttaccggggacggggtacggggtaaccgaagggtcccgttacgggtacccggttacccggtacgggtccgaaacccgggtaccccgtaagggtcccctcccgggtccccccgttggttcccgttacccgg

SEQ ID NO: 83061 - DNA, 606 bp, Homo sapiens
  misc_feature: GYAE6OF01CCZZZ.25.23.C01.1.454.CMB.1.raw
  modified_base (183)..(183): a, c, t, g, unknown or other
  misc_feature (183)..(183): n is a, c, g, or t
  modified_base (205)..(205): a, c, t, g, unknown or other
  misc_feature (205)..(205): n is a, c, g, or t
  modified_base (229)..(229): a, c, t, g, unknown or other
  misc_feature (229)..(229): n is a, c, g, or t
  modified_base (234)..(234): a, c, t, g, unknown or other
  misc_feature (234)..(234): n is a, c, g, or t
  modified_base (302)..(302): a, c, t, g, unknown or other
  misc_feature (302)..(302): n is a, c, g, or t
  modified_base (323)..(323): a, c, t, g, unknown or other
  misc_feature (323)..(323): n is a, c, g, or t
  modified_base (335)..(335): a, c, t, g, unknown or other
  misc_feature (335)..(335): n is a, c, g, or t
  modified_base (349)..(349): a, c, t, g, unknown or other
  misc_feature (349)..(349): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcgagggtcctgggcccagtcctgtgctgactcagcccaccctnagtgtcgtcggggacccccggnaggcgggtctccatctcttgttcngggancagcctcgacgtacgaaatagtttgctactggacagcagcaccagaaccgccccaagctctcatctanagaatgatcagccggtacccngaggactaaccngaccgtattcctcnggactcgaagtctggctccgtacgccctccgtacgccagtcgtagtcgggcttaccggccgaggatgaacggctaggaattagttactgtagcgtaggtttggagtcgcgtagtcgtagtacggtcggtaccggtacggttggtaccgggacgggacgggaacccaagggtcccgtcggtaacccgtccggtaagggttacccaaggacccccggtaaacgggccgttacccggcccccgttcgggtaccttacccg

SEQ ID NO: 83062 - DNA, 759 bp, Homo sapiens
  misc_feature: GYAE6OF01BO791.25.23.C01.1.454.CMB.1.raw
  modified_base (232)..(232): a, c, t, g, unknown or other
  misc_feature (232)..(232): n is a, c, g, or t
  modified_base (244)..(244): a, c, t, g, unknown or other
  misc_feature (244)..(244): n is a, c, g, or t
tcagactgtacagtcacgaccggtgctcgatttagtacacgtgattagggattgggggggaagctcagcttcagctgtggtagagaagacaggattcaggacaatctccagcatggccggcctccctctcctcctcaccctcctcaactcactgtgcagggtcctgggcccagtctgtgctgactcagccaccctcagtcgtcgtcgggaccccggcagagggtctcatctnttgttcgtggancagctaccgtacgtacgaaatagtttgctactggtaccagtcagtcctcccgaacggaacccggccccaagtcctccctcaatactagtaaggaatgaactcgaacgtccggtaccctacggagggacttaccgtacggaccgtatttcccgtgttacgggacttacgggtaaacgttccggtcgggtaccctttcccggtcccggggtaccccttcccggtacggggtcccctaacgttacccggtacgggttccggggtacccgtttaccccgggggtaacccggtaagggtcggtacgggtaacggtacccggtaagtaaacgtttaacgtttacggtcgggttacgacggttttagggggtttaggtaactcccgggttacgtacgggttacgtacgggttaacgggtccgggttaccggtaacggggttccgggttaccggggacgggtacggtaaccgacggtcgtacgtacccggttccgtaagggtcccaacgggccctaaccgggg

SEQ ID NO: 83063 - DNA, 719 bp, Homo sapiens
  misc_feature: GYAE6OF01C44T9.25.23.C01.1.454.CMB.1.raw
  modified_base (203)..(203): a, c, t, g, unknown or other
  misc_feature (203)..(203): n is a, c, g, or t
  modified_base (235)..(235): a, c, t, g, unknown or other
  misc_feature (235)..(235): n is a, c, g, or t
  modified_base (708)..(708): a, c, t, g, unknown or other
  misc_feature (708)..(708): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagcccaccctcagtgtcgtccggggcccccggnaggacgggtcctccatctctttgtcgtgggancacgctccgacgtacggaaattagttcgtactacgtcggtaacagcacgtcctacccgaaacggaacccgcccccaagtcctacctactaacgtactaagtacggtaatacgaactcgacggcccggacctcggaacgggtacctaccgtacggaccgtaccttctacgtgtaccgtacgtaacgtccggtcgtccgtcccgtcccggtcccttcccggtacgtaccctagttccggtacgggttcccggggtccggttaccccgggtcggaacgggtagttacggaacgttcggtaagttaacgttacttacggttcgttacggtagtttacgggttggtaactcgtaccgttaggtcgtagggttacggtcgggttccggtacgggtgggtaccgggcgggaacggtaccgtcgtcgtaccggtcggttaccgtacggacgtaccgaccgtcggtcccaccggttccccgngtactccccgg

SEQ ID NO: 83064 - DNA, 660 bp, Homo sapiens
  misc_feature: GYAE6OF01D09UQ.25.23.C01.1.454.CMB.1.raw
  modified_base (242)..(242): a, c, t, g, unknown or other
  misc_feature (242)..(242): n is a, c, g, or t
  modified_base (268)..(268): a, c, t, g, unknown or other
  misc_feature (268)..(268): n is a, c, g, or t
  modified_base (283)..(283): a, c, t, g, unknown or other
  misc_feature (283)..(283): n is a, c, g, or t
  modified_base (375)..(375): a, c, t, g, unknown or other
  misc_feature (375)..(375): n is a, c, g, or t
tcagactgtacagtcacgaccggtgctcgatttagtacacgtgattagggattggggagctgtggtagagaagacaggattcaggacaatcctccagcatggccggcctccctctcctcctcaccctcctcactcactgtgcagggtcctcgggcccagtctgtgctgactcacgccaccctcagtgtccgtccgggacccccggcaggacgggtcctccattccttcgttgttcgtgggancagcctccgacgtcggaaattagttntctacgtcggtaccnggcacgcctaccgaacgaacccggcccccaagccctcctctatactaagtaggaatgactcgacggcccgcctagacggactccgcgtaccntttcctcgcggtactacgtagtccgtcggcccttccgacccggtccctcccgtcggccatcgtacggtcggcccgttaccgggacggaggtcgtggacggtctaaggtaatttacttacgtgtcgtcggttaggtttcggagtcgacgtgtccgtgggtacggttcggtccggtagggtcggtcgggacggacggtaccacggttccgtccggtcccgacggttaccggcccgacgtccccggtacgtcccgtcccggtacccccggttcgtaacccttccccgg

SEQ ID NO: 83065 - DNA, 609 bp, Homo sapiens
  misc_feature: GYAE6OF01CTZL1.25.23.C01.1.454.CMB.1.raw
  modified_base (228)..(228): a, c, t, g, unknown or other
  misc_feature (228)..(228): n is a, c, g, or t
  modified_base (337)..(337): a, c, t, g, unknown or other
  misc_feature (337)..(337): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctcgggacccccggcagagggtctccatctcttgttctgggancagctccgacgtcggaaatagtttgtctactcggtacagcagctacccaagaaccggccccaagcctcctcatctataggatgatcgagccgccctcgagggactaccngacgtacttctctcggctcgaagtcgtcggcctccgtccgtcctcccgtggccatcgaggtcggctccgggtcgaggatggacgtctagtaattagttacgtgtagtcgttaggttcgggaatcgaccgtgttccgtggtacggttcggttaccggtacgggttcgggttcgggaccgggtacgggaacctaggtccggtaccgtacccggtccggtaacggtcccgaacggaccccgtaaggtccctccggtcccccgtcggtcctacccg

SEQ ID NO: 83066 - DNA, 609 bp, Homo sapiens
  misc_feature: GYAE6OF01CZD1J.25.23.C01.1.454.CMB.1.raw
  modified_base (206)..(206): a, c, t, g, unknown or other
  misc_feature (206)..(206): n is a, c, g, or t
  modified_base (323)..(323): a, c, t, g, unknown or other
  misc_feature (323)..(323): n is a, c, g, or t
  modified_base (329)..(329): a, c, t, g, unknown or other
  misc_feature (329)..(329): n is a, c, g, or t
  modified_base (361)..(361): a, c, t, g, unknown or other
  misc_feature (361)..(361): n is a, c, g, or t
  modified_base (377)..(377): a, c, t, g, unknown or other
  misc_feature (377)..(377): n is a, c, g, or t
  modified_base (399)..(399): a, c, t, g, unknown or other
  misc_feature (399)..(399): n is a, c, g, or t
  modified_base (429)..(429): a, c, t, g, unknown or other
  misc_feature (429)..(429): n is a, c, g, or t
  modified_base (441)..(441): a, c, t, g, unknown or other
  misc_feature (441)..(441): n is a, c, g, or t
tcagactgtacagtcacgaccggtgctcgatttagtacacgtgattagggagttggggagctgtggtagagaagacaggattcaggacaatctccagcatggccggcctccctctcctcctcaccctcctcactcactgtgcgagggtcctgggcccagtctgtgctgactcacgccaccctcagtgtcgtcggggacccccgggnaggtagggtcctccatctcttggttcgtggagcagctccgacgtacggaaattagtttgctactcggtaccagcagcctacccaacgaaccggccccaagcctctcatctatagatnagtacncggcgcctgaggtaccacgtcgaactgttacncgtcgctcgaagttcncggtctacgtccgccttaccgngccagtcagtcggcgtaccggtcgagtacngacgctagaatntgtgtgacgtaggttggactcggcctacgtgtggtacggttacggtccgttacggtcggttaccggggacgtacgggacctagggtacccgttacggaacccggttcgttacggaccgtacgacccggtaacggccccttcccgggtaccccgtcggtaccttccccg

SEQ ID NO: 83067 - DNA, 645 bp, Homo sapiens
  misc_feature: GYAE6OF01C6ENQ.25.23.C01.1.454.CMB.1.raw
  modified_base (220)..(220): a, c, t, g, unknown or other
  misc_feature (220)..(220): n is a, c, g, or t
  modified_base (244)..(244): a, c, t, g, unknown or other
  misc_feature (244)..(244): n is a, c, g, or t
tcagactgtacagtcacgaccggtgctcgatttagtacacgtgattagggattggggagctgtggtagagaagacaggattcaggacaatctccagcatggccggcctcctctcctcctcactctcctcactcaggacacgagggtcctcgggcccagtctggccgtgactcagcctgcctccgtgtctgggtctcctggacagtcgatcactatttccngcacgtggactcagcatgatgttnctagttattcttgtctcgtagtacaacaacaccaggacaaacgaccccaaatactactattatgacgtccaacgtaacgccgtacctacgaggttacttacttaactcgttcttctcgtacggtcctacgtaagtcgtacggacacgcacccggtcctacccggtaatacctaattccgttacgccgggtcctaccggagtaccggaggaacgggacgtaggtacttaacgttaactttaagttcgtacgtaccttaccgtataacgttacgtacgaactaacgtaactaccaacgtaaccttcccggtacgttaccggaccgtacgggaaccgtcgggtacctccgggtccgttacggaccctaaccggaccctaaaccggaccccaaacccgtgtaccg

SEQ ID NO: 83068 - DNA, 837 bp, Homo sapiens
  misc_feature: GYAE6OF01BE15W.25.23.C01.1.454.CMB.1.raw
  modified_base (213)..(213): a, c, t, g, unknown or other
  misc_feature (213)..(213): n is a, c, g, or t
tcagactgtacagtcacgaccggtgctcgatttagtacacgtgattagggattggggagctgtggtagagaagacaggattcaggacaatctccagcatggccggcctccctctcctcctccaccctcctcactcactgtgcgaggtccgtcgggcccagtctgtgctgactcacgcccaccctcgagttcgtccgtccggggaccccccggnaggtacgggtcctaccacttccttcttttggttcggtgggacgccacgtcccgtacccggaacggtaacggtaaaagtttaagttttcgtaccttaacgttcggtaacccaggtaccacgtcccgtaacccgaaaccggaaaccccggacccccaagtccccttcctacgtactttaccgtaagtaaggaacttcgactcgacggcccgccctaggaacgggtacctaccgtacgtaacccgttacttccgtccgtacggtccgtacgtagttcccgtcggtcccgttccccgtcccggaccccttcccggtccggacccttacggtccgtacgggttcccgggtcccggttccccgggtacgggtaaggtcgtacgggacgttacgtaacgtaatttacgttcgtacggtcgtacggtttaagggttggacttcggacgttacggttcgtagggttcgggttccggtaccgggttcgggttcgggttaccggggaccgggtaacgggaccgtaacgggttccggtaacccggtacccggtacggttaccgggtccgaaccccgggtaccggtacccgggtcccgttaccccccggtcccccggtttcggtcccttacccccgg

SEQ ID NO: 83069 - DNA, 812 bp, Homo sapiens
  misc_feature: GYAE6OF01AX40J.25.23.C01.1.454.CMB.1.raw
  modified_base (210)..(210): a, c, t, g, unknown or other
  misc_feature (210)..(210): n is a, c, g, or t
  modified_base (240)..(240): a, c, t, g, unknown or other
  misc_feature (240)..(240): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagcccaccctcagtgtccgtcgggacccccgggnaggagggtctccatctcttgttcgtgggancagctcgacgtacgtaaataagttgtctactggtacagcagcctccaacgaaaccggcccccaagcctcctacactctaacgtaggaatgactacgacggccggaccctcgaacgggaccttaccgtacgaacccggtactttccgtaccggtcggtccgttacggtaacggttccgttcgggccctttcccggtcccggtaccccttccccggtcgggtaccctaacgtccggtaaccggggttcggggtccccgttaccccggggtaccgggacgggtaacgttcggggaacgggtaccttaaggtaaaactttacggtttaaccgttacggttacggtaccgtttaagggggtttcgggtaacttccggaccccgttaaggttccgttagggtacgggtttccgggttacccgggttacggggtttcgggttacccgggggaacggggtaacccgggtaacggtaaccgggtccggttacccgggttaaccccggttacccggttaacggggttacccgtaccgggaacccccggaacgggttccccgttccccgggtacccccccggg

SEQ ID NO: 83070 - DNA, 730 bp, Homo sapiens
  misc_feature: GYAE6OF01BY891.25.23.C01.1.454.CMB.1.raw
  modified_base (217)..(217): a, c, t, g, unknown or other
  misc_feature (217)..(217): n is a, c, g, or t
  modified_base (342)..(342): a, c, t, g, unknown or other
  misc_feature (342)..(342): n is a, c, g, or t
  modified_base (451)..(451): a, c, t, g, unknown or other
  misc_feature (451)..(451): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggaccccggcagagggtctccatctcttgtcgtgggancagctccgacgtcggaaaatagtttgctactggtaccagcagctacccagaaccggcccaagctccgtcatctatacggaatgactcacgccggtacctcagggtactacctagaccgtattccncgtcgggtacctacgaaggtcctagggcctcccgtccgggccttcccgtcggcctacgttcgacggttcgggaccttcccgggtcggaacggtagttcgggacggttanacgttaaacgttactttaacgtcgggttataccggttagggtttacgggtgtcccggtaacgtacggttccgttggacgggtttacgggtccgggttacgggttcggttccggggtacggggaaccggacctaaacgggtcccgtaccggtaacccgttccggttaacgggcccgttaccgggtacccgggtaaaccggtcccgtaccccgttaccccccgggtttacggtacccccttaacggttccccgtttccccggttcccccggttaccccccg

SEQ ID NO: 83071 - DNA, 599 bp, Homo sapiens
  misc_feature: GYAE6OF01EBM57.25.23.C01.1.454.CMB.1.raw
  modified_base (191)..(191): a, c, t, g, unknown or other
  misc_feature (191)..(191): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggagcagctccgacgtcggaaataagtttgtctactggtaccagcagctacccagaaccggcccccaagcctcctcatctataggaatgatcgagcggccctgaggactacctgaccgtattctctggctcgaagtcgtggcctcctcggcctcccgtggccatcgaggtcgggccgtccggtaccgaggtctaggacggtcgtagtaattacttacgtgtcgcgttaggtttgggattcgctagtcgtgaggttcggtccgtaggggttgttccgggaggacgggaccaaggcgtacgacccgttaccgtaggtccgaccggaccgtaacgggcctcccggcccccgtcggtacctaccgttcttcccggtcccccgtccccg

SEQ ID NO: 83072 - DNA, 693 bp, Homo sapiens
  misc_feature: GYAE6OF01DC6HA.25.23.C01.1.454.CMB.1.raw
  modified_base (195)..(195): a, c, t, g, unknown or other
  misc_feature (195)..(195): n is a, c, g, or t
  modified_base (206)..(206): a, c, t, g, unknown or other
  misc_feature (206)..(206): n is a, c, g, or t
  modified_base (220)..(220): a, c, t, g, unknown or other
  misc_feature (220)..(220): n is a, c, g, or t
  modified_base (246)..(246): a, c, t, g, unknown or other
  misc_feature (246)..(246): n is a, c, g, or t
  modified_base (297)..(297): a, c, t, g, unknown or other
  misc_feature (297)..(297): n is a, c, g, or t
  modified_base (357)..(357): a, c, t, g, unknown or other
  misc_feature (357)..(357): n is a, c, g, or t
  modified_base (396)..(396): a, c, t, g, unknown or other
  misc_feature (396)..(396): n is a, c, g, or t
  modified_base (417)..(417): a, c, t, g, unknown or other
  misc_feature (417)..(417): n is a, c, g, or t
  modified_base (657)..(657): a, c, t, g, unknown or other
  misc_feature (657)..(657): n is a, c, g, or t
tcagactgtacagtcacgaccggtgctcgatttagtacacgtgattagggattggggagagaagacaggattcaggacaatctccagcatggccggcctccctctcctcctccaccctcctcactcactgtgcagggtcctcgggcccaggtctgtgctgacctcacgccacctcagtgtcgccgggaccccggnaggcggtcacntctcttgtctggancacgcgtcgagtacgaagttagttcnctacgtggtaccagctagcctccgaaaggaacccggcccagtcctcctacnctactagaaggaatcgctacgacggccgccctaggaacgtacctaccgcggacctgttcnccgtcgtcgacgtagtccgtgcccgtcccgtcgtccccncggtacgcctaacgttccggnggtcccgggtcgttacccggggtaacgacgggttggacggacggtacgtaagttaacgtttacgtgttcgtaacggtggttaaggtttcggggattcggaccgtagtcggtacggtcggtccgggtccgggtagggtcgggtaccgggtcgggaaccgggtacacggttccggtaccggtaacccgtacggtaccggtacaaacccgggtccgaccggttacccggccctcccccggttntacccgtacccgtccgttacccccgttcctaccccg

SEQ ID NO: 83073 - DNA, 616 bp, Homo sapiens
  misc_feature: GYAE6OF01EGM80.25.23.C01.1.454.CMB.1.raw
  modified_base (180)..(180): a, c, t, g, unknown or other
  misc_feature (180)..(180): n is a, c, g, or t
  modified_base (200)..(200): a, c, t, g, unknown or other
  misc_feature (200)..(200): n is a, c, g, or t
  modified_base (228)..(228): a, c, t, g, unknown or other
  misc_feature (228)..(228): n is a, c, g, or t
  modified_base (264)..(264): a, c, t, g, unknown or other
  misc_feature (264)..(264): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctnagtgtctcgggacccccggnagagggtctccatctcttgttctgggancagctccgacgtcggaaatagttgtctactgtaccngcagctaccagaacgccccaagctcctcatctataggatgatcagccgccctgaggactcctgaccgtattctcgtggctcgaacgtctcggccttccgtccggcccttcccgtcggaccctacgtcgacggtcgggtcccgtcccgggtaccggagggtactcgggaggtcttaaggtaactttacgttaccgtggtcgtacgtttaggtttgggattcggccgttagtcgttagggtacggttcgggttacccgagggttcggttccgggacgggtacgggaccacggtcgtacgtacccggtcgtcggcaccgacccgaggtcctacccgcccccgttggtcctacccg

SEQ ID NO: 83074 - DNA, 698 bp, Homo sapiens
  misc_feature: GYAE6OF01AYGZE.25.23.C01.1.454.CMB.1.raw
  modified_base (193)..(193): a, c, t, g, unknown or other
  misc_feature (193)..(193): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtcgtcgggacccccgggnaggagggtcctccatctcttgttcgtgggagcagctccgacgtacggaaattagtttcgtctacgtggtaccagcacggcctacccgaaggaaaccggcccccaagcctcctcatctagtaaggaatgactcgacgccggcctcgaggtactaccgtgaaccgtacttcgtcgtcggcctacgtagtcgtcggtcctcctcggccctccgtcgccagtcgacggtcggtccgtccggcggaggatgggacgctagaacttagtacgtgtcgcgttaggtggactcgaccgttagtcgtggtacggttccgggtaccggtacgggttgggttaccgggaccggggaaccgggtaccgaacggtcccgttagggtaccccggttaccgtaagggttccccgaaaccggtaccccgggtaaacgggtcccccgttcccggtacccccccggttacggtacccctaacccggtttccccggttccccgtttaaccccccgtaacccccg

SEQ ID NO: 83075 - DNA, 715 bp, Homo sapiens
  misc_feature: GYAE6OF01C8TVH.25.23.C01.1.454.CMB.1.raw
  modified_base (194)..(194): a, c, t, g, unknown or other
  misc_feature (194)..(194): n is a, c, g, or t
tcagactgtacagtcacgaccggtgctcgatttagtacacgtgattagggattgggggagagaagacaggattcaggacaatctccagcatggccggcctccctctcctcctcaccctcctcactcactgtgcagggtcctgggcccagtctgtgctgactcagccaccctcagtgtcgtcgggacccccgggnaggagggtcctccatctcttgttcgtgggagcagcctccgacgtacggaaatagtttgtctacgtggtaccagcacgcctacccgaagaaacccgcccccaagcctcctacatctagtaggaatgatcgagccgccctcgaggactacctgaccgtattcctgtcggctcgtaacgtcgtcggcctccgtccggccctcccgtcggccctagtcgtacggtcggggcccgttccgggtaccggtacgggagttacgggacggtacgttagtaaactttaacgttacgtcggtagtcgttaacgggttttagggacttcggtacccgtaggttccgtagggtaacgggttggggttacccgggttaggggttcgggttccggggaacggggacgggtaccgaaggtccgtaccggtacccggttaccgtaccgggtacgacccggacccggtacgggcccgttaccccggtcccccgttccggtaccttcccgtttcccgtccccgttcccccgtacccccg

SEQ ID NO: 83076 - DNA, 674 bp, Homo sapiens
  misc_feature: GYAE6OF01CEZAY.25.23.C01.1.454.CMB.1.raw
  modified_base (191)..(191): a, c, t, g, unknown or other
  misc_feature (191)..(191): n is a, c, g, or t
  modified_base (218)..(218): a, c, t, g, unknown or other
  misc_feature (218)..(218): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctcgggacccccggnagaggtctccatctcttgttctgggancagctccgacgtacggaaaattagtttgctacgtggtaccagcagctcccaagaaaccggcccccaagcctcctcatctataggaatgatcagccggccctgagggactaccgtcgaccgtattcctcgtcggtcctacgaacgttcgtcggtcctccgtccgccctccgtcggcctagtcgaggtcgggtccctccgggtccgtaggacgtcggaggtccgttaagtaacgttagttacgtggtcgtacgttaggtttgggactcgaccgtaggttccgtagggtacggttacgggtcccgggtagggttcggttccggggacgggtaacgggaccgtaacgccggttacggtacccgttcggtacgggtacccgacggtacccggacggtcccgttcccgccccccggttacggtaccctacccggttcccgttcccggtcccccgttcccccg

SEQ ID NO: 83077 - DNA, 865 bp, Homo sapiens
  misc_feature: GYAE6OF01BB5E1.25.23.C01.1.454.CMB.1.raw
  modified_base (225)..(225): a, c, t, g, unknown or other
  misc_feature (225)..(225): n is a, c, g, or t
tcagactgtacagtcacgaccggtgctcgattttagtacacgtgattagggaggttggggagcgtggtggtagagaagacagggattcaggacaatctccaggcatggccggcctccctctccctcctcaccctcctcactcacgtgtgcgaggtcctggccctagtctgtgctgacctcgacgtccctacccgtcacgttcggtccgtcggggaccccccgggnacggacggtctccacgttctcttcgttcgtaggacgcacggtcctccggacggtacggtaaaattaagtttcgtacttacgtaggtaaccgagccaacgtaccctaacccgaaaggaaaccccggacccccaaacgtccttaccctaacagtttaaccttaaggtaaggaactttcgaacttccgaacgggtcccgtaccccgtagggtaacggtaccttaccgtacggtaccttacgttccgtcgttacgggtaccgtaacggtacgttccggtacggtaccccgttcccggttcccgttacccgttacccggttacgacccttagggttccgtaccgggtccgggtaccccggttaccgggtaccggtaagggtacgtacggggtacgttacgtaacgttaacttttacgtacggttggtacggtacggttttaacgggtttggaacctttcggaccccgttaaggtccggttacgggtacgggtacgggttacccggtcgggttacgggttaccggggggaaccgggacgtaaccggtaacgtccggtttcccgggtaccgttaccggcgggttaacccgacggtaaccccggtacggtcccgttaccccggtcccggttaaccggttcctaccccg

SEQ ID NO: 83078 - DNA, 729 bp, Homo sapiens
  misc_feature: GYAE6OF01D4YLZ.25.23.C01.1.454.CMB.1.raw
  modified_base (161)..(161): a, c, t, g, unknown or other
  misc_feature (161)..(161): n is a, c, g, or t
  modified_base (171)..(171): a, c, t, g, unknown or other
  misc_feature (171)..(171): n is a, c, g, or t
  modified_base (194)..(194): a, c, t, g, unknown or other
  misc_feature (194)..(194): n is a, c, g, or t
  modified_base (554)..(554): a, c, t, g, unknown or other
  misc_feature (554)..(554): n is a, c, g, or t
  modified_base (706)..(706): a, c, t, g, unknown or other
  misc_feature (706)..(706): n is a, c, g, or t
tcagactgtacagtcacgaccggtgctcgatttagtacacgtgattagggagttggggagagaagacaggattcaggacaatctccagcatggccggcctcctctcctcctcaccctcctcactcactgtgcagggtcctgggcccagtctgtgctgactnagccaccctnagtgtcgtacgggacccccgggnaggacgggtcctccacttcctctttcggttcctaggggagccagccttcccgaccgtcgggaaaacttaggtttggtccttaaccgtgggtaaccccagcctaacggtccttaccccgaaaggtaaaacccccgggccccccaaaacggtcccttcccggtaacctaacgttaccccttaaaggtttaagggaacgttacgtaaactttccgaacggccgggtcccccttaggaacgggtacttaacgtcggaaccgtactttcgtactgggcctacgtaagtctgggcctccgtacgggtccctccggtaaggcccaagttccgaggtcggtccttccgggtccgaggacttgggacgngtcgaataacttgtcgtgctagtttcggatgacgtagtcgtggcggtacggtcggtacgggttcgttcgggacgggtacggaccgagacgttcggacccgtacggtacggtccgtacgaccccgaaggtcctaccggcccccgttaggaccnccttcgtccgttcccctaccccg

SEQ ID NO: 83079 - DNA, 857 bp, Homo sapiens
  misc_feature: GYAE6OF01EZZVW.25.23.C01.1.454.CMB.1.raw
  modified_base (191)..(191): a, c, t, g, unknown or other
  misc_feature (191)..(191): n is a, c, g, or t
  modified_base (220)..(220): a, c, t, g, unknown or other
  misc_feature (220)..(220): n is a, c, g, or t
tcagactgtacagtcacgaccggtgctcgatttagtacacgtgattagggattgggggagagaagacaggattcaggacaatctccagcatggccggcctccctctcctcctcaccctcctcactcactgtgcaggtcctgggcccagtctgtgctgactcagccacctcagtgtcgtcgggacccccggnaggaggtcctccatctcttgttctgggancagctccgacgtacggaaaattagtttgtctacgtcggtaccagcaacgcctacccgaaggaaacccggcccccaaagtcctacctactactacctaagtaaggaattggaactcgacggccggtccctagacgggtactaccgtaggtaccctattccacgtcggactacgtaagtcgtcggtcctcccgtcggacccctccgtaggaccctacgttacggtacgggttccggggtacccgttacccggggttaacccggtaacgggacgtttaccggggaacgggttaacccggtaaggttaaaacgtttaacgtttaacggttcgggttaacggttacccgggttaaggggtttttacgggaaacgtttcccggggtaaacccttacggggttacccgtacggggttaaacgggtttcccgggttacccggggttaacgggggttttaccgggttaccgggggtaaacccggggtaacgggtaacccggtaaacgggttcccgtacggttaacccccgggtacggtttaaccgggaccgtaaccggacccggtaaacgggtcccgtaccccgggtcccccggttacggttacctaaccctttcccggttaaccccgttccccccggttaacccc

SEQ ID NO: 83080 - DNA, 698 bp, Homo sapiens
  misc_feature: GYAE6OF01EGGB4.25.23.C01.1.454.CMB.1.raw
  modified_base (208)..(208): a, c, t, g, unknown or other
  misc_feature (208)..(208): n is a, c, g, or t
  modified_base (235)..(235): a, c, t, g, unknown or other
  misc_feature (235)..(235): n is a, c, g, or t
  modified_base (311)..(311): a, c, t, g, unknown or other
  misc_feature (311)..(311): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtctcggggacccccgggnagaggtctccatctcttgttctgggancagctccgacgtcggaaattaagttgtctacgtcggtaccagcacgcctaccaagaaacccgcccccaagcctccncatctagagatgatcgacgccgccctagagggtactaccgtgaccgtacttcgtcgtcggctacggtaagtcgtcggtccttcccgtaccgggtcccttcccggtcgcctacgtccgaaggttcgggtccgttcccggtcggaacggtgtggacgggtctaaggtaacttagttacgtgttaggacgttaggggtttacggacgttcgacctacgggttcgttaggtacgggttccggggtcccggtacggggttcgggtttccggggaaccggggtaacggggtaacccgtaacggggtaccgttccgggtaacccggtttaccccggtaacgggtacccgaacccgggtaccccgtaaacgggttcccgtaccccggtcccccgg

SEQ ID NO: 83081 - DNA, 725 bp, Homo sapiens
  misc_feature: GYAE6OF01BBVL7.25.23.C01.1.454.CMB.1.raw
  modified_base (173)..(173): a, c, t, g, unknown or other
  misc_feature (173)..(173): n is a, c, g, or t
  modified_base (231)..(231): a, c, t, g, unknown or other
  misc_feature (231)..(231): n is a, c, g, or t
  modified_base (429)..(429): a, c, t, g, unknown or other
  misc_feature (429)..(429): n is a, c, g, or t
  modified_base (548)..(548): a, c, t, g, unknown or other
  misc_feature (548)..(548): n is a, c, g, or t
  modified_base (665)..(665): a, c, t, g, unknown or other
  misc_feature (665)..(665): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtccgtgggcccagtctgtgctgactcacgccacctcngtgtcgtcgggaccccgtgggcaggcggtctccagttcttcgttgttcgtggggaacncgacggtccgtaccggtacggttaaccgggtaaaatttaaggttttcgttaccgttaacgttcggtaaccagccgaagtccctacccgaaacggaaacccggaccccaacgtcctacccgttacactacctaagtaacggaagttcgagtccgaacggtccggtaccctcggaacgggtacctaccgtacgtaaccgngtttccgtcgtcggcgtacgtaacgtcgtcgccgttcccgtccggtccctccggtcgacgtcgtcggtacgggtcggtcccggtcggtaccggtaggacgttcggacgtcgttaaagtnttaacgttcgtagtgttacggtcgggttaggcgttaccgacggtgttacgggtcggtcgggttacggtccggtagggttcgggacgggacggaccgtacggagcgtacggtaccggngtacgtacgaccggtccgacgtcgcccgtcccgtacggtctcggtccgcccgttaccccg

SEQ ID NO: 83082 - DNA, 645 bp, Homo sapiens
  misc_feature: GYAE6OF01BFDBQ.25.23.C01.1.454.CMB.1.raw
  modified_base (213)..(213): a, c, t, g, unknown or other
  misc_feature (213)..(213): n is a, c, g, or t
  modified_base (250)..(250): a, c, t, g, unknown or other
  misc_feature (250)..(250): n is a, c, g, or t
  modified_base (322)..(322): a, c, t, g, unknown or other
  misc_feature (322)..(322): n is a, c, g, or t
  modified_base (425)..(425): a, c, t, g, unknown or other
  misc_feature (425)..(425): n is a, c, g, or t
  modified_base (463)..(463): a, c, t, g, unknown or other
  misc_feature (463)..(463): n is a, c, g, or t
tcagactgtacagtcacgaccggtgctcgatttagtacacgtgattagggattggggagcttcagctgtggtagagaagacaggattcaggacaatctccagcatggccggcctccctctcctcctccaccctcctcactcactgtgcagggtcctgggcccagtctgtgctgactcacgccaccctcagttcgtcgtcggggacccccgggnaggagggtcctaccgacttcttcttgttcgtgggacncagctccgagtacggaaattagtttcgtctactggaccagcagcctaccacggaaaccgccccaacgctccnactctaacgtaggaatgaatccgagccggaccctggaaggacctaccgtgaccgtacttcgtcgttcggactgtaacgtcgtcgtcctccgtccgcctaccgngtccatcgtggtcggcgtccggcgaggcgtgacgatanaattagttacgtgtagacgttaggttggatccggtactagtccgtaggtacggttccgggtaacggttcgggttcggtaccgggaggggtaccggaacccagggtccgtcccggttacccgtaccggtacggtaccccgaacccggaccggtaccgggtccccgttcccgggtaccccccgg

SEQ ID NO: 83083 - DNA, 887 bp, Homo sapiens
  misc_feature: GYAE6OF01BA5VI.25.23.C01.1.454.CMB.1.raw
tcagactgtacagtcacgaccggtgctcgatttagtacacgtgattagggattggggagctgtggtagagaagacaggattcaggacaatctccagcatggcccggcccctcctcctcctcctaccaccctcctactactactcgtgtcgcggtaccggttccggccggaccgtcgttcgtggtcgcgtacgtacctaccgaccacccctacctcgtggtccgtccggacccgggaccccggagaacgggtcgtcctactcttcgttcgtttgtcggaggacgacgtcgaccgtaccggtacgtaaacgttaaagttacgttcgtacctaacggtaccggaccacggtaccaccgtaccccgtaaacccggaaaccgggtaaccccccgtaaccgttaccgttacctactaaccgtttaacggaaacggtaagtacgtacgtaaccgtccggaaccggccccgtaacgtaacgggaaacggttaacccttacccggaaggttacccgttcgtttcccgtacgggtaccgtaaccggttaaacgtccgtttaccgggccccgttccgttacccccgtaccggggtccccccttaccgggacgtaaccgtcggttacgggtaccgggtcccggtccgggtaacccgggtaacggtacgacgggttacccggaggttaacggtaaccgtttaagttaccgttacggttacggtacgtacggtttaggtacggtcgtacgtacggtgtacgtggtacggggttaccgtacgggtggttaccgggagggacgggtaacgtacggtacgtccgtacccgtacggttcgacggtacccgaccggtaacggccgtaccccggtcccgtaccggtaccgtaccgttccgtaccccg

SEQ ID NO: 83084 - DNA, 846 bp, Homo sapiens
  misc_feature: GYAE6OF01CL9HU.25.23.C01.1.454.CMB.1.raw
tcagactgtacagtcacgaccggtgctcgatttagtacacgtgattagggattggggagcttcagctgtggtagagaagacaggattcaggacaatctccagcatggccgcctccctctcctcctcaccctcctcactcactgtgcagggtcctgggcccagtctgtgctgactcacgccaccctcagtcgtacgtcggggacccccgggcaggacgggtctccgacttcttcgttgttcgtgggagcagcctaccggacgttacggaaattaagtttcgtactactggtaccagcagcctaccgaacgaacccggcccccaaggtccctcctactacgtactaagtaacggaatcggactacgacggccggtccctacgaagggtacctaccgtacgaccgtactttcctcgttcggacctcggaacgtcgtcggaccttcccgtccggtcccttacccgtcggtcctaacgttccggtacgggttccggggaccccgttaccccggggtccgggtaacgggtacggttacgggtaccgggtaacgtttaacggttaaacgttttaaacggttttccgtaacggggtttcggttaccggttaaagggggtttttcggaacgtttaccggggtaccccgttaagggtttcccgggttaacgggttacggggttcccggggtttaaccggtaacgggggtttcccgggttacggggggaacccgggggtaaacgggtaacccggtacgggttacccgtaccggggttaaccccggtttacccgtacgggtacccgttacccggaacccggtaaacccgggttccgtaccccccggttaccccccggg

SEQ ID NO: 83085 - DNA, 664 bp, Homo sapiens
  misc_feature: GYAE6OF01DNSIF.25.23.C01.1.454.CMB.1.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
  modified_base (401)..(401): a, c, t, g, unknown or other
  misc_feature (401)..(401): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcgagggtcctcgggccctagtctgtgctagactcacgcccaccctnaggtgtccgaccggggacccccggngaaggcgggtcacctattccgttctttggtccgtaggggacgctacgccgtaccggtaacgtagtaaaatttagttgttacctacgtacggtaccagcacgtccaccgaacgaaccgcccaagtcctcactactactaagtagaagtgactcgacggtcccgacctaggacggtaccttaccgngtaaccgtcttcggctacgggtccaacggtacgtccgtcggaccctcccgtccggtcccctacggtccgccttaacgtccgaggtcccgggccgtccggtacgagcgtacggagtcgtaagttaatacgttacgtcgtaggtcggtttgggtacgcttacggccgttagtaccggtgtacgggtcggtacggtgggtcgtacgggacgtaggccgagtccgtacgtccggtacgtacgcgacgaccgcgccgcccgtccccgg

SEQ ID NO: 83086 - DNA, 658 bp, Homo sapiens
  misc_feature: GYAE6OF01ETRBH.25.23.C01.1.454.CMB.1.raw
  modified_base (182)..(182): a, c, t, g, unknown or other
  misc_feature (182)..(182): n is a, c, g, or t
  modified_base (203)..(203): a, c, t, g, unknown or other
  misc_feature (203)..(203): n is a, c, g, or t
  modified_base (234)..(234): a, c, t, g, unknown or other
  misc_feature (234)..(234): n is a, c, g, or t
  modified_base (407)..(407): a, c, t, g, unknown or other
  misc_feature (407)..(407): n is a, c, g, or t
tcagactgtacagtcacgaccggtgctcgatttagtacacgtgattagggattgggggagctgtggtagagaagacaggattcaggacaatctccagcatggccggcctccctctcctcctcaccctcctcactcactgtgcagggtcctgggcccagtctgtgctgactcagcccaccctnagtgtcgtcgggacccccggnaggagggtcctccattctcttgttctgggancagcctccgacgtacggaaattagtttgtactactggtaccagtcacgcctcccaaggaaacccggccccaagcctccgtacactactaagtaggaatgactcacggccgtacctagaggtactaccgtgacctatcgtctcgctacgagtcgcgcctccgtccgtcctccgngacctagtcgagggtccggtacgtccgggtaccgaagggtctacgggacggtacttaaggaaatttacgttacgtggtacgtcggttaggttaggactacgtaccgtagttcgtaggtacggttcgggtaccggtagggttcgggtccggacgggtaacgtaaccggtagtaccgtaccggtacccgtacggtcggtaaccacggacccggtaacggttcccgacccggtcccccgttgtaccctacccgg

SEQ ID NO: 83087 - DNA, 726 bp, Homo sapiens
  misc_feature: GYAE6OF01C8SII.25.23.C01.1.454.CMB.1.raw
  modified_base (209)..(209): a, c, t, g, unknown or other
  misc_feature (209)..(209): n is a, c, g, or t
  modified_base (247)..(247): a, c, t, g, unknown or other
  misc_feature (247)..(247): n is a, c, g, or t
tcagactgtacagtcacgaccggtgctcgatttagtacacgtgattagggattggggagcttcagctgtggtagagaagacaggattcaggacaatctccagcatggccggcctccctctcctcctccaccctcctcactcactgtgcagggtcctggcccagtctgtgctgactcagccaccctcagtgtccgcggggacccccgggnaggacgggtcctccacttctccgtttgttcgtgggacncacgccgtaccggaacgttacggtaaaattaacggtttcgtaccttaacgtccggtaaccaggaccaggtccctacccgaaacggaaaccggcccccaaagtcctccttacgaattcctaagtaggtaatcgatcgacgcgtacccagaggtacaccgttgccgtagtctcgtcggctagacgtcgtcggctccgtcggaccctcgtcgctatcgtacgtcggccgtaccggtaccgaggtgtcgacggtctagggtaaacttacgttacgtcggtacggttaccgttagggttttcggaagttccggtaaccgtacggtttacccggtaggtaacgggttcccggggtaacccggtaaccgggtttcgggtacccggggacggggtaaacgggaccggtaacggccggttaccgggttacccggtaccgttaacggtcccgtaacgacccgggtacgccccgtcccgggttacccccg

SEQ ID NO: 83088 - DNA, 696 bp, Homo sapiens
  misc_feature: GYAE6OF01A1WHH.25.23.C01.1.454.CMB.1.raw
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
  modified_base (686)..(686): a, c, t, g, unknown or other
  misc_feature (686)..(686): n is a, c, g, or t
tcagactgtacagtcacgaccggtgctcgatttagtacacgtgattagggattggggagcttcagctgtggtagagaagacaggattcaggacaatctccagcatggcccgcctccctctcctcctccaccctcctcactcactgtgcagggtcctgggccccagtctgtgctgactcacgcccaccctnagtcgtccgtcggggacccccggngagagggtcctccattctcttgtcgtgggagcagcctaccggacgtacggtaaaatagtttcgtacctacgttcggaaccagtccgacgcctaccccgaaaccggaaaaccccggaccccccgaaagtccctaccctctaacgttacctagtaaggaactggaactcgacgtccggccctacggaaggtcctaccgtagtacccgtattccgtctcggtccgtacgaagttccgtcggcccttccggtccggtcccctaccgtcgtacccgtaattccggacgggtccgggtccccgtacccgggtacggaaggtacggtggacccggtattacggtaaaactttcgttaggtcggtacgtacggtttaaggtttcgggaatcggtaccctggttaccgtggtagtaccggtcgacgggttgtacggcggacgacgtagcgtacgcgtacggacgtccacggaccgcgtccncccggtcccg

SEQ ID NO: 83089 - DNA, 789 bp, Homo sapiens
  misc_feature: GYAE6OF01BL8S0.25.23.C01.1.454.CMB.1.raw
  modified_base (195)..(195): a, c, t, g, unknown or other
  misc_feature (195)..(195): n is a, c, g, or t
  modified_base (227)..(227): a, c, t, g, unknown or other
  misc_feature (227)..(227): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtccgtcggggacccccgggnaggacgggtctccatcctcttgttcgtgggancagctccggacggtacggtaaaattaggtttgactacgtggtaccagcgacgcctcccgaaggaaaccggcccccaagtctcctacgactctaagtacggaatcgatcgacgccgcccgtacgacgggtactaccgtcgaccgtacttcctgtacggtacctacggtaacgttcgtcgggtccttacccggtccgggtaccccttccccggtacgggtacccctaaccttacggtaacggggttcccggggacccggtttcccggggtaacccgggtacgggtacggttagggtaccgggtacgttacggtaaaacgtttaccggtttactacgggttcggtaccgtttaggggtttacgggtacgttaggtacgtaacggttcgttacgggtacggttcgggttaccggtcgggtttacgggttcgggacggggtacgggaaccgtacggcgtacggtacccggtaccgtacgggttaccgtacggacccggtaacggtcccgttacccggtacccccgttcggtaccttcccgtcccgtttcccggtcccccgtccccgg

SEQ ID NO: 83090 - DNA, 797 bp, Homo sapiens
  misc_feature: GYAE6OF01EKZ0E.25.23.C01.1.454.CMB.1.raw
  modified_base (206)..(206): a, c, t, g, unknown or other
  misc_feature (206)..(206): n is a, c, g, or t
  modified_base (242)..(242): a, c, t, g, unknown or other
  misc_feature (242)..(242): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcacgcccaccctcagtcgtcgtcggggacccccgggnacggacggtcctccattcttcttggttcgtgggacncagcctccggacggtacggtaaattagttcgtactacgtggtaccagctacgcctaccgaacggaaacccggacccccaaggtcctccctacacgtactaagtaggacttcggaactcgacgggccgtacccctaggaagggtacctaccgtacgtaacccgtctttccgtcgttcggaccgttacgtaacgttccggtcggtcccttcccggtccccggtcccttccggtccgactacgtccggtagggtccggtacccggttaccgggtccggaggtacgtaggtacggcttagtaacttcgtttcggtaggtcgtacggtttaggttacggaccgttacggccgttagggttacgtagggttaaccggggttcgggttacccgggtaggggtttaccggggtaccgggggtaacggggtaccgggaacccggtaacgggtcccgggttaccgggttaaccccggttccggggttaacggtacccgtacgggtaccccggaaccgggttccctttccccgggtaccccgttccgggtaacccttaccccccgg

SEQ ID NO: 83091 - DNA, 811 bp, Homo sapiens
  misc_feature: GYAE6OF01CRF5Z.25.23.C01.1.454.CMB.1.raw
  modified_base (207)..(207): a, c, t, g, unknown or other
  misc_feature (207)..(207): n is a, c, g, or t
  modified_base (244)..(244): a, c, t, g, unknown or other
  misc_feature (244)..(244): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcacgccaccctcagttcgtccgtcggggaccccccggnaggtacgggtcctccattcttctttgttcgtgggacncagcctccggacgtacggtaaattagtttgtactacgtcggtaaccagcacgcctacccgaagaaacccggacccccaagtcctaccgtactataccgttaagtaacggaaattcggaattccgaacggcccgggtaacccccttaggaacgggtacttaacccgtacggtaaccgtatttccgtacgtgggtacccttacggaacgtttcgttcggtccctttcccggtcccgggtacccttccccggtcggtaccccgtaagttccggtaacgggttcccggggtcccgttaccccggggttaccggaagggtacttcggggaacggtaccgttaagttaacttacgtttaccggtggtacggtaggtttacgggtttaggggacctttacgggacccgttaggttaccggtagggtacgggtttccgggtaccggttacgggggttcggttaccggggcgggaacggtacccgaggttaccggtccggtaccggttaccggtacgggtcccaacggtaccccggtaacggtccccgttacccgcccccggttgcccttacccgg

SEQ ID NO: 83092 - DNA, 679 bp, Homo sapiens
  misc_feature: GYAE6OF01CJ1YQ.25.23.C01.1.454.CMB.1.raw
  modified_base (224)..(224): a, c, t, g, unknown or other
  misc_feature (224)..(224): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtcgtcgggacccccggcaggagggtcctccatcttcttgttcgtgggancagcctaccggacggtacggtaaaattaagtttgtctacgtggtaccagcacgctacccgaagaaacccggccccaagcctcctcagtctaagtaggaatcgactcgacggcccggtccctacggacgggtactacccgtaggacccgtattccgtcgtcgtacctacggaagttccgtcggtccttcccgtccggtccctcccgttacggcctagtcgtacgggtcgggtcccgtcccgggtacggaggtacgtggacggtctaagtaacttagttacgtgttcgtaggtaggtttggaactcgctagttcgtaggtcggttcgggccggttagggttcgggtcgggacgggtaacggacctaaggccgtaccggtaccgttacgtacggtacaccggtacccgaggttcccgaccggtccccgtcgtacctcgtccgttcccgtcccctcccg

SEQ ID NO: 83093 - DNA, 766 bp, Homo sapiens
  misc_feature: GYAE6OF01BTF9W.25.23.C01.1.454.CMB.1.raw
  modified_base (173)..(173): a, c, t, g, unknown or other
  misc_feature (173)..(173): n is a, c, g, or t
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctcgactcacgcccacctnagtgtcgtccgggaccccggagnggtcctccattctcgttgtctggancagccgtaccgtaagttaccggtaaaattagtttcgtccttaacgtcggtaaccacgctacgcccttacccgaaacggtaacccgacccccgaaggtccttacctactacgttactacgaaggtactacgaatcgaacgtcccggtaccctaggtaacggtaccttcccgacggtaacccgtcttttccgcgttcgtaccgtacgtaacgttcaccggtcccgtacctccggtccctcccgtgaccgtacgttacggcggtaccgggtcccgtaccgggacgtaccggtgtacgggcggttactagtaaacgtttacgtccggttagttaccgtagtttagggttaacggcttacggtccgtaaggttccgtaggtacgggttccccggtacgggttacggggttcggtaccggggtaacgggtacggtaaccgtaacggtcccggtaacggttccggccggtttacggcggtacccgtacggtccggcccggttacccctcccgggttacgaccttcccggtacgtttccccgtccccctccgg

SEQ ID NO: 83094 - DNA, 606 bp, Homo sapiens
  misc_feature: GYAE6OF01D4YL1.25.23.C01.1.454.CMB.1.raw
  modified_base (190)..(190): a, c, t, g, unknown or other
  misc_feature (190)..(190): n is a, c, g, or t
  modified_base (216)..(216): a, c, t, g, unknown or other
  misc_feature (216)..(216): n is a, c, g, or t
  modified_base (284)..(284): a, c, t, g, unknown or other
  misc_feature (284)..(284): n is a, c, g, or t
  modified_base (301)..(301): a, c, t, g, unknown or other
  misc_feature (301)..(301): n is a, c, g, or t
  modified_base (310)..(310): a, c, t, g, unknown or other
  misc_feature (310)..(310): n is a, c, g, or t
  modified_base (332)..(332): a, c, t, g, unknown or other
  misc_feature (332)..(332): n is a, c, g, or t
tcagactgtacagtcacgaccggtgctcgatttagtacacgtgattagggattggggagagaagacaggattcaggacaatctccagcatgccggcctccctctcctcctcaccctcctcactcactgtgcagggtcctgggcccagtctgtgctgactcagccaccctcagtgtctcgggaccccgggnagaggtctccatctcttgttctggancagctccgacgtcggaaattaagtttgtctactggtacagcagctccaagaaccgccccaagcctccncatctagtagatgatcngcggcctgngggactacctgaccgtattctntcggctcgaagtctgcctccgtcgccctcctcggccatcgagtcgggtcctccgggtcgaggtagtgacggtctagtaattatttactgtcgcgttaggtttggagtcgtaccgtagtcgtggtacggtcgggtaccggtacggggttcggtttcgggacgggtacggaccgaacgccgtcggtacccgtccgtaggtccgacggacccgaagggtcccgtcgtcccccccgttcggtaccctacccgttccttcccgttccccgtaccccccg

SEQ ID NO: 83095 - DNA, 884 bp, Homo sapiens
  misc_feature: GYAE6OF01A91SE.25.23.C01.1.454.CMB.1.raw
  modified_base (182)..(182): a, c, t, g, unknown or other
  misc_feature (182)..(182): n is a, c, g, or t
  modified_base (204)..(204): a, c, t, g, unknown or other
  misc_feature (204)..(204): n is a, c, g, or t
  modified_base (238)..(238): a, c, t, g, unknown or other
  misc_feature (238)..(238): n is a, c, g, or t
  modified_base (458)..(458): a, c, t, g, unknown or other
  misc_feature (458)..(458): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcacgggtcctcgggcccagtctgtgctgactcagccaccctnagtcgttcgcggggaccccggnaggagggtcctccattctcttgttcgtgggaacnctagccgtacggacgtacggaaattacgttgtactacgtgtaccagtacacgtcctacccgaacggaacccggaccccaagtcctcctacgatacgtagtagattgactcgacggtccgtaccgcgaacgggtacttaccgacgtaaccttgttaccgtcgtacggacgttacgtaacgtcgttcgtaccttcccggtacccggtccctcccgggttacnccgttacgttaccgggtacgggttccggggttacccggttaccccggggttacgggaacggttacgtaaccgggtacggtaccggtttaaaggaaaccgttttggttttaaccgcgggtttacggttacggtttacggggtttacgggtaaaccgttcgggttaaaccttacgggttaccggtttacggggttaacgggggtttcccggtttaacccgggggttaccggggtttccggggtttaaaccggggacccgggggggtaaaaccgtaccccggtaacccgggggttacggttaaccccgggtttaccccgggaccgggttttacccccgggaccggtaacccgggaaaccccgttacccgggggtccccccgtttaaccccggtcccccgggttacccgtttcccggttaaaccccccgg

SEQ ID NO: 83096 - DNA, 783 bp, Homo sapiens
  misc_feature: GYAE6OF01DVBC9.25.23.C01.1.454.CMB.1.raw
  modified_base (203)..(203): a, c, t, g, unknown or other
  misc_feature (203)..(203): n is a, c, g, or t
  modified_base (207)..(207): a, c, t, g, unknown or other
  misc_feature (207)..(207): n is a, c, g, or t
  modified_base (234)..(234): a, c, t, g, unknown or other
  misc_feature (234)..(234): n is a, c, g, or t
  modified_base (330)..(330): a, c, t, g, unknown or other
  misc_feature (330)..(330): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcacgggtcctgggcccagtctgtgctgactcagcccaccctcagtgtcgtcgggacccccggnaggngggtctccatctcttcgtcgtgggacnctagccgtccgacgtacggaaaattagtttcgacttacgttcggtaacctggacacgtcctacccgaacggaaacccggcccccaaagtcctcctntactacgtaagtagtatgactcgaacggccgtacccctaggtacggtactaccgtacgaccgtctttctcggtcgacgtcgtaacgtcgttcgccctaccgtccggtccctacgtccgtcctagtccgaggtccggtcccgtaccgggtccgaggtacggttcggacgtcgtacgtaacgttagtttcgtaggtcgtaccggtttaagggttgggtaccgttacggtaccgttggtacgttacggggtacggtttcccggggttaccgggttacgggttcgggttacccgggggtaaccggggtaaccgggttaccgggtaaccgggttcccggttaaacccgggtttacccgggttacccggttaaccggtaccccgggttaaccgaaccccggtaacgggttaccccggtccccgggttaaccccccgttcgggtcccctttaaccccggg

SEQ ID NO: 83097 - DNA, 801 bp, Homo sapiens
  misc_feature: GYAE6OF01B0XKH.25.23.C01.1.454.CMB.1.raw
  modified_base (223)..(223): a, c, t, g, unknown or other
  misc_feature (223)..(223): n is a, c, g, or t
tcagactgtacagtcacgaccggtgctcgatttagtacacgtgattagggagttgggggagcgttcagtctgttaggtagagaacgaccaggattcaggacaatctccagcatggccggcctccctctcctcctccaccctcctcactcactgtgcagggtcctgggcccagtctgtcgctgactcacgccaccctcacgtcgtccgtcggggacccccgggnacggagggtcctaccgaacttcctctttggttccgtgggaacgtcgaacggccgtaccggacggttacggaaattacggtttcgtacctacgtcggtaccacgtaccacgtcctacccgaacggtaaaccggcccccaagtcctaccctcaacgttcttaacgtaacggtaactcgaactcgacggtcccggtaccctacgacgggtactaccgtacggaaccgtacttccgtcgtcggtacgtacgtaacggtcgtcgggtaccttccggtccggtaccttcccgtacggaccctagtccggaacggttcggggtcccttacccggggtaccgaagggtactacgggtacgtaccgttacggaaacttttcgtaacgttggtacggtaccgttaagggtttcgggaataccggtaccgtagttccgttaacgggacggtttccggggtaccggttaccgggttcggggttccggaaccggggtaacggggtacccgtacgggttacgtccggttacccggtacgtaccgggtccaacgggtaccccggaaccggttcccggtacccggtacccccgg

SEQ ID NO: 83098 - DNA, 710 bp, Homo sapiens
  misc_feature: GYAE6OF01CC6NV.25.23.C01.1.454.CMB.1.raw
  modified_base (208)..(208): a, c, t, g, unknown or other
  misc_feature (208)..(208): n is a, c, g, or t
tcagactgtacagtcacgaccggtgctcgatttagtacacgtgattagggattgggggagctgtggtagagaagacaggattcaggacaatctccagcatggccggcctccctctcctcctcaccctcctcactcactgtgcagggtcctcgggcccagtctgtcgctgactcacgcccaccctcagtcgtcgtcggggacccccggngacggtagggtcctcgactcttcttggttcgaggggacgcgtacgccgtaccggacggtacggaaagttaacgtttgtactacgtacggtaccagtcacgcctaacccgaaacggaaacccggccccaagtcctacctacctagttaccgtaagtaacggtaatcgtaactccgacggccggtacccgtcggaacgggtacctaccgtacggacgttacgtcgtcgtagggtctacggtacgtcgtcgtcttccgtccgtcctccggtgcctacgtccggtacggtcgggtccgtacccgggtacgagggttacgcgggtaacggtcgtagtaagttacttacgtgtacgttcgtaggttcggactcggacgtacgttacggtcgtaccgggtacgggttcgtaacggggttcgtacggggacggtacggacgtacgcggtcgtaccgtacggtcggtacgacggtaccgtacggccctaccggtcccctggtcctacccgg

SEQ ID NO: 83099 - DNA, 787 bp, Homo sapiens
  misc_feature: GYAE6OF01AP9K5.25.23.C01.1.454.CMB.1.raw
  modified_base (197)..(197): a, c, t, g, unknown or other
  misc_feature (197)..(197): n is a, c, g, or t
  modified_base (233)..(233): a, c, t, g, unknown or other
  misc_feature (233)..(233): n is a, c, g, or t
tcagactgtacagtcacgaccggtgctcgatttagtacacgtgattagggattgggggagagaagacaggattcaggacaatctccagcgagtggccggcctccctctcctcctcaccctcctcactcactgtgcagggtcctgggcccagtctgtgctgactcagcccaccctcagtcgtcgtcgggacccccggnaggacggtcctccatcctcgtttggttcgtgggacncacgcctccggacgtacggaaattagtttgtctacgtggtaaccagcgacgcctaccgaagaaacccggcccctaagtcctcctacacgttccgtaagtaacgggtaatggactacgaaccggtccggtccccttagaaagggtccttaaccgtacgaacccgttaattccgtacgttcggacctaacggtaacgttccgtacgggtcccttacccggtccggtccccttcccgtcggggtacccaaacgttccggtcggggttcccgggtacccgtttaccccgggggtaccggagggtagttaccggggaaacggtccttaaacggttaaagttacctttaccggtgggtacgtacggtttaagggttttccgggaactcccggtacgtacgggttcgtaacgggtcggtaccgggtaccccggtaggttcgggtaccggacggtcggaaccgtccgtcgtcgtacccgtagtaccgggtcaccggaccgacggtcccgttacccgaccccggttgggtacccacgtttacccgttcccggccccgtacccc

SEQ ID NO: 83100 - DNA, 706 bp, Homo sapiens
  misc_feature: GYAE6OF01ESKUF.25.23.C01.1.454.CMB.1.raw
  modified_base (192)..(192): a, c, t, g, unknown or other
  misc_feature (192)..(192): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccacctcagtgtcgtcggggaccccgggnaggacgggtctccatccttcttgttcgtgggagcagcctccgacgtacggtaaattagtttgtactacgtcggtaccagcacgcctaccgaacggaaacccggcccccaagcctcctactactactagtaagaatgtactcgacggccggaccctacggacgggtactaaccgtacggtaaccttacttccgttcgtaccggtaccgtaccggtaacgttccgtacgggtcccttccggtccccggtcccgttccgtaccgtacccgtacgtaccggtagggtcccgggtccgttcccggggtaccgtaggtagttcgggacgtacgttaataaacgtttcgttagtggtacgttacggttacggttggtacgtcgacgttgtcgtcggtacgggttcggtacccggttgggttcgggtacgggacggtacggacgtcgcgtcgaccggtcgtacggaccgtacgtaccggcgtcctccccggacctcgtactaccttccgttccgccctaccg

SEQ ID NO: 83101 - DNA, 733 bp, Homo sapiens
  misc_feature: GYAE6OF01BHN1A.25.23.C01.1.454.CMB.1.raw
  modified_base (207)..(207): a, c, t, g, unknown or other
  misc_feature (207)..(207): n is a, c, g, or t
  modified_base (217)..(217): a, c, t, g, unknown or other
  misc_feature (217)..(217): n is a, c, g, or t
  modified_base (240)..(240): a, c, t, g, unknown or other
  misc_feature (240)..(240): n is a, c, g, or t
  modified_base (411)..(411): a, c, t, g, unknown or other
  misc_feature (411)..(411): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcacgggtcctgggcccagtctgtgctgactcacgcccaccctcagtcgtccgtcggggacccccggnaggacggtcnccattcttctttgtcgtgggacncagccgtccggacggtacggtaaatttaaggtttcgtacctacgtcggtaaccacgctacgacctacccgaacggaaacccggacccccaagcccttcctactactactagtaacgtaatacgactccgacggccgtaccctcggaagggtacctaccgtggaacccgttnttaccgtcgttcggaccgttacggtaacgttccggtcgtcccttacccggtcccgtccccgttccgtcggacctacgtccgtacgggtccggtccgtccggggtaccggaggtcgtacggacgtacgtaagtacgttaagttcgtaggtcgtacggttaggtttggcgtacgtccgtagttcggtacggtcggttaccgggtcggttacgggttcgggtcgggaggggtaaccggtacgaacggtcgaaccgggtaccggtacggtacggccgacgaccccggtacggtcccgttaccccggtcccgtcgtcccgttacccg

SEQ ID NO: 83102 - DNA, 794 bp, Homo sapiens
  misc_feature: GYAE6OF01B0AAO.25.23.C01.1.454.CMB.1.raw
  modified_base (229)..(229): a, c, t, g, unknown or other
  misc_feature (229)..(229): n is a, c, g, or t
  modified_base (551)..(551): a, c, t, g, unknown or other
  misc_feature (551)..(551): n is a, c, g, or t
tcagactgtacagtcacgaccggtgctcgatttagtacacgtgattagggagttgggggagcttcagctgtggtagagaagacaggattcaggacaatctccagcatcggccgcctccctctcctcctccaccctcctcacctcactggtcgcgacgggtccgtcgggcccagtcgtgtgctcgacctcacgcccacctcaggttcgtccggaccgggggacccccggngtagggtaccggtcctaccgtattccgttcgtttcggtttaccggtagggaccggaccgtcggtaccgtacccgggtacggttaaacggtaaagttttaacggtttcgtaaccgtaacggtaccggtaaccacgaccgtaccgtaccctaaccccggaaaccgggaaacccccggccccctaagtcccctttaccaactacttacgtaagtaacggatcgtaacgtcgaccgggcccgtaccgaggacggtacctacgcgtacttactcgtggtcggacctacggtacgtcctcggtacccgttccgccggtcccctacggnggtaccctaggtacggtacgggtcggaccccgttcgggtaacggaggttaacggcggtaacgtcttaacgaactttacgtgtacggtcgtaggttgggtaacgtcgctacgttacggcgttagggaccggtttcggggaccgtaggggttccggggaccggtaaggggaccgtacggacgttccgggaccgtaaccgtcgtacggccgaacccgggacccgcggtttcccgacccgttcccgg

SEQ ID NO: 83103 - DNA, 662 bp, Homo sapiens
  misc_feature: GYAE6OF01CO4FI.25.23.C01.1.454.CMB.1.raw
  modified_base (190)..(190): a, c, t, g, unknown or other
  misc_feature (190)..(190): n is a, c, g, or t
  modified_base (219)..(219): a, c, t, g, unknown or other
  misc_feature (219)..(219): n is a, c, g, or t
  modified_base (286)..(286): a, c, t, g, unknown or other
  misc_feature (286)..(286): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctggcccagtctgtgctgactcagccaccctcagtgtctgggacccccgggnagagggtcctccatctcttgttctgggancagctccgacgtcggaaatagtttgtctactggtaccagcagctccagaaaccggccccaagctccncatctataggaatgatcaacgcgccctgaggactaccgtgaccgtattctctcggcttacgaagtctcggcctccgtccggccttcccgagggtcccaagtcgacggtcgggccgttcccgggtaccgtaggtagtcggaggccgtagtaaacttaacttaacgtgtgtacgttaggtttgggattacgaccgtaggttcgtaggtacgttcgggtaccggtacgggttcgggttaccgggacgggtacgggaaccgtaacggcggtaccggtacccggttaccgtaacggtaccgaaccgacccggtaaacggtccgtacccggcccccgttcggtaccctaccgttcccgttcccgttcccccgttaacccccg

SEQ ID NO: 83104 - DNA, 847 bp, Homo sapiens
  misc_feature: GYAE6OF01CADAG.25.23.C01.1.454.CMB.1.raw
  modified_base (174)..(174): a, c, t, g, unknown or other
  misc_feature (174)..(174): n is a, c, g, or t
  modified_base (229)..(229): a, c, t, g, unknown or other
  misc_feature (229)..(229): n is a, c, g, or t
  modified_base (685)..(685): a, c, t, g, unknown or other
  misc_feature (685)..(685): n is a, c, g, or t
tcagactgtacagtcacgaccggtgctcgatttagtacacgtgattagggagttggggagcttcagctgtggtagagaagacaggattcaggacaatctcagcagtcgggccggtcctccctcctcctcctccaccctcctcacctcacgtgcgacgacgggtccgcgggcccngtccgtgtcgctcgacctcacgcccaccgtcgagtcgtccggccggggacccggngacggacgggtcctctcttcttcggttgttacgtgggacgaccgtacgccggtaccgtaaccggtaaggttaaaacgttttacggtttcgtccgttaacggttacggaacctagccgtacgtaccccgtaaccggaaacccgggaaccccgtaccccgtaacctcctaccgtactactaaccgtaaggttacggaacttacggacgaccgaccggtcccgaaccggtacgtaaccggactttaacccggtcgtaacccgttacttccggtcgttacggcccgtacgaccgtttggcccttccggttaccccggcccgtacccggtttccgccgttacgcgttaccgggacggttcccgggaccggtacccggttacgaggggtacgtacgggacgtaacggttaaagtaccgttttagtcccggttaagggtccgtaacgggttggggttacccgngggtaccggtaacgttcgggttacggtacgggttaacccggggtcggtaccgggttaggggttcccggggacgggtaccgggaacggtaccttaggcccgggttacgtaaccggtgaaaccgggtcgaaacccggccggcccggtcccgccccgttccccgg

SEQ ID NO: 83105 - DNA, 902 bp, Homo sapiens
  misc_feature: GYAE6OF01CSQUY.25.23.C01.1.454.CMB.1.raw
  modified_base (177)..(177): a, c, t, g, unknown or other
  misc_feature (177)..(177): n is a, c, g, or t
  modified_base (200)..(200): a, c, t, g, unknown or other
  misc_feature (200)..(200): n is a, c, g, or t
  modified_base (225)..(225): a, c, t, g, unknown or other
  misc_feature (225)..(225): n is a, c, g, or t
  modified_base (231)..(231): a, c, t, g, unknown or other
  misc_feature (231)..(231): n is a, c, g, or t
  modified_base (425)..(425): a, c, t, g, unknown or other
  misc_feature (425)..(425): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcgacgggtcctcgggccctagtctgtcgctgactcacgcccacctnagtcgtcgtccggggaccccggnagaggtcctacatctcgttgttcgngggacncgtacgtccgtaccgaacggttaacgtaaagtttacggtttacgtactacgtacggtaccaggtacaccgtacctacccgaaaacggaaaaaccccggcccctaaatcccgtacctactactacgtaagtaacggtaacgtgaactccgaacggtacccgaccttaaggacggtaccttaaccgcgtaaccgtntttaccgcgtacgggtaccttacggaaggtccgttcggtaccccgttaccggtaccccggtcccgttacccgtagggacccctaagttaccggacgggttacccggggtacccgttcccggggtaacggtaacgggtacgtaacggtacgggtacttaaacggtaaacgttaacgtttaacggttcggttacggttaccggttaacgggtttagggacgtttaccggtaacccggttagttaccggtacgggttaaccgggttcccggggtttaccgggaaacggggttttccggggtaaccgggtaccggggtaaaccgtaccgggtaaccggttaccgggtaccgtaccccggttaacgtaccgggtaaccaacccgggtaccccggtaaacggttccccggtcccccgggtacccccgtttaaccgggacccgtttacccttaacccggtttccccggttcccccctaaacccg

SEQ ID NO: 83106 - DNA, 769 bp, Homo sapiens
  misc_feature: GYAE6OF01E2K5D.25.23.C01.1.454.CMB.1.raw
  modified_base (210)..(210): a, c, t, g, unknown or other
  misc_feature (210)..(210): n is a, c, g, or t
tcagactgtacagtcacgaccggtgctcgatttagtacacgtgattagggattgggggagctgtggtagagaagacaggattcaggacaatctccagcatggccggcctccctctcctcctcaccctcctcactcactgtgcagggtcctgggcccagtctgtgctgactcacgcccaccctcagtgtcgtcggggacccccgggcaggngggtcctccattctcttgttcgtggggagcacgcctacccggacggttacgggaaaatttaaggttttcgtccttaacgtcggtaaccagcacgcctacccaacggaaacccggcccccaagtcctccctcactctataggaatgactcgacggccggccctacggaggactacctcgacccgtattcctcgtcggctacgagtcgtcgggtcctcccgtcccggtcccttcccgtggccctaacgtccggtagggtcccggggtcccgttccccggggtaccgaacggggtacgtacgggaacgggtaccttaaggtaaactttacgtttacggttggtacggttaccgttaggggttttcgggacgttcgtaccgtaggttcggtagggtacgggttccgggtacccgggttacgggttccggggttaccggggacgggggtaccgggaaaccgtacggtccggttacccggtaccccgggttaccggtacgggacccgtaaccggaacccgtacgggtacccgttacccggccccccgtttacggcccttaccccg

SEQ ID NO: 83107 - DNA, 913 bp, Homo sapiens
  misc_feature: GYAE6OF01EZR0I.25.23.C01.1.454.CMB.1.raw
  modified_base (206)..(206): a, c, t, g, unknown or other
  misc_feature (206)..(206): n is a, c, g, or t
tcagactgtacagtcacgaccggtgctcgatttagtacacgtgattagggattggggagctgtggtagagaagacaggattcaggacaatctccagcatggccggcctccctctccctcctccaccctcctcactcactgtgcagggtcctgggcccaggtctgtgctgactcagccaccctcagtgtcgtcggggacccccgggngaggacgggttcctcctagttccttcgtttggttcgtggggtacgcgtacgccgtccggacgtacggtaaaattaaggttttcgtacgttacgtcggtaaccagcgacgcctacccgaacggtaaacccgaccccctaacgcctacccttcgacttactaaggttaacgaatacgtacgtacgaaccgggccgtacccgtacggaacgggttaccttaacccgtcgggtaacccgtacgttttaccgttaccgttacgggtacccgttaaccgggtaaacggtttcccggtttaccgggtccccttccccggttccccgggtcccctttacccccggtcgggtaccctaccgttaccgggtacgggttccggggttacccgtttaccccggggtccgggttaaacgggtcggttaacggggtacggttaccgttaacgggttaaaacgtttaccgtttaccgttggtttacggttaacccgggtttaaggggttttacgggtacgttaccggtaccgtttacgggttacggttacgggttaaggggttccgggtttaaccggggttacgggtttaccgggggttcccggggaacggggttaaccgggaaccgttaccgggtaccgtacgggttaacccggttacggttacgggaccgtaaccggacccggtacggttcccgacccggtccccgtcggtcctacccgg

SEQ ID NO: 83108 - DNA, 722 bp, Homo sapiens
  misc_feature: GYAE6OF01CCRSV.25.23.C01.1.454.CMB.1.raw
  modified_base (270)..(270): a, c, t, g, unknown or other
  misc_feature (270)..(270): n is a, c, g, or t
  modified_base (287)..(287): a, c, t, g, unknown or other
  misc_feature (287)..(287): n is a, c, g, or t
tcagactgtacagtcacgaccggtgctcgatttagtacacgtgattagggattgggagggctttgttggagaccctgtccctcacctgcagtgtctctggtggctccgtcagtgcttattactggagctggatcccgccagtccggccggggaggggactggagtggagttgggcgtatatatacgatggattaaccacctaccaacccctcctacaagatcgatcaaccatactcgagcggaacacgtcgagggatcgaggtcgttccngcattcgtgtacttcgngccgactcggccgacggacgaccggtccctactactacgtgtcgaccgagacgtacgttcggactgaccgtacgttagttttacggaattaatttattcgttctttgttcgttctttagacgtgtcgggtacgggtaccgtaaacgggacgtaccggttccgtaccgttccttccgttacgtaccgtcccctaccgaacccggacccggtccctacgttcccggttcccctttacccccggcgtaccccacccccttaccacccgaaggccctccgtaccgtcgggtacgggaccaccggtccggcccggtcccggtggcccgttccggtccgttacgggtacccgtaaaccggtcccttaaccgttcccgtacggttaccgtacggttacgttaccggtacgggaccgggtacgggtccgtaaggacggaacgg

SEQ ID NO: 83109 - DNA, 781 bp, Homo sapiens
  misc_feature: GYAE6OF01CBJ28.25.23.C01.1.454.CMB.1.raw
  modified_base (232)..(232): a, c, t, g, unknown or other
  misc_feature (232)..(232): n is a, c, g, or t
  modified_base (300)..(300): a, c, t, g, unknown or other
  misc_feature (300)..(300): n is a, c, g, or t
tcagactgtacagtcacgaccggtgctcgatttagtacacgtgattagggattggggagatgtggtagagaagacaggattcaggacaatctccagcatggccggcctccctctcctcctcaccctcctcactcactgtgcagggtcctgggcccagtctgtgctgactcagccacctcagtcgtcgtcggggacccccggaggacggtcctccatcttcttgttctgggancagctcgagtacggtaaatagtttgtctactggtacagcacgctccgagaaaccggccccaagctccntatctagtacgaatgactcgaacgccgcctacgaggtactaccgtacgtaaccgtacttcgtacgtcggtctacgtaaagttcctcgggtaccttccgtccgtcccttaccgtggccctaagtcgacggtgggtcccttccgggtacgaggttacgacggtacggacgttaagtaacgtttaacgtttacgttacgggtacgtaccgtttaagggttttacgggtaaacttcccggtaaccggtttacgggttaccggtacgggttaacgggtttccgggttacccgggtttaacggggtttacgggttacccggggggaaccgggttaaaccgggggaacccttaaacggggtcccggtttaaccgggtaaccccggtttacccggttaaagggtcccgaaacccgggttacccgggtaaaccgggttccccgttaaaccccgggttcccccgttaacggttaaccccgtttaaccccgg

SEQ ID NO: 83110 - DNA, 769 bp, Homo sapiens
  misc_feature: GYAE6OF01AMCVW.25.23.C01.1.454.CMB.1.raw
  modified_base (209)..(209): a, c, t, g, unknown or other
  misc_feature (209)..(209): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtcgtcggggacccccgggnacggagggtcctccattcctcgtttgttcgtggggacgcagcctccggacgtacggtaaaattagtttgtctacgtcggtaccaggcacggcctaccgaacggaaacccggccccaagcctacctacactactaagtaggtaactggtaactccgaacggtcccggtacccctacggtaacggggtactacccggtacggtaacccggtacttttcccgcggttcgggacccgttacgggtaaacggttccggttcggtcccgttccccgtcccgggtacccttccccggtcgggacccttacgtcggtacggggttcggggtcccgttcccgggtaccggaggtacgttcggaacgggtccttaagggtaactttacggtttacgtcggtacggtcggtttaagggtttcgggaattcgggcctaggtcgtagggtacggttccggaaccgggttgggttcgggttacggcggggttaccggacgtacggtaccgtccgggaccggttccggtacggtacccgacggaccccggaacggtccccgtccggtcccccggg

SEQ ID NO: 83111 - DNA, 650 bp, Homo sapiens
  misc_feature: GYAE6OF01AFPJJ.25.23.C01.1.454.CMB.1.raw
  modified_base (207)..(207): a, c, t, g, unknown or other
  misc_feature (207)..(207): n is a, c, g, or t
  modified_base (322)..(322): a, c, t, g, unknown or other
  misc_feature (322)..(322): n is a, c, g, or t
  modified_base (363)..(363): a, c, t, g, unknown or other
  misc_feature (363)..(363): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcaggtcctggcccagtctgtgctgactcacgcccaccctcagtcgtcgcgggacccccggnaggagggtctcagtctcttggttctgggagtcagcgtaccggacgtacggaaattagttgctacgtggtaccagcagcctaccgagaacccggccccaagtcctccacatactanaggatgatcgagccgacctgaacggactaccgtgaaccgtnttcgtacgtcgtaccgtacgtaacgtccgtgtaccctccgtccgggtccctccgtccgtacctagtccgtacgggtcgggtccgtacccgggtaccgaagggcgtaggacggtacgttagtaaacgttctttacgtcggtacgtagttacgggttttggacgtcgtaaccgttgtccgtaaggtggtcggtaccggtgggttggttcccggagggtaccgggtaccgagtccggacggtacccgtccgtaaccggtcaccggaccgaacggtcccgtccgtcccccg

SEQ ID NO: 83112 - DNA, 695 bp, Homo sapiens
  misc_feature: GYAE6OF01BX2PV.25.23.C01.1.454.CMB.1.raw
  modified_base (193)..(193): a, c, t, g, unknown or other
  misc_feature (193)..(193): n is a, c, g, or t
  modified_base (217)..(217): a, c, t, g, unknown or other
  misc_feature (217)..(217): n is a, c, g, or t
  modified_base (251)..(251): a, c, t, g, unknown or other
  misc_feature (251)..(251): n is a, c, g, or t
  modified_base (429)..(429): a, c, t, g, unknown or other
  misc_feature (429)..(429): n is a, c, g, or t
  modified_base (587)..(587): a, c, t, g, unknown or other
  misc_feature (587)..(587): n is a, c, g, or t
tcagactgtacagtcacgaccggtgctcgatttagtacacgtgattagggattggggagagaagacaggattcaggacaatctccagcatggccggcctccctcctcctcctcaccctcctcactcactgtgcagggtcctgggcccagtctgtgctgactcacgccacctcagtcgtcgtcgggaccccggnaggcggtctccatctcgttgtcgnggagcacgcctcgacgtacggtaaattaggtttntactacgtcggtacagcagccaccgaacgaacccggaccccagccctactactacttacgtaagaacggtaatcgatcgaccggccgtacccgagacggtactaccgtcgtacgttattcctcggtcgcgtacgtacgtcgtacggccgttcccgtccgtaccctcccggcggtaacncggtacgacgggtccggtcgtacccgggaggcgtagcgacggtctagtaacgttagttacgtgtacgtggttaggttggtacgtcgaccgtagttcgagggtacgggttccgggtaccggtacgggttccggggtacgggtacggggacggtaaccgnggttccggtacgtacccgggttaccgtacgggtcgaacccggttaccgccggttacccgtacccccgtccgtaccggtacctccttcccggttcccgtcccctacccg

SEQ ID NO: 83113 - DNA, 769 bp, Homo sapiens
  misc_feature: GYAE6OF01C7XH2.25.23.C01.1.454.CMB.1.raw
  modified_base (174)..(174): a, c, t, g, unknown or other
  misc_feature (174)..(174): n is a, c, g, or t
  modified_base (264)..(264): a, c, t, g, unknown or other
  misc_feature (264)..(264): n is a, c, g, or t
  modified_base (375)..(375): a, c, t, g, unknown or other
  misc_feature (375)..(375): n is a, c, g, or t
  modified_base (464)..(464): a, c, t, g, unknown or other
  misc_feature (464)..(464): n is a, c, g, or t
  modified_base (642)..(642): a, c, t, g, unknown or other
  misc_feature (642)..(642): n is a, c, g, or t
  modified_base (696)..(696): a, c, t, g, unknown or other
  misc_feature (696)..(696): n is a, c, g, or t
tcagactgtacagtcacgaccggtgctcgatttagtacacgtgattagggattggggcagcttcagctgtggtagagaagacaggattcaggacaatctccagcatcggcccgcctccctctcctcctcacccctctcacctcacgtgtgcagggtcctcggcccaagtcgtgngtctgacctcacgaccctaaccctgtagttcgtccggccggggacccccgggatacggacggttcacctacttccttcttacggttcggngggacacggaacgccggttaccggaacggtaaggtaaaatttaggtttcgtacctacggtacggtaacgacgtacacgaccctaaccgaaacgaacccccggtaccccaanccctttaccacgaccttagaacgttaacgagtacgtacgacgaccgggcctaaccgttaggaccggtataccggtacgtccgtttaacncgttctgaacggtacgaaccgtttcggtacgcctttacccgccggtaccccttcccgcgaccacgttcggaccggttccgggccgttacccggaagggtaacgtcggtacgaaccgggtataaacggttaattacctttagggtccgaggttacggttagtttcggacttcggtaacncgtgttacggaggttccgtacgggtcggtcggtacggggtacggaaaccggtanccgggtacccgaacggttacccggtcgttaacgggacccgaccggtaacccgtacccggtcctaccccccggg

SEQ ID NO: 83114 - DNA, 821 bp, Homo sapiens
  misc_feature: GYAE6OF01CPMXU.25.23.C01.1.454.CMB.1.raw
  modified_base (191)..(191): a, c, t, g, unknown or other
  misc_feature (191)..(191): n is a, c, g, or t
  modified_base (222)..(222): a, c, t, g, unknown or other
  misc_feature (222)..(222): n is a, c, g, or t
  modified_base (227)..(227): a, c, t, g, unknown or other
  misc_feature (227)..(227): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctggcccagtctgtgctgactcagccacctcagtgtcgtcgggacccccgggnaggacgggtcctccattcctgttagtttcgngggancagcctaccgacgtcggaaaattaacgttttcacttacgtcggtaccagaccgtacgccgtacccgaacggtaaaccccggacccctaacggtccttaccctctaacgtcgtacgtaaggaacgtcgaacgtaccgaccgggccggtacccgtacgggtaacggtaccgttacccgtaacggtaaccgttaccgtttccgtaccggtcggtaccgttcggtaaacgttcggtacgtcccggttcccgtaccggtccccgttccgtaaccggccttacgtaccgtaacgggttccgggcccggttccgggaaccgggtacggagtcggggtaacggtcgtaacgtaagtttaccgttacggtgggttactcgggtttaacgggtttacggacgttcgtaaccgttggttaccggtaggtttaaccggtccgggttaccggttacgggtttcgggttacccgggaggttaacccggtacggtaccctcgggtacccgttacccggtacgtacgggtcccgtaccgacccggtactcccggtaccccggttcccggtcgtacccgtacgttccccgttaacccgtccccttaccccg

SEQ ID NO: 83115 - DNA, 745 bp, Homo sapiens
  misc_feature: GYAE6OF01DN6VT.25.23.C01.1.454.CMB.1.raw
tcagactgtacagtcacgaccggtgctcgatttagtacacgtgattagggattggggcagcttcagctgtggtagagaagacaggattcaggacaatctccagcatggccgcctccctctcctcctcaccctcctcactcactgtgcacgggtcctgggcccagtctgtgctgactcacgccaccctcagtgtcgtccggggacccccgggcgaggtacgggtcctccacttccttcgtttcggttcgtcgggacgcgacgcctccgacggtacgtaaattaagtttctcttacgtggtaccagcacgcctaccaacgaacccggccccaagcctccgctatacgttagtaggtaatgtactacgacggcccgacccgtacggaacggtaccgtacccgttacggaaccggttaactttccgtccggtacggtaccttaccggtaacgtttcggtcggtcccttcccgggtccgtccccgttaccggccggtaccgtacgtccggtagggtccgggtaccccggttcccgggttaccggaacggtcgttaccgggacgtacgttaggtaaactttagtttccggtaggttacgtacggttaggtttcgggtagttccgtacgtaggttcgttaacgggtcgggtacgggttccgggtcgggttcggtacgggccgggaaggtaccgtacgcgttccggaccgttaccggtacggaccgtaccgaccgaccggtccgtacccccgg

SEQ ID NO: 83116 - DNA, 718 bp, Homo sapiens
  misc_feature: GYAE6OF01CAJ73.25.23.C01.1.454.CMB.1.raw
  modified_base (203)..(203): a, c, t, g, unknown or other
  misc_feature (203)..(203): n is a, c, g, or t
  modified_base (235)..(235): a, c, t, g, unknown or other
  misc_feature (235)..(235): n is a, c, g, or t
tcagactgtacagtcacgaccggtgctcgatttagtacacgtgattagggattggggagctgtggtagagaagacaggattcaggacaatctccagcatggccggcctcctctcctcctcaccctcctcactcactgtgcagggtcctgggcccagtctgtgctcgactcacgcccaccctcagtgtcgtcgggacccccggnacggaggtcctccatcttctttgtcgtgggancagccgtaccgacggttacggaaaattaggtttcgtcgtaacgtggtacctagcaacgcctaacccgaacggaaaccccggcccccaaggtcctacctactaactctaagtaggaattcggactcgacggccgtcctacggaagggtacctaccgtacggaccttattccgtacgtcggcgtaacgtacgtccgtaccggtccttccggtcccgtcccgtccgtacggacctagttccggacgggtcccggtccggtaccgggtacgtacgggtagtacgggaacggtacgttaacgtaagtttacgtttacgcggtttcgtacgtttgggtttacggacgtacgccggttaagtcggtaggttcgggtccggtcggttaggttcgggtacgggaccgggtacggtaccgaacggtccgtacggtacccgttcggaggtcccgaccgaccgtacgtccgcccggtccccgtggcccttaccgg

SEQ ID NO: 83117 - DNA, 737 bp, Homo sapiens
  misc_feature: GYAE6OF01AVTEV.25.23.C01.1.454.CMB.1.raw
tcagactgtacagtcacgaccggtgctcgatttagtacacgtgattagggattggggagagaagacaggattcaggacaatctccagcatggccggcctccctctcctcctcaccctcctcactcactgtgcgacgggtccgtcgggcccagtctgtgctgactcacgcccaccctcagtcgtccgtccggggaccccggcgacggacgggtctccatcttcgttcgttcgtgggacgcacgtccgtccggacggtaacggtaaagttagtttcgtcttacgtcggtaaccagcacgcctacccgaacgaaccccggaccccaacgtcctcctactacttactaagtaacggaatcgtaactcgaccggccggtacccgtacgaacgggtactaaccgtcggtaaccgttacttccgtcgtcggtaccgtacgtacgtcgtcgcctccgtccgtccctccgtcgcctacgtcgtacggtcggccgttccgggtacgaggtcgtacgggacggtactaagtacttacttacggtcgtgtacggtttaggttcggcttccggacgttgtacgtgggtacgggttccggtcggtacgggtcggtaccgggaggtaaccgggacctagggccgtaccgggtaccttacgggtacgtcccgaccgggacccgtacgggttcccctccccggttcccggttactacccgttacccggtttccctcccggttcccccctacccg

SEQ ID NO: 83118 - DNA, 727 bp, Homo sapiens
  misc_feature: GYAE6OF01AHV36.25.23.C01.1.454.CMB.1.raw
  modified_base (200)..(200): a, c, t, g, unknown or other
  misc_feature (200)..(200): n is a, c, g, or t
  modified_base (223)..(223): a, c, t, g, unknown or other
  misc_feature (223)..(223): n is a, c, g, or t
  modified_base (263)..(263): a, c, t, g, unknown or other
  misc_feature (263)..(263): n is a, c, g, or t
  modified_base (296)..(296): a, c, t, g, unknown or other
  misc_feature (296)..(296): n is a, c, g, or t
  modified_base (310)..(310): a, c, t, g, unknown or other
  misc_feature (310)..(310): n is a, c, g, or t
  modified_base (320)..(320): a, c, t, g, unknown or other
  misc_feature (320)..(320): n is a, c, g, or t
  modified_base (347)..(347): a, c, t, g, unknown or other
  misc_feature (347)..(347): n is a, c, g, or t
  modified_base (361)..(361): a, c, t, g, unknown or other
  misc_feature (361)..(361): n is a, c, g, or t
  modified_base (379)..(379): a, c, t, g, unknown or other
  misc_feature (379)..(379): n is a, c, g, or t
  modified_base (421)..(421): a, c, t, g, unknown or other
  misc_feature (421)..(421): n is a, c, g, or t
  modified_base (694)..(694): a, c, t, g, unknown or other
  misc_feature (694)..(694): n is a, c, g, or t
  modified_base (710)..(710): a, c, t, g, unknown or other
  misc_feature (710)..(710): n is a, c, g, or t
tcagactgtacagtcacgaccggtgctcgatttagtacacgtgattagggagttgggggagcttcagctgtggtagagaagacaggattcaggacaatctccagcatggccggcctccctctcctcctccaccctcctcacctcgactgtcgcgagggtccgtcggcccgagtcgtgtcgctgactcgacgccacctcgngtcgtccgtcggggacccccggngacggacgggtcctcctatcttcgttcgtcgtgggacacncggtctaccggacggttacgaaagttacgtttncgtaacgtgtaccngcgacgaccncccaggtaacccgcccaagtcctcctnactcgtagacgtancgtactcgacgccgaccngtacggactcgtcgccgtattccgtgcggtactacgggtacnccgttacgggccttacccggcctcccgttcccgacgtaccctaaggtccggtacggtccggggtaacccgttcccggggtaccgagggttaacccgtggaccggttcgttaacgaagtttacgttcgtcggtaacgccgggttttggggttaagccgttcgacccggttagtacccggttgggttaaccgccggttaacgggggtccctagggggtaccgaacggggtaaccggcctacgggtccggtccgaccccgtttagcgggaaacccncgggtacccggtaacncccccggttacggcccc

SEQ ID NO: 83119 - DNA, 754 bp, Homo sapiens
  misc_feature: GYAE6OF01BNZQV.25.23.C01.1.454.CMB.1.raw
  modified_base (180)..(180): a, c, t, g, unknown or other
  misc_feature (180)..(180): n is a, c, g, or t
  modified_base (203)..(203): a, c, t, g, unknown or other
  misc_feature (203)..(203): n is a, c, g, or t
  modified_base (232)..(232): a, c, t, g, unknown or other
  misc_feature (232)..(232): n is a, c, g, or t
  modified_base (315)..(315): a, c, t, g, unknown or other
  misc_feature (315)..(315): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctnagtgtccgtcggggacccccggnaggagggtcctccatctcttgtctgggancagcctcggacgtacggaaattagtttgtctacgtggtaccagcagtctacccgaagaaccgccccaagcctcctcatcgtanaaggatgatcacgcggcctagagggactaccgtgaccgtattcgtctggcctacggaacgttcgtcggtcctccggtcccggtcccgttccgtcgtaccctagttccgaggttccggggtccgtaccccgggtccggaaggtcgagggtacggtactacgtaaagtttcgtttaacgtcggttacgcggtttaggtttacggggaacttccggtaccgttaaggttccgttacgggggtaggttccggggtttacccgggtaccggggggtttcgggttaccccgggggaagggggttaacccgggaaacccggtaggttacccgggttacccgggttaccccgggttaaccgggttaaccgggtccgaaacccgggttacccccgaaacgggtcccgttaacccccgggccccccgtttacgggtcccttacccccgg

SEQ ID NO: 83120 - DNA, 825 bp, Homo sapiens
  misc_feature: GYAE6OF01C31XL.25.23.C01.1.454.CMB.1.raw
  modified_base (233)..(233): a, c, t, g, unknown or other
  misc_feature (233)..(233): n is a, c, g, or t
tcagactgtacagtcacgaccggtgctcgatttagtacacgtgattagggattgggggagcttcagctgtggtagagaagacaggattcaggacaatctccagcatggccggcctccctctcctcctccacctcctcactcactgtgcgacgggtccgtcgggcccagtctggtgcgtagacctcgacgacccaccctcgaggtcggtccggtaccgggggaacccccggggngaacgggtacgggtcctcctagttccttccgtttggttacggtacggggacgacgaacggtccgttaccggaacggttaacggtaaaagtttacgttttccgtaacgttacgacggttaaccgagaccgaaccgtacccgtaacccgaaaccgggaaaaccccggacccccgtaaacgtccccttacctacgtactttaacgaagttaacggaacgtaggtactaccgaaccggtcccggtacccgtacgggtaaccggtactaaccgtacggtacccgttaacgttcctacggtaccggttaccgtaacgggtacgtccggttccggccctttaccccggtaccggtccccctaccggttacgaccgtacgtacggtcgggtcgggtacccggtcggtaaccgagggttaccgtagggtaacgtcgttaacggtaaactttcggttacgtagggttaccgtaggttaacgggtttggaactcggtacgtagtccgtagggtacgtcgggtaccggtggtcggtacgggacgtaggacctaggcgtacgtaccgacgttacgaccgacgaccgacgccggtcccgtacccgg

SEQ ID NO: 83121 - DNA, 722 bp, Homo sapiens
  misc_feature: GYAE6OF01AL9VJ.25.23.C01.1.454.CMB.1.raw
  modified_base (198)..(198): a, c, t, g, unknown or other
  misc_feature (198)..(198): n is a, c, g, or t
  modified_base (297)..(297): a, c, t, g, unknown or other
  misc_feature (297)..(297): n is a, c, g, or t
tcagactgtacagtcacgaccggtgctcgatttagtacacgtgattagggattggggagagaagacaggattcaggacaatctccagcatggccgcctcctctcctcctcaccctcctcactcactgtcgcacgggtcctcgggcctagtctgtcgctgactcacgccacctgtcgtgtacgtccggggacccccggngtaggtcggtcctcctattcgttcgttcggtcggtacgggctccgcgtccgtaccggtacggtaacgtaaatttaggttcgtacgtaccgtacgtaccncgcacgtccgtaccgaaaccgaaccccggacccactccttactacgtacttacgtaagtaacgtaacgtcgtaacgtcggccgtacccggtaccctacgggtaacgtaacccgttaccgtaacgtacccgtttacgttccgtacggtccggacgtacggtacgtccgtccgtccgtcccggtaccgcctcggtccgactcgggtcggtacgggtcccggtcccgtcggtacggaggtacgtacggtcgtaactagtaattacgtacgttcgtacggtaggttggttacggtactcggttacgtcggtcggtggtcgggtacggtcggttcgggtcggtcggcggtacgtaccgtcgtcgtaccgtcgtcgtacgcgacgcggtcgtccgtccgcccgtacctcgtaccgtccttcccgtcctccg

SEQ ID NO: 83122 - DNA, 716 bp, Homo sapiens
  misc_feature: GYAE6OF01CA86Z.25.23.C01.1.454.CMB.1.raw
  modified_base (211)..(211): a, c, t, g, unknown or other
  misc_feature (211)..(211): n is a, c, g, or t
  modified_base (248)..(248): a, c, t, g, unknown or other
  misc_feature (248)..(248): n is a, c, g, or t
  modified_base (633)..(633): a, c, t, g, unknown or other
  misc_feature (633)..(633): n is a, c, g, or t
  modified_base (682)..(682): a, c, t, g, unknown or other
  misc_feature (682)..(682): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctcgggcccagttctgtcgctgacctcacgcccaccctcgagtcgtccgtcggggacccccggnaacgggcggtctccattcttcgttgttcgtggggacncacgccgttacgaacggtacggtaaaagttagtttccgtacttacgtacggtaccaggcaacggtcctacccgaaggaaaccccggcccccaaggtcctcccgtacacgttacctaagtacggaacgtgtaactcgacggacccggtacctacggaacgggttactacccgtacggaaccgtacttcgtccgtagggtcctaggtaacgtccgtcgtcctacccggttccgcccttcccgaggcccctaagtcccggtaacggtccgggtaccgtcccgggtacggtacggtagacggtacggtacgtacggtaaattacgttacgtgtcgtacggttaaggttcggtaacgttcgaccggtagtccggtagtagtcgggtaccncgggtgtaccggcgggtacgaccgtagcgtcggaccgttacgcgtaccncggacctacggacctcccggaccctcgtcgtccg

SEQ ID NO: 83123 - DNA, 777 bp, Homo sapiens
  misc_feature: GYAE6OF01A84K8.25.23.C01.1.454.CMB.1.raw
  modified_base (188)..(188): a, c, t, g, unknown or other
  misc_feature (188)..(188): n is a, c, g, or t
  modified_base (290)..(290): a, c, t, g, unknown or other
  misc_feature (290)..(290): n is a, c, g, or t
tcagactgtacagtcacgaccggtgctcgatttagtacacgtgattagggattggggagcttcagctgtggtagagaagacaggattcaggacaatctccagcatggccgcctccctctcctcctcaccctcctcactcactgtgcgagggtcctgggcccagtctgtgctgactcacgcccaccctnagtgtccgtcggggaccccccgggaggagggtcctccatctcttgttctgggagcacgcctccgacgtacggaaattaggtttgtactacgtggtaccagcncgcctccgaacggaaaccgggccccccaaggccctccgtacactctaagtaacggatgactcgacgtccggtccccgtagacgggacttaccgtaggacccctatttccttccgtacggtcctacggtaaggttccgtacggtcccttacccgttccggccccttcccgtcggaccctagtacgtacgggttccggggtccgttccccgggtaaccggaagggtacgtaccgggacggtccgttaagtaaacgtttaactttaccggtggttacggtacgtttacggggtttacgggtaaccgttcggtacccgttaggtcccggttagggtacggggttaccgggttccggggtccgggttcgggtttacccgggggacggggaaccgggtaacccggtacgggtaccgttcccgggttacccgttaccggttaaaccgggtccaacccgggtacccgacccgggtccttaccccgggtccccccg

SEQ ID NO: 83124 - DNA, 700 bp, Homo sapiens
  misc_feature: GYAE6OF01D02YE.25.23.C01.1.454.CMB.1.raw
  modified_base (187)..(187): a, c, t, g, unknown or other
  misc_feature (187)..(187): n is a, c, g, or t
  modified_base (212)..(212): a, c, t, g, unknown or other
  misc_feature (212)..(212): n is a, c, g, or t
  modified_base (247)..(247): a, c, t, g, unknown or other
  misc_feature (247)..(247): n is a, c, g, or t
tcagactgtacagtcacgaccggtgctcgatttagtacacgtgattagggattggggagcttcagctgtggtagagaagacaggattcaggacaatctccagcatggccgcctccctctcctcctcaccctcctcactcactgtgcaggtcctgggcccagtctgtgctgactcgacgcccaccctnagtcgtccgtccggggaccccgggnaggaggtcctccattccttcgttgttcgtgggacncacggctaccggacggtacggtaaagttagtttgtacctacgtacggtacctacgcgacgcctaccgaaccggaaaccccggacccccgaagtcccttacctacgtaacttaccgtaagtaggtaatgactcgaacgccgacctagacggactaccgtcgactctcgtcgtcgtctaacggacgtcgtcggtccctccgtcccgtccctccgtacgtacctactcggtaggtccgggtccgttacccgggtacgaggtacgtaggtacggtacttaagtaactttacgttacgttgggtacgtacgggttaggtttacgggacttccggaccgttagttaccggtggtaccgggttcgggtaccgggttcggtcggtccgggacggggtacgtaacgacgtacgtaccggtaccgtacggtacgcgaccgaccggacgtcccgccgtccccgg

SEQ ID NO: 83125 - DNA, 928 bp, Homo sapiens
  misc_feature: GYAE6OF01DXK0Q.25.23.C01.1.454.CMB.1.raw
  modified_base (245)..(245): a, c, t, g, unknown or other
  misc_feature (245)..(245): n is a, c, g, or t
  modified_base (336)..(336): a, c, t, g, unknown or other
  misc_feature (336)..(336): n is a, c, g, or t
  modified_base (419)..(419): a, c, t, g, unknown or other
  misc_feature (419)..(419): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcgagggtcctgggcccagtctgtgctgactcacgcccaccctcagtcgtccgtcggggacccccgggcaggacgggtcctcctatccttcgtttgttcgtgggancagcctaccggacggtacggaaattagtttcgtcttacgtcggtaccagccacgtcctacccgaacgaaacccggacccccaagccttccnctattcctaagtagggaattcgataccgacggcccggtacccgtacgaacgggtcttaacccgtacggtaaccgtactttccnccggtttcggtacccgttaacggtaaccgtttccggttcgcccgtttcccccggttacccggtccccgttaccccgtcggacccgtaagttccgtacgggttcgggtcccggttcccgggtacccggtaggtacggtgggaacggtacgttaacggtaacttttaaccgtttacggtttacggttaccggttagggtttaacgggttttacgggtcggttaccggtaccgttacggttccggtttacggggttacggggtttacccggggtttaccccggggtttaaccggggggtttcggggttaccccgggggggtaaccggggtaaccggggaaaccccggtaacgggttaccccggggttaacccgggtttaacccccgggtttaacccgggttaccgggttaaaccccgggtaaccccgggtaccccgggtaaacccgggttcccccgggtttacccccgggtccccccggtttccccggggttaccccgttttacccccgggg

SEQ ID NO: 83126 - DNA, 829 bp, Homo sapiens
  misc_feature: GYAE6OF01DHGJ8.25.23.C01.1.454.CMB.1.raw
  modified_base (205)..(205): a, c, t, g, unknown or other
  misc_feature (205)..(205): n is a, c, g, or t
  modified_base (320)..(320): a, c, t, g, unknown or other
  misc_feature (320)..(320): n is a, c, g, or t
  modified_base (797)..(797): a, c, t, g, unknown or other
  misc_feature (797)..(797): n is a, c, g, or t
tcagactgtacagtcacgaccggtgctcgatttagtacacgtgattagggtattggggagagaagacaggattcaggacaatctccagcatggccggcctccctctcctcctcaccctctcactccactgtgcagggtccgtcgggccagtctgtcgctagactcacgccctaccctcgagttgtccgtcggggaccccccgggnacggtacgggtcctccgattccttcgttacggttccgtagggaacgcctacgtcctaccggtaaccgtacggaaaaagtttcgtttcgtacttacgtgggtaccctaggcctacnccgtacccaaacggaaaccccggcccctaagtccctttaccgtacctaagtttaccgtacgttaacgggtaaacgttcgaaacgttcgaccgggtcccggtacccgtttacgggaacggtaccttaccgtacggaacccgttattccggtacgtcggtaccgtacgtacgttaccgtcggtcccttcccgggtcgtccccgttcccggtacgggtaccctaacggttccggaaccgggtttcgggaaccccggttcccggggtacgggtacggtaccggtacggtcggtaaccgtagtaacgtttaccgttactgggttcgtacggttaggtttcgacgtaccgtacccgtacgtcggttaacggtcggttccgggtaccgggttacgggtcgggtaccgggacgtaacggtccgacggtaccggtccggtacctcggtacgtaccgtcgaccgtacgcccgttccggaccccgttntacgtacccgttcgtaccccgtcccttacccg

SEQ ID NO: 83127 - DNA, 871 bp, Homo sapiens
  misc_feature: GYAE6OF01DK5DR.25.23.C01.1.454.CMB.1.raw
  modified_base (122)..(122): a, c, t, g, unknown or other
  misc_feature (122)..(122): n is a, c, g, or t
  modified_base (130)..(130): a, c, t, g, unknown or other
  misc_feature (130)..(130): n is a, c, g, or t
  modified_base (227)..(227): a, c, t, g, unknown or other
  misc_feature (227)..(227): n is a, c, g, or t
  modified_base (334)..(334): a, c, t, g, unknown or other
  misc_feature (334)..(334): n is a, c, g, or t
  modified_base (506)..(506): a, c, t, g, unknown or other
  misc_feature (506)..(506): n is a, c, g, or t
tcagactgtacagtcacgaccggtgctcgatttagtacacgtgattagggattggggagcttcagctgtggtagagaaagacaggattcaggacaatctccagcagtggcccgcctcccctntccctccnccaccctcctcactcactgtcgcgacgggtcctcgggccctagtcgtgtcgctgacctcacgcccacccttaggttcgtccgtccggggaccccggngagggtacggtcctacctacttccttcgtttgttcgacgggacgccacgtccgtaccggtaaacgtaggtaaaagtttacgtttcgtaccttacgtaccggtaaccngcgtaccgcccgtaacccgaaaccggaccccgacccccctaagtcctaccctagtacctagtaaggtaacggatacgaatccggacgccccgtcgtaacggagaccttaccgaccggttacctacttcgtaccgcggtacttacggtcgtagtcccggtacctcccggtacncccgttccacgtctagacccgtggtccgggtacccgtacccggtcgggtaaacgtcggtacggtacggtagttaacgggttacttaaggttcgtacgggtagtacgggtttcgggttaacctgggtaaccctcgggtttaacgttacccgggtgggtttaccgggaccgggtttccggggttaaccgggttaccgggggtaccgggttacccggggggtaacccgggttaaaccgtaaccggggtttaccccggttaccgggaacccccggttttcggttaaacccggggtaccccgggttaaccccgggaaaccccgggtttaacccgggggccccccgttttaaccccggtttccccccgggg

SEQ ID NO: 83128 - DNA, 737 bp, Homo sapiens
  misc_feature: GYAE6OF01AGOLK.25.23.C01.1.454.CMB.1.raw
  modified_base (207)..(207): a, c, t, g, unknown or other
  misc_feature (207)..(207): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtccgtgggcccagtctgtgctgactcacgcccaccctcagtgtccgtcggggacccccgggngaggtacgggtctaccatcttctttgtcgtgggagcacgcctaccggacgtacggtaaattagtttcgtacttaacgtcggtaaccagccacgtccctacccgaaaccggaaaccccggacccccaagtcccttcctactattacctaagtaacgtaatcgactaccgacggcccggtcccgacgaacgggtacctaccgtacgtaccggttacttcctaccggtgtaccgtacggtaacgtcgtcggtccttcccgtcccggtccctccgtcgacctacgtcggtagggtcccgggtccgtccggggacgaggagtcgggacggtacttaagtaactttgtacgtcggtacgtaccggttgggttttacgacgttccggtacgtacggtttcggtacgggtaccgggttccgggttcccggtacgggggtttggtacccggggacgggtaccgaaacgtcggtccgtaccggtaccgtacgtcggacccgacggaccgtcgcccgttccccgcccgttcgccttacccg

SEQ ID NO: 83129 - DNA, 791 bp, Homo sapiens
  misc_feature: GYAE6OF01E1KV6.25.23.C01.1.454.CMB.1.raw
  modified_base (229)..(229): a, c, t, g, unknown or other
  misc_feature (229)..(229): n is a, c, g, or t
  modified_base (725)..(725): a, c, t, g, unknown or other
  misc_feature (725)..(725): n is a, c, g, or t
tcagactgtacagtcacgaccggtgctcgatttagtacacgtgattagggattgggggagcttcagctgtggtagagaagacaggattcgaggacaatctccagcatggccgcctccctctcctcctccaccctcctcacctcacttggtgaccgacgggtccgtcgggacccagtcctgtgctagacctcgagcccacctcgagttcgtcgtcccggggacccccggnaggtcggtcctacctcgttccttcgttgtttccggagggactcctacggtccgtaccgtaacggtaggtaaaatttacggttctacgttacgttcggtaccacgacgtacgtcccgtaccgaaccggaaaccccggcccctaacgtcctaccctactacttacgtaacgtacgggtactacggtacttcgacccggtaccgtcccgtaacggtacggtaacctccgtacgtaacgttccgtttacgtccgtggtaaccgtacggacgttcgtccgtcccgtccggtaccggtccctccgtaccgtcgtaccgtcggtaccgggttccggtccgggtacccgtaacgggtacggtacggtcgtaacgggtaccgttagtaccgttaggtttaccgcgggttagtacgggttggttaccgacggtccgtacgttcggttacgttgggtaaccggttccggtacggttcggggtaccggtacggggaggttaacccggnggtaaccgcggtaaccgcccggttacgtaccgcggtacccgtaccggctaccgtcccccgtaccgg

SEQ ID NO: 83130 - DNA, 825 bp, Homo sapiens
  misc_feature: GYAE6OF01DYCWM.25.23.C01.1.454.CMB.1.raw
  modified_base (142)..(142): a, c, t, g, unknown or other
  misc_feature (142)..(142): n is a, c, g, or t
  modified_base (289)..(289): a, c, t, g, unknown or other
  misc_feature (289)..(289): n is a, c, g, or t
  modified_base (297)..(297): a, c, t, g, unknown or other
  misc_feature (297)..(297): n is a, c, g, or t
  modified_base (369)..(369): a, c, t, g, unknown or other
  misc_feature (369)..(369): n is a, c, g, or t
  modified_base (448)..(448): a, c, t, g, unknown or other
  misc_feature (448)..(448): n is a, c, g, or t
  modified_base (502)..(502): a, c, t, g, unknown or other
  misc_feature (502)..(502): n is a, c, g, or t
  modified_base (697)..(697): a, c, t, g, unknown or other
  misc_feature (697)..(697): n is a, c, g, or t
tcagactgtacagtcacgaccggtgctcgatttagtacacgtgattagggattgggggcagcttcagctgtggtagagaagacaggattcaggacaatctccagcatcggccgcctccctctcctcctcaccctctcactcnctgtgcgtacgggtccgtcggcccagttccgtgtcgctcgaccttcgaccgtccctacccgttgcggtcggtaccggtacccgggggaccccccggagaacggggttaccggtcctaccctgtttccgttaacggttttcgttcggnggggaccncgacggtacccgtccggtaaccggttaacggttaaatttacggttttccgacttaacggtcgggtaaacccngtaccgacgtacccctaacccggaaaccggaaaccccggacccctatacccgtacttacagtttactaaggaacgtagngtacctccggtaacggcccgtaccacggtacgaaccttcccgtacgaaccgttnttccggtacacggggttacctaaggtcggttacccgcggtccccttaaccgggtcccgtaccttccgtgaccctattcggggacgtccgtacccggttccggaaggtccgaggttacgagtttacaacggtttactacgttcgtagggttacgtggtttaaaggttccggaacttcgggacctttaccggggttnaccgggttacggtccgggttcgggtagggttccgtaaccgggggaacgacggtaacccgtgacccgggtttaccggaaacccgtcggtaacgtcccggaccgacccggtttacccggcgttccccccg

SEQ ID NO: 83131 - DNA, 821 bp, Homo sapiens
  misc_feature: GYAE6OF01ATPYB.25.23.C01.1.454.CMB.1.raw
tcagactgtacagtcacgaccggtgctcgatttagtacacgtgattagggattggggagctgtggtagagaagacaggattcaggacaatctccagcatggccggcctccctctccctcctcaccctcctcactcactgtgcgtacgggttcccgtcgggcccctaggttcctggtcgtctcgacctcgaccgtccctaccctctaggttcgttccggtacccggggaccccccggatagggtaccgggttccctaccctagtttccgtttacgtttcggtttccggtagggactaccgtcgacccggttccggtaacgggtaacgttaaaatttacggtttcgttacctaaccggttcggtaaccacgaccgtaacgtcccctaaccgaaaaccggaaccccggacccctacgtccttacctacttacgtactaaggttacgaagttcgtacgtaccgccggtaccccgttcgtacggaacggttaccctaccccggttagtaccgttacgttccgttacgtcggtaccgttaccgtaacgtccgtacgttcccgtaccccgtgtccccgttaacgtcggaacctcgtagtacggttcccgtcccggtaccggaaggtcgttacggtggtacgttacaacggttacttcggttatcgggtacgttaggttacgtcggttacgtcgtacgttcgtagtcggttacggtcggtccgttgggtaccggaccggtacggacgtaaaccgtgtcccgtacggttacctagggtcccgcgaacccggtccgtccgtccctaccccgtaccggcttccgttaccccg

SEQ ID NO: 83132 - DNA, 703 bp, Homo sapiens
  misc_feature: GYAE6OF01ELWJZ.25.23.C01.1.454.CMB.1.raw
  modified_base (163)..(163): a, c, t, g, unknown or other
  misc_feature (163)..(163): n is a, c, g, or t
  modified_base (188)..(188): a, c, t, g, unknown or other
  misc_feature (188)..(188): n is a, c, g, or t
  modified_base (235)..(235): a, c, t, g, unknown or other
  misc_feature (235)..(235): n is a, c, g, or t
  modified_base (398)..(398): a, c, t, g, unknown or other
  misc_feature (398)..(398): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcacgggtcctgggcccngtctgtgctgactcacgccacctcngtgtcgtcgggaccccggagaggtcctcattctcttgttcgtgggancgacgccgtaccggacgtacggtaaaattagtttcgacgttacgttacggtaccagtacacgccctaccgaacggaaaccccggtcccccaagtccctacctactattacgtaagtaaggaactcactcgacggtccgccgtagaggtacctacgacgacgtnttctcgcgtcgtacgtaacgtcgtcggacccttccgtcccgtccctccgacggtcctacgtcggaccggttcggggtccttcccgggtacggagtacgtcggacgtacgttaagtaacgtttagtacgtggtacgtacgttagggttggtaccgtcgtacgttacgttcggtacggtagggtcccgggttacgggtacgggttcgggttaccgggggacggtaacgggaccgtaaggccggtaccggtacccggttacgaccggttaccgaccggaccgtacgggtccctcccgggtaaccccgg

SEQ ID NO: 83133 - DNA, 907 bp, Homo sapiens
  misc_feature: GYAE6OF01CE6PV.25.23.C01.1.454.CMB.1.raw
  modified_base (260)..(260): a, c, t, g, unknown or other
  misc_feature (260)..(260): n is a, c, g, or t
tcagactgtacagtcacgaccggtgctcgatttagtacacgtgattagggattgggggaggagaagacaggattcaggacaatctccagtcatggccgcctcctctcctcctcaccctcctcactcactgtgcgagggtcctggcccagtctggtcgctgactctacgccctaccctgaggttgtccggtccggggacccccgggagtaggtacgggtcctaccgtagttccgttcgtttggttaccggtagggggtacnccgtaccggtcccgtaccggtaaaccggttaccggtaaaacgtttaaggttttcggtaccgttaaccggtacggtaacccgcgaccgtacccgtacccgtaccccggaaaccggaaaccccggtaccccccgaacggttccctacccgttaccgtaaccttccggttaaaccgtaggtaacgtttacgaaccgttccggaccggtaccccgggtacccgtaacgggttagggtaaacccgttacccgttaaccgggtaacccgttacgtttccggttccggtacggttaccggtaacggttaccgttacggttcccgggtacccttccccgggtccgggttacccccttaacccggtcgggttacccgtcgttaaccggggtacgggttcccggggttaccgttaccccggggttacgggacggtacggtacggtacgggtaccgtaacggtaaacgttaacgtttacgtacggttcgttacggttaggttacgggtacgttacgtacggttacggtcgttaacggtcggtacggtaccgggtaccgggtcggtacgggtacggtacggacgtacgtcgtacggccgtacgtcgtacgagaccgtacgccgtccgtcccgtcgtctaccgtcgtccgtcccgtcccg

SEQ ID NO: 83134 - DNA, 777 bp, Homo sapiens
  misc_feature: GYAE6OF01AJGSK.25.23.C01.1.454.CMB.1.raw
  modified_base (580)..(580): a, c, t, g, unknown or other
  misc_feature (580)..(580): n is a, c, g, or t
tcagactgtacagtcacgaccggtgctcgatttagtacacgtgattagggattggggcagcttcagctgtggtagagaagacaggattcaggacaatctccagcagtcggccggcctccctctcctcctcaccctcctcactcactgtcgcgacgggtcctcgggccctagtctgtgctgactcgacgcccaccctcgaggtcgtccggtccggggacccccggtgaggtccggttcctcctacgttccttacgttcggttaccggtggggacgaccgtacgtcccgtccggtaacggttaacggtaaagtttaacggtttcgtaccgtacgtacggtaaccgacgccaccgtcccgtaacccggtaaccggaacccccggacccgtaacgtccctacctacgtacgttacgtaagtaaggacgtacgtagtccgaccggcccggtccgtacggacggtacctaaccgtaccgtacgttactcgtcgtacgtcgtacggtacgtccgccgtccgtaccgtcccggtccctcgaccggctacggtcggtcggtacggtccccggtacgggtcggaggtacncgggtacgtacgtacgtaagtttcgtcgtagtccgttaaggttggtacggtgtaccggtcgtacgttgtagggtcgtacgggtcggttacggggtcggtaccggggaacgggtacgtaccggttacgaccggttacccgggtaccgttaccgggtacggtaccccgaacggacccggtccgtccggtaccccccggg

SEQ ID NO: 83135 - DNA, 774 bp, Homo sapiens
  misc_feature: GYAE6OF01AYE89.25.23.C01.1.454.CMB.1.raw
  modified_base (370)..(370): a, c, t, g, unknown or other
  misc_feature (370)..(370): n is a, c, g, or t
tcagactgtacagtcacgaccggtgctcgatttagtacacgtgattagggattgggggagagaagacaggattcaggacaatctccagcatggccggcctccctctcctcctcaccctcctcactcactgtgcagggtcctgggcccagtctgtgctgactcagcccaccctcagtgtcgtcggggacccccgggcaggagggtcctccatctcttgttcgtgggagcagcctccggacgtacggaaattagtttcgtctacgtggtaccagcacgcctacccaacggaaacccggcccccaagcctcctcacttctaagtaggaatgactcgacggtcccggcctaggacggtactacctcgaaccgtnttccgtcgtggcctacggaacgttccgtcggtccttcccgtccggtcccttacccgtggccctagtccgacgggtccgggtcccgttcccggggtcggaacggtaggtccggagggtccgttaaggtaaacgtttacgttacgttaggtcggtaacggtttagggtttacgggtacgtcccgtcgtaggttcggtagggtacgggttccggggttccgggtaccgggtttcgggtaccggggtacgggggacccgggtaaccgacgggttccggtacccgggtaaccccggttaccggtaccgggtacccgtaaccggccccggttacgggccccgttacccccggtccccggttacccggttacccacccgtttcccgttcccccgttcccccttacccccgg

SEQ ID NO: 83136 - DNA, 927 bp, Homo sapiens
  misc_feature: GYAE6OF01D4PQ1.25.23.C01.1.454.CMB.1.raw
tcagactgtacagtcacgaccggtgctcgatttagtacacgtgattagggattggggagcttcagctgtggtagagaagacaggattcgaaggacaatcctccagcatcggcccgcctccctctcctcctccacccttcctacacctcacgttgtagccgagggtcccgtcgggccctagtctgtgcttcgactcaccgcccctaccctctagttcgtccggtacccggggacccccggacacggtaccggtccctccgtacttccgtttacgttttcggttaccgtggggaaccgccgaccggtaccgtacccgggaacggttaacggtaaaagttttagtttcggttacctacggttacgtaccgacgccgaccgtacccgaaccccgtaaaccggaaaccccggcccccgtaacgccccttacccttactaacgttaccgttaaggaacggttaagtacggtaaccttccgaccggccccggttaccctaaccggggaacggttacctaccgtaccggtaccgtttaaccgttcccgttaacggtccgggtacgttacgtaccgtttcgccggttcccgtcccgtacccgtccccttacggtcgtaccgtacgttaccgtacgggtccggtacccgggtacggtaccggaacggtatcggttaacgtcgtacgtttaacgttactttaaccggtttgtacggtttacgtaggggtttaacgggtttgggtacccgttacgggttacccttgggttaccggtttgttacccgggggttaccggggtaacccgtttggggttacccggggtaacggggtacccggaaaccggggttacctacgggttaaccccggtaccgggtttcccgaaacgggttacccggtaccacccgggttaaccccgtcccgtcccggtaaccccccgg

SEQ ID NO: 83137 - DNA, 860 bp, Homo sapiens
  misc_feature: GYAE6OF01DEG1F.25.23.C01.1.454.CMB.1.raw
  modified_base (188)..(188): a, c, t, g, unknown or other
  misc_feature (188)..(188): n is a, c, g, or t
tcagactgtacagtcacgaccggtgctcgatttagtacacgtgattagggattggggagcttcagctgtggtagagaagacaggattcaggacaaatctccagcatggccgcctccctctcctcctcaccctcctcactcactgtgcgaggtcctgggcccagtctgtcgctgactcacgcccacctnagtcgtccgtccggggacccccggtagaggtacggttcctacctacgttcctttcgtttcgttccgtagggacgcctaacgtcccgtaccggtaacggttacggtaaaagttttaacggtttcgtaccttaccggtacggtaaccgacgtacctaccgtacccgtaaccccgaaacgggtaaaccccccggaccccctaaaggttccccttacccgtaacgttaacgttaccgttaaacggtaacggtaacgttcgaaccttaacccggaccggtccccggtacccgttaacggtaaccgggtaaccttaccgttacgggtaacccttactttccggaccggttcgtaccggttaacgtaaccggttcggtccggttcccgttacccggtccgttccccgttacggttcggaccttacgtacggttacgggtccggtaccggttcccgggacggtagtacgcggtacggttcctaagttaaccgttacgttacgtcgtaaggttacggttacggttcggcttacggaccgttggttccgacgggttacggtaccgggtaccgggttaccggttcgggtaccggggacgttaaccggtaccgtagccggttaacccggtaccggttagtacccggacacccggtaggccccgttacgtcccccgttaacccgg

SEQ ID NO: 83138 - DNA, 815 bp, Homo sapiens
  misc_feature: GYAE6OF01AY2QE.25.23.C01.1.454.CMB.1.raw
  modified_base (578)..(578): a, c, t, g, unknown or other
  misc_feature (578)..(578): n is a, c, g, or t
  modified_base (754)..(754): a, c, t, g, unknown or other
  misc_feature (754)..(754): n is a, c, g, or t
tcagactgtacagtcacgaccggtgctcgatttagtacacgtgattagggattggggagcttcagctgtggtagagaagacaggattcaggacaatctcagcagtcggccggccttccctcctccctcctccaccctccctcacctcacgtgtcgcgtacggtccgtcgggaccacgttctggtcgtctacgactccgacgccctaccctcgagtcggtccgtccgggacccggcgaggacgggtcctccacgttccttgtttcgtcggtaggacgtcgacgtccggtaccggtaaccggtaaacggttaaatttacggtttaccgttaccgttaaccggttacggtaaccgacgtaccggaaccgtacccgtaaccccggtaaacccggaaccccggaaccccctacgtaccctacctacttaacgtactaaaggtaacggtaacttacgaactacggaccggacccgtaccgtacgggtaacgtaccgtaccgtcgaacccttcgtcctaggtcgtacgtaggtacgtcgttccgtaccgtaccggtccgtccccgtcgtcgtccgtacgtccggngggtccggccggtcccggtagacggtacgtaggtacggtacttacgtaacgttacgttggtcgtacggttagggttcgtacggcgttaccggtattaccggtgtagggtccggtacggtacggtacgggttcgggaacgggtccggtaaacgggtcaccgggtaccgttaccgggnggttaaccccgagggtaccccgaaacccggtccggtaccgcccgggtaaccccggtcccgg

SEQ ID NO: 83139 - DNA, 797 bp, Homo sapiens
  misc_feature: GYAE6OF01C8KNC.25.23.C01.1.454.CMB.1.raw
  modified_base (225)..(225): a, c, t, g, unknown or other
  misc_feature (225)..(225): n is a, c, g, or t
tcagactgtacagtcacgaccggtgctcgatttagtacacgtgattagggattgggggggaagctcagcttcagctgtggtagagaagacaggattcaggacaatctccagcatggccggcctccctctcctccctcacccctcctcactcactgtgcgagggtccgtgggcccagtctgtgctgactcacgcccaccctcagtgtccgtccgggacccccgggnaggacgggtcctccattctcgttgttcgtgggagcagcctcgacggtacggaaattaagtttgtacctacgtaggtaaccagctacgcctacccgaaggaaacccgccccgaagccctaccgtacactcgtaagtaagaatgaactcgacgcccgccgtacgacgggtactaccgtacgacccggtactttcgtacgtcggtacctacggtaacgttcgtcgtccgtccccgtccgtccccgttcccgtacggacctacgtacgacgggttccggtacccgtccgggtaccggagggtacttcgggagggtacccttaagttaacgttaactttaccggttggtaaccgttaccgggttaaggggttttcggggacttaccccgggtacttaacggggtccgttacggggtaccggttttaccggggtacccggggttaaggggtttcccggggttaacccggggggtaaccggggaaacccgggttaaacccggaacgggttccgttacccgggtaccccgggtttaacgttcccggggtaaaccgacgggttaccccccggtaaacgggg

SEQ ID NO: 83140 - DNA, 680 bp, Homo sapiens
  misc_feature: GYAE6OF01A6E8H.25.23.C01.1.454.CMB.1.raw
  modified_base (177)..(177): a, c, t, g, unknown or other
  misc_feature (177)..(177): n is a, c, g, or t
  modified_base (198)..(198): a, c, t, g, unknown or other
  misc_feature (198)..(198): n is a, c, g, or t
  modified_base (228)..(228): a, c, t, g, unknown or other
  misc_feature (228)..(228): n is a, c, g, or t
  modified_base (277)..(277): a, c, t, g, unknown or other
  misc_feature (277)..(277): n is a, c, g, or t
  modified_base (318)..(318): a, c, t, g, unknown or other
  misc_feature (318)..(318): n is a, c, g, or t
  modified_base (324)..(324): a, c, t, g, unknown or other
  misc_feature (324)..(324): n is a, c, g, or t
  modified_base (342)..(342): a, c, t, g, unknown or other
  misc_feature (342)..(342): n is a, c, g, or t
  modified_base (494)..(494): a, c, t, g, unknown or other
  misc_feature (494)..(494): n is a, c, g, or t
  modified_base (502)..(502): a, c, t, g, unknown or other
  misc_feature (502)..(502): n is a, c, g, or t
  modified_base (512)..(512): a, c, t, g, unknown or other
  misc_feature (512)..(512): n is a, c, g, or t
  modified_base (544)..(544): a, c, t, g, unknown or other
  misc_feature (544)..(544): n is a, c, g, or t
  modified_base (605)..(605): a, c, t, g, unknown or other
  misc_feature (605)..(605): n is a, c, g, or t
  modified_base (626)..(626): a, c, t, g, unknown or other
  misc_feature (626)..(626): n is a, c, g, or t
tcagactgtacagtcacgaccggtgctcgatttagtacacgtgattagggagttgggagagaagacaggattcaggacaatctccagcatcggccggcctcctctcctcctactaccctcctcactcactgtgcgaggtcctcgggcccagtctgtgactcgactcacgccaccctnagtcgtccgtcgggaccccgnaggacgggtcctccacgtcttcttgttcgnggacgcacgcctccgacgtacgaagttacgttcgtactacgtgaaccgngccacgtcctacccaaggaaacccgccccaagtccctaccnctactntaacgtaggaactcgtanccgacggccgaccgtcgtagggacttaccgtacggaaccttcgttctcgtccggtacttaccggaacgttccggtcgttaaccgttcccggtccgtaaccggtccggtacgtaccgtattccggagttcccgggaaccgttcggggtaccgnggtaacgnggtaccggtnacgtaaactgttaccgtggtacgactttgggnggtaacttcgccgattcgagtcggttacggtcgtaccggttgggcggtacggacgacgcgngttaccggtacgcgtaccggntacgccgtggacccttccggccctcggtccgttacttccgccccgtcccggtcc

SEQ ID NO: 83141 - DNA, 888 bp, Homo sapiens
  misc_feature: GYAE6OF01BFFMB.25.23.C01.1.454.CMB.1.raw
  modified_base (216)..(216): a, c, t, g, unknown or other
  misc_feature (216)..(216): n is a, c, g, or t
  modified_base (458)..(458): a, c, t, g, unknown or other
  misc_feature (458)..(458): n is a, c, g, or t
tcagactgtacagtcacgaccggtgctcgatttagtacacgtgattagggattggggagcttcagctgtggtagagaagacaggattcaggacaatctcagcatggccggcctccctctcctcctccaccctcctcactcactgtgcagggtcctgggcccagtctgtgcttgactcacgcccacctcaggtcgtcgtccgggggaccccccgggngaacggacgggttcctaccctacttccttcgtttggttccgtagggacgtcagtccgtccggacgttacggaaattaacgtttgtactaccgttcggtaacccagccaacgtccctaccccgaaacggaaaccccggccccctaacggtccttcccgtactagttaccttaagtaaggtactgactaccgacggtcccgggtaccctacgggtacgggtaacctaccggtcgtaaccgtttnttcccgttcgtcgggtaccgtaaccgtaagttcccgggttcgtcccggttcccggttcccggtcccccgttacccgtccgggaccctacgttaccggtcggggttccgggtcccggttcccgggtacggaacgggtcggtacggacgggtcgttaaccgtaagttaccgtttcggttacgtccgggtagtttaccggggtttggtaccgtttacgggaacccgtttcgggtccgttggggttaacggggttcccgggttaccgggggttaccgggttcggggtacccggggtaaacgggggttaccccggaaacgggtttacggtaccggttaccccggggtaacccggttttccgggtaaccgggtccccgtaaaccgggtccccccggtaaacgggttcccccgtccccccgggggtttacccccccg

SEQ ID NO: 83142 - DNA, 851 bp, Homo sapiens
  misc_feature: GYAE6OF01CAFUU.25.23.C01.1.454.CMB.1.raw
  modified_base (207)..(207): a, c, t, g, unknown or other
  misc_feature (207)..(207): n is a, c, g, or t
  modified_base (238)..(238): a, c, t, g, unknown or other
  misc_feature (238)..(238): n is a, c, g, or t
  modified_base (244)..(244): a, c, t, g, unknown or other
  misc_feature (244)..(244): n is a, c, g, or t
  modified_base (360)..(360): a, c, t, g, unknown or other
  misc_feature (360)..(360): n is a, c, g, or t
tcagactgtacagtcacgaccggtgctcgatttagtacacgtgattagggattggggagctgtggtagagaagacaggattcaggacaatctccagcatggccggcctcctctcctcctcaccctcctcactcactgtgcgagggtctcgggcccagtctgtgctgactcacgcccacctgaggtcgtcgtccggggacccccgggnaagggtcggtcctcatccttcttcggttcgngggacncgacgtccgtaccgtaacggtaacggtaaatttaaggtttcgtaccgttacgttacggaccaaggtccacgcccgtaacccgaaacggtaaaccccgaccccaagtcccttacctntacttacgtaaggtaaacgatacggactaccggcggtacccggtaccgtacgggaaaccgggttactaaccccgttacgggtaacccgttagttccgtcggtaacggtccgtaacggtacgttcgtaccgggtcccttccggtcccgtccgttccgccggtacctacgtcggtacgggtccgggtcccggttacgggacgtaaggtcggacgttacgggacttaagtaaactttcgtacggttcggtacggtcgtttagggtttacgagtttccgaccgtacggttacgggtgtttaaccggggtaccgggtttaccggggtcggtttccgggggtaaacggggaacccggttaacgggtaaccctacgggttacccgggtaccggttaccccgggttaacggtaacggtaccccggtaaccggacccgggttaccccggcccgggttaaacccccgttcccccggggttcgttaacccccggtttcccgg

SEQ ID NO: 83143 - DNA, 911 bp, Homo sapiens
  misc_feature: GYAE6OF01EEABI.25.23.C01.1.454.CMB.1.raw
  modified_base (214)..(214): a, c, t, g, unknown or other
  misc_feature (214)..(214): n is a, c, g, or t
  modified_base (252)..(252): a, c, t, g, unknown or other
  misc_feature (252)..(252): n is a, c, g, or t
tcagactgtacagtcacgaccggtgctcgatttagtacacgtgattagggattggggagctgtggtagagaagacaggattcaggacaatctccagcatggccggcctccctctcctcctccaccctcctcactcactgtgcgagggtccgtcgggcccagtcgtgtgctagacctcacgcccaccctcaggtcgtccgtccgggacccccggnacggcgggtcctccattcttcgtttcgttcgtaggggnaccgagtcccgttaccggaacgggttaccggtaaaagttttaacgttttcgtaccgttaccgttaacggtaaccgacgtcacgtccctaacccgaaccggaaaccccggtaccccaacgtccctccttacacttacgtaagtaacggaatgaacgtcgaccggcccgtcccgtacgtaacggtaccttaccgtaaccgtacgttacctttcctacggttcggtaccgttacgtaacgttcggttacccgtccggttccccgtaccccggttccccttcccccggtaacgtcccgtaacggttacggtacgggtccgggttccccgggttacccgggtaccgggtaaggtccgtacgggaaaccgggtcgttacggtaaccttttagttccgttagggtaccggttcgggtttaacgggtttcgggaccgttcggacccggttaggttacggttaaccgggttcggggttacccggggttcccgggtaacggggtttccggggttaccgggaaccggggttaaacgggtaccgtaccgggttaccggtaacccggttacccggggttaaccggtaccggttacccgggaacccgttaacccgggacccggtttaccccggttccccccggttccccgggtactttcccccggttccccgg

SEQ ID NO: 83144 - DNA, 184 bp, Homo sapiens
  misc_feature: GYAE6OF01AOUQY.25.23.C01.1.454.CMB.1.raw
  modified_base (176)..(184): a, c, t, g, unknown or other
  misc_feature (176)..(184): n is a, c, g, or t
tcagactgtacagtcacgaccggtgctcgatttagtacacgtgattagggagttggggggaagaggaagactgacggtcaccccaggagttcaggtgctgggcacagcggccctgggctgcctggtcaaggctacttccactgtacagtctgagcgggtctggcaaggcgcatagnnnnnnnnn

SEQ ID NO: 83145 - DNA, 776 bp, Homo sapiens
  misc_feature: GYAE6OF01BWJTP.25.23.C01.1.454.CMB.1.raw
  modified_base (179)..(179): a, c, t, g, unknown or other
  misc_feature (179)..(179): n is a, c, g, or t
  modified_base (271)..(271): a, c, t, g, unknown or other
  misc_feature (271)..(271): n is a, c, g, or t
  modified_base (372)..(372): a, c, t, g, unknown or other
  misc_feature (372)..(372): n is a, c, g, or t
  modified_base (619)..(619): a, c, t, g, unknown or other
  misc_feature (619)..(619): n is a, c, g, or t
  modified_base (679)..(679): a, c, t, g, unknown or other
  misc_feature (679)..(679): n is a, c, g, or t
tcagactgtacagtcacgaccggtgctcgatttagtacacgtgattagggattgggggagcttcagctgtgttagagaagacaggattcaggacaatctccagcatggcccgctccctctcctctccaccctcctcactcactgtgcacgggtcctgggcccagtctgtgctgacctcncgcccaccctcagttgtcgtcggggaccttccgtgggacctaggtccggtacacctatccttcctagccacgtcggaaccgacgccggttanacgtagttggtcgtacttaataactatgtcctccgttcggacccaacaaccgacccgaggtaaccgaacccggtacccctaaactctactacttatttacngtactgtacctacgtacgtacccggtcccggtacccgtcggttaggtttaaccggttttcggtaccggggtttcccttccgttttccgtccgttaccgggtccctttaaccgtaacggtttcgtaccggtaccgtacccggttcccgggcccccttccgtaccgtacccttcggtacccggttcggggaccctcccggacggttccgtagggacccgagtacgggttacctttacgtttaacgtttntccgtactttaacgttacctagtaaccgagtaacaccctaaacctggtaccgttttcggnggggttcccggtacgggggtacggtaacgggtaccgtaccggttacccgggtaccgttccgtacgggtacccgtacggaacccggtagttcccccgg

SEQ ID NO: 83146 - DNA, 814 bp, Homo sapiens
  misc_feature: GYAE6OF01A4N2S.25.23.C01.1.454.CMB.1.raw
  modified_base (185)..(185): a, c, t, g, unknown or other
  misc_feature (185)..(185): n is a, c, g, or t
  modified_base (251)..(251): a, c, t, g, unknown or other
  misc_feature (251)..(251): n is a, c, g, or t
tcagactgtacagtcacgaccggtgctcgatttagtacacgtgattagggattggggagagaagacaggattcaggacaatctccagcatggccggcctccctctcctcctcaccctcctccactccactgtcgccgagggtcctcgggccctagtcctgtcgcgtcgactcgacgcctaccctnacgtcgtccgtccggggaccccggtcacgggtcgggtccttccgattcgttccgttgtcgtgggcncgacgtccgtaccgtacggtacggtaaaacttcggtttcgccttacgtacggtacccgtagacgtaccgccgtacccgaacgggaaaccccgacccgaactccgtaccctacacttaccgtaaggtacgtaacgttaccgaattcccggaacggttcccggaccctaacggagggtaacccttacccgtaccggtaccgggtaactttccggtcgtaccggtaccgtaacggaaccgtttcggaacgtccgttcccggacccgttacccgtccggttcgaccctaggtcccggttggtcccggaccggttacccgggttaccggaggttaccggtaggtaacgggtacttaccgttaagttaccgtttacgtcggtaacgttcgtttaagggttacgtacgtccggtacgtcggtagttacggtcggttaccggtcgggtaccggtcggttacgggcggtaaccggacgtacggtcgtaccgaccggttccggacggtccggacgccggtaaccgtcgacccggtcccgtaccgtcctacgtccccgtccgtcccgttacccg

SEQ ID NO: 83147 - DNA, 768 bp, Homo sapiens
  misc_feature: GYAE6OF01CWGK1.25.23.C01.1.454.CMB.1.raw
  modified_base (214)..(214): a, c, t, g, unknown or other
  misc_feature (214)..(214): n is a, c, g, or t
  modified_base (259)..(259): a, c, t, g, unknown or other
  misc_feature (259)..(259): n is a, c, g, or t
  modified_base (546)..(546): a, c, t, g, unknown or other
  misc_feature (546)..(546): n is a, c, g, or t
  modified_base (555)..(555): a, c, t, g, unknown or other
  misc_feature (555)..(555): n is a, c, g, or t
tcagactgtacagtcacgaccggtgctcgatttagtacacgtgattagggattggggagcttcagctgtggtagagaagacaggattcaggacaatctccagcatggccgcctccctctcctcctcaccctcctcactcactgtgcacgggtcctgggcccagtctgtgctgactcacgcccaccctcagtcgtcgtaccggggacccccgganaggtacggtcctccgtattccgttcgtttcgttccgtaggggacncgacgtaccgtaccggtacggtacggaaaatttacggttttcgtacttacgtacggacaggaccaacgtcccgtacccgaaacggtaaccccggacccccaaggtccctcctactacgttactaagtacggtaatacgactaccgacggtccccgaccgtacggaacggtacttacccgtacgtaaccgtactttcgtacgtcggctttacggacgtccgtcggtctcccggtccgtcctccgtacgcctagtcgacgggttcggccgtaccgtcggaacggtacgnggtaccgtnttaacgtaaacttagtttacgcggtaccggttagttacgggttacggtaccgtacgtcccgttaggttacgtaccgggtttcggttaccgggtccgggttaacgggttcggtccggggaacggtaaccgggacgtaagtcccgggttaaccgtcccggttagtaccggtaccgaacccgggtcctaaccggtccccgtacccggttcccccgg

SEQ ID NO: 83148 - DNA, 945 bp, Homo sapiens
  misc_feature: GYAE6OF01AIYO2.25.23.C01.1.454.CMB.1.raw
  modified_base (213)..(213): a, c, t, g, unknown or other
  misc_feature (213)..(213): n is a, c, g, or t
  modified_base (249)..(249): a, c, t, g, unknown or other
  misc_feature (249)..(249): n is a, c, g, or t
tcagactgtacagtcacgaccggtgctcgatttagtacacgtgattagggattgggggagcttcagctgtggtagagaagacaggattcaggacaatctccagcatggccggcctccctctcctcctcaccctcctcactcactgtgcagggtcctgggcccagtctgtgctgactcacgcccaccctcagtcgtcgtcggggacccccgggnacggagggtcctccacttctcgtttgttcgtgggancagccgtccggacgtacggtaaaattacgtttcgactacgtcggtaaccaggcacgtcctacccgaacggaaaccccggcccccaaaggcccttaccctacgacttaccgttaaaggtaacggtaaatttcggaacttaccggaaccgggccccggtaccccgttacggaacgggtaccttaacccggtacggtaacccgttactttcccgtacggttacgggtacccgttaacggtaacggttccgtaccgggtccccttccccggtcccggtccccttacccgggtccgggtaacccctacggtaccgtacggggttcccggggtaccccgttacccgggggtaacccggaagggtacggttacgggaacccgggttaccgttaaacggttaaacgttttaccgttttaaccggtcggggtttaccggtaccgggttttaacggggttttcggggaacctttacccgggtacccgttaacgggtttaccggttacggggttacggggtttaccccgggttaacccgggggtttacgggggttccgggttaacccgggggaaccggggtaaccgggtaaacccgtagggtacccgttaacccggggtaccccgtttaacgggttacccgggtacccggtaaccccggaaccccggttaacccggggtccccgtttccccccgggtaaccccccgg

SEQ ID NO: 83149 - DNA, 748 bp, Homo sapiens
  misc_feature: GYAE6OF01BZPQY.25.23.C01.1.454.CMB.1.raw
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
  modified_base (261)..(261): a, c, t, g, unknown or other
  misc_feature (261)..(261): n is a, c, g, or t
tcagactgtacagtcacgaccggtgctcgatttagtacacgtgattagggattggggacgcttcagctgtggtagagaagacaggattcaggacaactctccagcagtggccggcctccctctcctcctcaccctcctcactcactgtgcgagggtcctggcccagtctgtgctgactcagcccaccgtnagtgtccgtacggggacccccggngacggtacgggtcctacctacttccgttcgttcgttcggagggtacncgacgtccgtaccggagttacggaaattacggttttactccgttaacgttaccgggtaaccacgtaccgtacggtccctaaccccggaaaccggaaaacccccggaccccctaaggtccccttaccgtaactacgttacttaaacggtaaggaaacttcgaactaccgacggcccgtaccgtacgtacggtacctaacgcgtaaccgtacttccgtcgacggtactacggtacgtccgtacgcctccggtcccgtcccttacggcgtactcggtacgcgggtcggtcctaccggacggtcgtatgggaccgtcgaagttaacttagtcgtcggtgtacgtcgggttagacctacgagtgtacgcgttcgggtcgtacgggtcggttcgggtacggagggtaaccggaccgtaaggtccccggtacgtacccggtacggtacgaaccgtaccgggaccctcgggttaccccgcccgggtaaacccccg

SEQ ID NO: 83150 - DNA, 764 bp, Homo sapiens
  misc_feature: GYAE6OF01D50JS.25.23.C01.1.454.CMB.1.raw
  modified_base (174)..(174): a, c, t, g, unknown or other
  misc_feature (174)..(174): n is a, c, g, or t
  modified_base (208)..(208): a, c, t, g, unknown or other
  misc_feature (208)..(208): n is a, c, g, or t
  modified_base (249)..(249): a, c, t, g, unknown or other
  misc_feature (249)..(249): n is a, c, g, or t
  modified_base (309)..(309): a, c, t, g, unknown or other
  misc_feature (309)..(309): n is a, c, g, or t
  modified_base (425)..(425): a, c, t, g, unknown or other
  misc_feature (425)..(425): n is a, c, g, or t
tcagactgtacagtcacgaccggtgctcgatttagtacacgtgattagggattggggagctgtggtagagaagacaggattcaggacaatctccagcatggccggcctccctcctcctcctcacccctcctcactcactgtgcagggtcctggcccagtctgtgctgactcacncccaccctcgagtcgtcgtccggggacccccggngaggtacgggtcctacctattcttccgttgttaccgagggnaccacggtcctaccggtacggttaacggtaaatttagtttcgtacttacgtcggtaaccngaccacggtccctacccgaaacgaaccccggcccccaagtcctacccgtactatacttaagtaacggaattcgaactcgaccggccgtccgtaggacggtaactccgcgtaccgtnttccgcgtacggactacgtacgtcgtccgtccgtcccgtacccggtccttaccgtcgctacgtcgggttacggccggtacccggtccgggtaccggaggtacgtacggacgtacgtagttaacgtttgtttaccggtggtttacggtcgtttaacgggttcggtcctacggcgtttaggtcggtaggtacggtttacgggtcgggttcgggttccgggtacggggaccggtaagggacccgtacgggtaccgtacccgggtaccgttcggtaccggtaccggacccgtccggtaaccgtccccgtaacccggttcccccggtcgttcccgttaccccgg

SEQ ID NO: 83151 - DNA, 820 bp, Homo sapiens
  misc_feature: GYAE6OF01AJSRA.25.23.C01.1.454.CMB.1.raw
  modified_base (191)..(191): a, c, t, g, unknown or other
  misc_feature (191)..(191): n is a, c, g, or t
  modified_base (503)..(503): a, c, t, g, unknown or other
  misc_feature (503)..(503): n is a, c, g, or t
tcagactgtacagtcacgaccggtgctcgatttagtacacgtgattagggattggggagagaagacgaggattcaggacaatctccagcatgccgcctcctctcctcctcaccctcctcactcactgtgcgacgggttcctcggggccctaggtcctggttcgtcgtaggtacctcgacgccctacccctntaggtcgtcccggtaccggggcccccggcgtaggacggtcctcgacttcttacgttgtttcgaggacgcacggtcctaccggtacggtaaccggaaaagtttaacgttttcgtacgtaccgttacggaacccgacgaccgaacggtacccgtaaccgaaaccggtaaaccccggaccccctaaacggtcccttacctacggtacttacttaaacgtaagggtaactacggtaactacgacgtcccggaccgtagacgaccgtacctaacggactacgttcgtagtcgtacggacgtaacgtcgtacggtccnccgtccggccctacgtcgacctagtacgcggtcggtccgtaaccggcaaggtacgaggtacgtacgttaagtaagttagtaccggtagtccgttacggttaaagggtttccgagttccgtaacccgagttaacggtcggtaagttccggggttaacccggttagggttcgggtaacgggcggtaaaccggacggttaacgtccggaacgggtttaccgaaccggtttaggaaccggttacccgtaaccggtcccggtccgccccgttaccccgacggttaccttacccggttacccgtcccgggtttcccccgaccc

SEQ ID NO: 83152 - DNA, 846 bp, Homo sapiens
  misc_feature: GYAE6OF01CN6VN.25.23.C01.1.454.CMB.1.raw
  modified_base (272)..(272): a, c, t, g, unknown or other
  misc_feature (272)..(272): n is a, c, g, or t
tcagactgtacagtcacgaccggtgctcgatttagtacacgtgattagggattggggagggcgtttgttggagaccctgtccctcacctgcagtgtctctggtggctccgtcagtgcttattacgtggagcgtggagtccgccgagtccgccggggagggactggagtggattgggctatatatacgaatggaacttaccacctaccaacccctcctcaagagtcgagtccacatatcaggtcgacacgtccagggatcgtaggtcgttccngactacttcgtacgtacgttcgtcggaccgacgtccggcccggacccggtaacccgtacccggttaccccttaagttaacccttaacggttcggttccgacccgtaaggtacgtaccgttaccggtaccgtcggaccggttaacgtttacgtttttacgggaaactttaagttttacgtttactttcggttttaggttcggttaccttttaggaaccttggtacgggtacggggtaccgtaaacgggtaccggtaccggtaccctacccggtttcctacgtacccgtacggtaccccgtacccgaaccggtaacccggtccgtaaccggttcccggtaccccgttcccccggtgacccccgttacccgttccctaaccgtaacgccgttacccgcggtttaccgggacgggggaccctaccgggacggtcccgggtaacccggttcgggtccgttaaccgggtccgttacggtaaaccggaacgttacccggtttaaccgtacccgaacggtttcggaaccgttggttaccggttacggggaccgtccggggaacgttccggggaacgaccggg

SEQ ID NO: 83153 - DNA, 800 bp, Homo sapiens
  misc_feature: GYAE6OF01AQHJO.25.23.C01.1.454.CMB.1.raw
  modified_base (214)..(214): a, c, t, g, unknown or other
  misc_feature (214)..(214): n is a, c, g, or t
  modified_base (224)..(224): a, c, t, g, unknown or other
  misc_feature (224)..(224): n is a, c, g, or t
  modified_base (243)..(243): a, c, t, g, unknown or other
  misc_feature (243)..(243): n is a, c, g, or t
  modified_base (249)..(249): a, c, t, g, unknown or other
  misc_feature (249)..(249): n is a, c, g, or t
  modified_base (339)..(339): a, c, t, g, unknown or other
  misc_feature (339)..(339): n is a, c, g, or t
  modified_base (551)..(551): a, c, t, g, unknown or other
  misc_feature (551)..(551): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcgagggtcctgggcccagtctgtcgctgactcacgtccaaccctcagttcgtcgtccgggaccccggnaggacggtcncctactcttcttcgttcgngggacncacgcctccgacggtacggaaattagtttcgtacgtacgtacggtaccagccacgcccgtaccgaacggtaacccgccccaagtcctccnctactctagtagaactgtactcgacggtcccgtaccgtcgtaacgggtaacctccgtaacgtaaccgttcgttaccgttccgacgggtcccgtaaccggtaacggttcctaccgggttcccgttacccggttccccggtaccccttcccgggttccgaccgttactacggttacccggggtcggtacccgggttaccgggcgtaacggggtntaacgggacggtcctaagttaacttaacgtttacgtcggtagttacggtttaacgggtgttaccgtggaacccgttggttcgttacgggaccggtttcggggtacccggtttaggggttccggggttaacccgggaccggggaaccgggttaaacctacgggtccggttacccgggtaaccggttcccggtaaagggtccccctaagggaccccccggtaacggtccccgttaccccggtacccccggg

SEQ ID NO: 83154 - DNA, 707 bp, Homo sapiens
  misc_feature: GYAE6OF01DOJF0.25.23.C01.1.454.CMB.1.raw
  modified_base (174)..(174): a, c, t, g, unknown or other
  misc_feature (174)..(174): n is a, c, g, or t
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
tcagactgtacagtcacgaccggtgctcgatttagtacacgtgattagggattgggggagctgtggtagagaagacaggattcaggacaatctccagcatggccggcctccctctcctcctcaccctcctcactcactgtgcgagggtcctgggcccagtctgtgctgactcancccaccctgagtgtccgtcggggacccccggnaggcggtcncctatctcgtttgtcgtgggagcacgcctccggacgttacggaaattagtttcgatactggtaccagcacgcctacccgaacggaaaccggacccccaagtcctcctctatactaagtaaggaatagactcgacgcccggtaccctacggaagggtacctaaccgtcgaaccgtacttccgtacgtcggtacgtacggtaacgttcgtccggtcccgttcccctcccgggttcccctcccggttcggaccgtacgtcgtcgggtaccgggtccccgtacccgggtcggaacggtacgtgggacggtactagtaacttagttacgttgtacgtgttacggtttggtacgtcgaccgtgttacgtgggtacggtcggttcggtcggttcgggtcgggaacgggacggactacggtacggtaccggtacccggttacgtacggccgaccggacccgtagtcccgtacccggtcccccggttagtcccgttacccg

SEQ ID NO: 83155 - DNA, 175 bp, Homo sapiens
  misc_feature: GYAE6OF02H7Y5S.25.23.C01.1.454.CMB.1.raw
  modified_base (173)..(175): a, c, t, g, unknown or other
  misc_feature (173)..(175): n is a, c, g, or t
tcagactgtacagtcacgaccggtgctcgatttagtacacgtgattagggattgggggaagaggaagactgacggtcccccaggagttcaggtgctgggcacagcggccctgggctgcctggtcaaggactacttccactgtacagtctgagcgggctggcaaggcgcatagnnn

SEQ ID NO: 83156 - DNA, 225 bp, Homo sapiens
  misc_feature: GYAE6OF02I63VI.25.23.C01.1.454.CMB.1.raw
  modified_base (221)..(225): a, c, t, g, unknown or other
  misc_feature (221)..(225): n is a, c, g, or t
tcagactgtacagtcacgaccggtgctcgatttagtacacgtgattagggattgggggaagaggaagactgacggtcccccaggagttcaggtgctgggcaccttgggcacgggggaggtgtgtcacaagatttgggctctgggcacagcggccctgggctgcccgtgagacgtacttcctactgtacagtctgagcgggcgtggcgaaggacggcatagnnnnn

SEQ ID NO: 83157 - DNA, 517 bp, Homo sapiens
  misc_feature: GYAE6OF02GTS07.25.23.C01.1.454.CMB.1.raw
  modified_base (191)..(191): a, c, t, g, unknown or other
  misc_feature (191)..(191): n is a, c, g, or t
  modified_base (333)..(333): a, c, t, g, unknown or other
  misc_feature (333)..(333): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggagcagctccgacgtcggaaatagtttgctactggtaccagcagctcccagaaacggcccccaagctcctcatctataggaatgatcagcggccctcagggatacctgaccgattcnctggctcgaagtctggctcctcggcctccctggccatcagtgggctccggtccgaggatgaggctgaatattactgtgctagtttgggatgccagtctgagtggtccgacggtgttcggcggagggaccaagctgaccgtctaggtcagcccaaggctgcccctcggtcactctcgtcccaccc

SEQ ID NO: 83158 - DNA, 524 bp, Homo sapiens
  misc_feature: GYAE6OF02I3YJB.25.23.C01.1.454.CMB.1.raw
  modified_base (206)..(206): a, c, t, g, unknown or other
  misc_feature (206)..(206): n is a, c, g, or t
  modified_base (234)..(234): a, c, t, g, unknown or other
  misc_feature (234)..(234): n is a, c, g, or t
  modified_base (329)..(329): a, c, t, g, unknown or other
  misc_feature (329)..(329): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggancagctccgacgtcggaaataagtttgtctactggtaccagcagctcccagaaacggccccaagctcctcatctataggaatgatcagcggccctnagggatacctgaccgattctctggctcgaagtctggctcctcggcctccctggccatcagtgggctccggtcgaggatgaggctagaatattactgtgcagtttggatgccagtctgagtggtccgacggtgttcggcggagggaccaaggctggacccgtccgtaggtccaggcccgaaggtcctcgtcccccg

SEQ ID NO: 83159 - DNA, 524 bp, Homo sapiens
  misc_feature: GYAE6OF02HD2RE.25.23.C01.1.454.CMB.1.raw
  modified_base (207)..(207): a, c, t, g, unknown or other
  misc_feature (207)..(207): n is a, c, g, or t
  modified_base (330)..(330): a, c, t, g, unknown or other
  misc_feature (330)..(330): n is a, c, g, or t
tcagactgtacagtcacgaccggtgctcgatttagtacacgtgattagggattggggcagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggagcagctccgacgtcggaaataagtttgtctactggtaccagcagctcccagaaacggccccaagctcctcatctataggaatgatcagcggccctnagggatacctgaccgattctctggctcgaagtctggcctcctcggccctccctggccatcaggtgggctccggtccgaggatgaggctgaattattactgtgctaggtttgggatgccagtctgagtggtccgacggttgttcggcggtagggaccaaggctcgaccgtcgtaggtcacggcccaggcctccgg

SEQ ID NO: 83160 - DNA, 504 bp, Homo sapiens
  misc_feature: GYAE6OF02J18WS.25.23.C01.1.454.CMB.1.raw
  modified_base (191)..(191): a, c, t, g, unknown or other
  misc_feature (191)..(191): n is a, c, g, or t
  modified_base (471)..(471): a, c, t, g, unknown or other
  misc_feature (471)..(471): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggagcagctccgacgtcggaaatagtttgctactggtaccagcagctcccagaaacggcccccaagctcctcatctataggaatgatcagcggccctcagggatacctgaccgattctctggctcgaagtctggctcctcggcctcctggccatcagtgggctccggtcgaggatgaggctgaatattactgtgcagtttgggatgccagtctgagtggtccgagtgttcggcgaggacagctgaccgtcaggtcngcccaggctgcccctggcactctcgtcccaccc

SEQ ID NO: 83161 - DNA, 166 bp, Homo sapiens
  misc_feature: GYAE6OF02IDCKD.25.23.C01.1.454.CMB.1.raw
  modified_base (158)..(166): a, c, t, g, unknown or other
  misc_feature (158)..(166): n is a, c, g, or t
tcagactgtacagtcacgaccggtgctcgatttagtacacgtgattagggattgggaccaaggtcaccgtcctaggtcagcccaaggccaaccccactgtccactctgttcccaccctcctcactgtacagtctgagcgggctggcaaggcgcatagnnnnnnnnn

SEQ ID NO: 83162 - DNA, 184 bp, Homo sapiens
  misc_feature: GYAE6OF02GJVBD.25.23.C01.1.454.CMB.1.raw
  modified_base (173)..(184): a, c, t, g, unknown or other
  misc_feature (173)..(184): n is a, c, g, or t
tcagactgtacagtcacgaccggtgctcgatttagtacacgtgattagggattgggggaagaggaagactgacggtcccccaggagttcaggtgctgggcacagcggccctgggctgcctggtcaaggactacttccactgtacagtctgagcgggctggcaaggcgcatagnnnnnnnnnnnn

SEQ ID NO: 83163 - DNA, 522 bp, Homo sapiens
  misc_feature: GYAE6OF02IF858.25.23.C01.1.454.CMB.1.raw
  modified_base (191)..(191): a, c, t, g, unknown or other
  misc_feature (191)..(191): n is a, c, g, or t
  modified_base (219)..(219): a, c, t, g, unknown or other
  misc_feature (219)..(219): n is a, c, g, or t
  modified_base (342)..(342): a, c, t, g, unknown or other
  misc_feature (342)..(342): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggancagctccgacgtcggaaataagtttgctactggtaccagcagctcccagaaacggcccccaagctcctcatctataggaatgatcagcggccctcagggatacctgaccgattctctggttcncgaagtctggctcctcggcctccctggccatcagtcgggctccggtccgaggatggaggctgaatattactgtgctagtttgggatgcagtctgagtggtccgaggttgttcggcggaggaccaagctgaccgtctaggtcagcccaaggcctcgcccctggtccactctcgtcccaccc

SEQ ID NO: 83164 - DNA, 519 bp, Homo sapiens
  misc_feature: GYAE6OF02GBX0A.25.23.C01.1.454.CMB.1.raw
  modified_base (191)..(191): a, c, t, g, unknown or other
  misc_feature (191)..(191): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggagcagctccgacgtcggaaataagtttgtctactggtaccagcagctcccagaaacggcccccaagctcctcatctataggaatgatcagcggccctcagggatacctgaccgattctctggctcgaagtctggctcctcggcctccctggccatcagtgggctccggtccgaggatgaggctgaatattactgtgctagtttggatgcagtctgagtggtccgacggtgttcggcggagggaccaagctgaccgtctaggtcagcccaaggctcgcccctggtccactctcgtccctaccc

SEQ ID NO: 83165 - DNA, 630 bp, Homo sapiens
  misc_feature: GYAE6OF02G3RSS.25.23.C01.1.454.CMB.1.raw
  modified_base (211)..(211): a, c, t, g, unknown or other
  misc_feature (211)..(211): n is a, c, g, or t
  modified_base (240)..(240): a, c, t, g, unknown or other
  misc_feature (240)..(240): n is a, c, g, or t
tcagactgtacagtcacgaccggtgctcgatttagtacacgtgattagggattggggagcttcagctgttggtaggagaaggacaggattcaggacgaatctccagcaatggccggcctccctctcctcctcaccctcctcactcactgtgcagggtcctgggcccagtctgtgctgactcgagccaccctcagtgtctgggaccccgggnaggacggtctccatctcttgtctgggacncagcctccgacgtcgaaactagttcgctactggtaccagcagctcccagaaccggccccaagctcctcagtctatacggatgatcacgtccggccctcgagggtactaccgtgaccggtatttccgtcgtcggacgtcgaagtctgggcctccgtcggccctcccgtggccatcgagtcgggcctccgggtccgaggatggaggctagaattattacgtgtgcgtaggtttgggatcggacctagttcgtgtacgggttcggtaccgggtagggttcggttccggggacgggtacggggaacccaagggtccgtacgggtaccccggttccggttaacggggttcccgaccggtaccccggaacgggtcccgtacccgggtcccccccgg

SEQ ID NO: 83166 - DNA, 660 bp, Homo sapiens
  misc_feature: GYAE6OF02IXU1K.25.23.C01.1.454.CMB.1.raw
  modified_base (137)..(137): a, c, t, g, unknown or other
  misc_feature (137)..(137): n is a, c, g, or t
  modified_base (141)..(141): a, c, t, g, unknown or other
  misc_feature (141)..(141): n is a, c, g, or t
  modified_base (192)..(192): a, c, t, g, unknown or other
  misc_feature (192)..(192): n is a, c, g, or t
  modified_base (202)..(202): a, c, t, g, unknown or other
  misc_feature (202)..(202): n is a, c, g, or t
  modified_base (205)..(205): a, c, t, g, unknown or other
  misc_feature (205)..(205): n is a, c, g, or t
  modified_base (222)..(222): a, c, t, g, unknown or other
  misc_feature (222)..(222): n is a, c, g, or t
  modified_base (228)..(228): a, c, t, g, unknown or other
  misc_feature (228)..(228): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcacngtcncaggtccgtcggccgagtacgtcgtcgactggctcagccacctcagtgtcnggaccccggnagngtctcatctcttgtcgnggagcncgctcgacgtacgtaagtagttgtctacgtcgtacacgcacgctccacgaacgacccacgctctcactctagtagatagactcgacgcgccgtcgacgacgtacgtacgtacgtactctcgtcgtcgtacgtacgtcgtcgtcgtccgtccgccgtccgtccgtccgtacgtacgtacggtcggtccggtccggtccggtacggtacgtacggtacggtacgtacgtaacgttaacgttacgttacgtacgtacgtacggttacggtacgtacgtaccgtacgttcgtacgtacggtacggttacgggttacgggttacggttacgggtacgggtaccgggaccgtacggtaccggtacggtaccggtaccggtacggtaccgtaccggtaccgaccggtaccgtacccggtcccggtacccgtccgtaccg

SEQ ID NO: 83167 - DNA, 507 bp, Homo sapiens
  misc_feature: GYAE6OF02HI9P3.25.23.C01.1.454.CMB.1.raw
  modified_base (448)..(448): a, c, t, g, unknown or other
  misc_feature (448)..(448): n is a, c, g, or t
tcagactgtacagtcacgaccggtgctcgatttagtacacgtgattagggattggggcagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggcagagggtctccatctcttgtctgggagcagctccgacgtcggaaataagtttgtctactggtaccagcagctcccagaaacggccccaagctcctcatctataggaatgatcagcggccctcagggatcccagaccgattcctctggctcgaagtctggctcctcggcctccctgccatcagtgggctccggtccgaggatgaggctgaatattactgtgcagtttgggatgccagtctgngtgtccgaggtgttcggcggagggaccaagctgaccgtctaggtcaggcccaggcctcg

SEQ ID NO: 83168 - DNA, 517 bp, Homo sapiens
  misc_feature: GYAE6OF02FPVC9.25.23.C01.1.454.CMB.1.raw
  modified_base (206)..(206): a, c, t, g, unknown or other
  misc_feature (206)..(206): n is a, c, g, or t
tcagactgtacagtcacgaccggtgctcgatttagtacacgtgattagggattggggagcttcagctgtggtagagaagacaggattcaggacaatctccagcatggacggcctccctctcctcctcaccctcctcactcactgtgcagggtcctgggcccagtctgtgctgactcagccaccctcagtgtctgggacccccgggnagagggtctccatctcttgttctgggagcagctccgacgtcggaaataagtttgtctactggtaccagcagctcccagaacggcccccaagctcctcatctataggaatgatcagcggccctcagggatacctgaccgattctctggctcgaagtctggctcctcggcctcctggccatcagtgggctccggtccgaggatgaggctgaattattactgtgctagtttggatgccagtctgagtcggtccgacggtgttcggcggagggaccaaggctgaccgtctaggtcagcccaaggcctgtcccccg

SEQ ID NO: 83169 - DNA, 503 bp, Homo sapiens
  misc_feature: GYAE6OF02I1HSU.25.23.C01.1.454.CMB.1.raw
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
  modified_base (321)..(321): a, c, t, g, unknown or other
  misc_feature (321)..(321): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggancagctccgacgtcggaaatagtttgtctactggtaccagcagctccagaaacggcccccaagctcctcatctataggaatgatcagcggccctnagggatacctgaccgattctctggctcgaagtctggctcctcggcctccctggccatcagtggctccggtcgaggatgaggctgaatattactgtgctagttggatgcagtctgagtggtcgaggtgttcggacggaggacgagctgaccgtctagtcagccgaggctcgcccctggtctcg

SEQ ID NO: 83170 - DNA, 544 bp, Homo sapiens
  misc_feature: GYAE6OF02IGK51.25.23.C01.1.454.CMB.1.raw
  modified_base (199)..(199): a, c, t, g, unknown or other
  misc_feature (199)..(199): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggagcagctccgacgtcggaaatagtttgctactggtacagcagctcccagaaaccggcccccaagctcctcatctataggaatgatcagcggccctcgagggactacctgaccgattctctggctcgaagtctggctcctcggccctcctggccatcagtcgggcctccggtccgaggatggaggctggaattattacgtgtgctaggtttgggatgcctagttcgtgaggtggtccgacgggttgttcggcgggaggaccgagcgtcggaccgtccgtaggtccgacgcccgaaggtcctcggccccttcggtctaccg

SEQ ID NO: 83171 - DNA, 574 bp, Homo sapiens
  misc_feature: GYAE6OF02GA2BP.25.23.C01.1.454.CMB.1.raw
  modified_base (205)..(205): a, c, t, g, unknown or other
  misc_feature (205)..(205): n is a, c, g, or t
  modified_base (413)..(413): a, c, t, g, unknown or other
  misc_feature (413)..(413): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggagcagctccgacgtcggaaataagtttgtctactggtaccagcagctccagaaccggccccaagctcctcatctataggaatgatcagccggccctcgagggactacctgaccgtattctctggctcgaagtctggctcctcggccctccgtcggccatcgagtcgggctcccggtcgaggntggaggctagaattattactgtgcgtaggtttgggattgtaccgagttcgtgtaggtcgggtaccgtacgggttggttcgggcgggacgggaaccaaggtccgtacggtacccggttccgtagggtccaccggacccgaacggtccgtcccgtccccccgg

SEQ ID NO: 83172 - DNA, 536 bp, Homo sapiens
  misc_feature: GYAE6OF02FZ79S.25.23.C01.1.454.CMB.1.raw
  modified_base (208)..(208): a, c, t, g, unknown or other
  misc_feature (208)..(208): n is a, c, g, or t
  modified_base (236)..(236): a, c, t, g, unknown or other
  misc_feature (236)..(236): n is a, c, g, or t
  modified_base (350)..(350): a, c, t, g, unknown or other
  misc_feature (350)..(350): n is a, c, g, or t
  modified_base (411)..(411): a, c, t, g, unknown or other
  misc_feature (411)..(411): n is a, c, g, or t
tcagactgtacagtcacgaccggtgctcgatttagtacacgtgattagggagttggggcagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggnaggagggtctccatctcttgtctgggancagctccgacgtcgaaataagtttgtctactggtaccagcagctcccagaaacggccccaagctcctcatctataggaatgatcagcggccctcagggatacctgaccgattcnctggctcgaagtctggctctcggcctcctggccatcagtggctccggtccgagatgaggcngtaatattacgtgtgctaggttggatgccagttctgacgttggtccgacggttgttcggcgggtaacgggaccaaggtccgtagacccgttccgtacggtaccacggcccgtaaggcctacccgg

SEQ ID NO: 83173 - DNA, 532 bp, Homo sapiens
  misc_feature: GYAE6OF02JHTCL.25.23.C01.1.454.CMB.1.raw
  modified_base (293)..(293): a, c, t, g, unknown or other
  misc_feature (293)..(293): n is a, c, g, or t
  modified_base (327)..(327): a, c, t, g, unknown or other
  misc_feature (327)..(327): n is a, c, g, or t
  modified_base (343)..(343): a, c, t, g, unknown or other
  misc_feature (343)..(343): n is a, c, g, or t
  modified_base (417)..(417): a, c, t, g, unknown or other
  misc_feature (417)..(417): n is a, c, g, or t
  modified_base (509)..(509): a, c, t, g, unknown or other
  misc_feature (509)..(509): n is a, c, g, or t
tcagactgtacagtcacgaccggtgctcgatttagtacacgtgattagggattgggagctgtggtagagaagacaggattcaggacaatctccagcatggccggcctccctctcctcctcaccctcctcactcactcgtgcagggtcctgggcccagtctgtgctgactcagccaccctcagtgtctgggacccccggcagagggtctccgaatctcttgttctgggagcagctccgacgtcggaaatagtttgtctactggtaccagcagctccagaaacggcccccaagcncctcatctatagaatgatcagcggccctcagggntaccgtgaccgattcncctggctcgaagtctggctcctcggcctcctaggccatcagtggctcggtccgagatgaggctcgaatattacngttgcagtttggattgcagtctcgagtcgtaccgcgtggttcgcgggtaggaccaaggcgtggaccgtccgtaggtcaggccccaaggtccngtacccccgtcggtacctaccgg

SEQ ID NO: 83174 - DNA, 511 bp, Homo sapiens
  misc_feature: GYAE6OF02GI2YL.25.23.C01.1.454.CMB.1.raw
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
  modified_base (440)..(440): a, c, t, g, unknown or other
  misc_feature (440)..(440): n is a, c, g, or t
  modified_base (459)..(459): a, c, t, g, unknown or other
  misc_feature (459)..(459): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggancagctccgacgtcggaaatagtttgtctactggtaccagcagctcccagaaacggcccccaagctcctcatctataggaatgatcagcggccctcagggatacctgaccgattctctggctcgaagtctggctcctcggcctccctggccatcagtgggctccggtccgaggatgaggctgaatattactgtgcagtttggatgccagtctgngtggtccgaggtgttcggnggagggcagcgtgaccgtcgaggtcagcccaggcctcgcccctggtctaccg

SEQ ID NO: 83175 - DNA, 526 bp, Homo sapiens
  misc_feature: GYAE6OF02GMWWD.25.23.C01.1.454.CMB.1.raw
  modified_base (190)..(190): a, c, t, g, unknown or other
  misc_feature (190)..(190): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggagcagctccgacgtcggaaataagtttgtctactagtaccagcagctccagaaacggcccccaagctcctcatctataggaatgatcagcggccctcagggatacctgaccgattctctggctcgaagtctggctcctcggcctcctggccatcagtcgggctccggtccgaggatgaggctgaattattactgtgcgtagtttggatgcagtcgtgagtggtccgacgggttggttcggcgggaggaccaaggcgtgaccgtcgtaggcagccgaaggcctcgcccctggtccactcgtcgtccctccc

SEQ ID NO: 83176 - DNA, 525 bp, Homo sapiens
  misc_feature: GYAE6OF02FNR9J.25.23.C01.1.454.CMB.1.raw
  modified_base (323)..(323): a, c, t, g, unknown or other
  misc_feature (323)..(323): n is a, c, g, or t
  modified_base (452)..(452): a, c, t, g, unknown or other
  misc_feature (452)..(452): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccgggcagagggtctccatctcttgttctgggagcagctccgacgtcggaaataagtttgctactggtaccagcagctcccagaaacggcccccaagctcctcatctataggaatgatcagcggccctnagggatacctgaccgattctctggctcgaagtctggctcctcggcctccctggccatcagtggctccggtccgaggatgaggctgaattattactgtgctagtttgggatgccagtctgagtggtccgnggtgttcggcgagggaccaaggcgtcggaccgtcgtaggtcaggcccaaggcctcggccccctggtcctaccg

SEQ ID NO: 83177 - DNA, 691 bp, Homo sapiens
  misc_feature: GYAE6OF02IIHGU.25.23.C01.1.454.CMB.1.raw
  modified_base (262)..(262): a, c, t, g, unknown or other
  misc_feature (262)..(262): n is a, c, g, or t
tcagactgtacagtcacgaccggtgctcgatttagtacacgtgatttaggggtagggttaggggaggactgtggtaggacgaagaccaggattcgacggacgaatctccaggcaagtcggccggtccctccctccttcccttcctccaccctcctcgactcgactaggtgcagggtcctgggcccagtctgtgctgactcagcccaccctcagtgtctcggggacccccgggcaggagggtctccatctcttgttctgggancagctccgacgtcggaaataagtttgtctactggtaccagcagctccagaaaccggcccccaagcctcctcatctataggaatgatcagccggcctcgagggactaccgtgaccgtatttcctcgtgggcctacgtaagttcgtcgggtccttcccgtcgggcccttcccctgggacccattccgaggtcggggcccttccgggtccggaggagttcggaggcgtaggaaatttacttacgtgtgtacgttagggttttgggacttcggacctaggttcttcgggtaggttcgggttcccgggttaacgggttcggtttaccggggacggggtacgggacccgtaaggtccggtacggtacccggttaccgtacgggttacgaccggtcccgaagggtccctaccggtccccccgttcggtcctacccg

SEQ ID NO: 83178 - DNA, 540 bp, Homo sapiens
  misc_feature: GYAE6OF02GT5VB.25.23.C01.1.454.CMB.1.raw
  modified_base (206)..(206): a, c, t, g, unknown or other
  misc_feature (206)..(206): n is a, c, g, or t
  modified_base (234)..(234): a, c, t, g, unknown or other
  misc_feature (234)..(234): n is a, c, g, or t
tcagactgtacagtcacgaccggtgctcgatttagtacacgtgattagggattggggcagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggancagctccgacgtcggaaataagtttgtctactggtaccagcagctcccagaacgccccaagctcctcatctataggaatgatcagcggccctcagggatacctgaccgattctctggctcgaagtctggctcctcggcctcctggccatcagtcgggctccgggtccgaggatgaggctggaatattactgtgcagtttggatgccagtctggagtggtccgaggttcggttcgggcgggtaagggacccaaggtccgtacgtaccggtccgttagggtccaggtccccaagggcccttacccggg

SEQ ID NO: 83179 - DNA, 681 bp, Homo sapiens
  misc_feature: GYAE6OF02F00HI.25.23.C01.1.454.CMB.1.raw
  modified_base (272)..(272): a, c, t, g, unknown or other
  misc_feature (272)..(272): n is a, c, g, or t
  modified_base (346)..(346): a, c, t, g, unknown or other
  misc_feature (346)..(346): n is a, c, g, or t
tcagactgtacagtcacgaccggtgctcgatttagtacacgtgattagggtagtttggggggaagcttacagctggtggtacgaggaagtacagggattcagggacaacttctccagcatagggcccggcctcccgtctcctcctcacccgtccttcgactcaacttggttcgctagggtcctgggtacccaggtctgtgctgactcagccaccctgaggtgtctgggggacccccgggcaggacgggtctccagtctccttgtctgggacncagctccggacgtcggaaataagttgtccttactggtaccagcgagtctcccaggaaaccggccccaagctccncgatacgtatagggaatggatcgagtccggtcctcgagggactaccgtgaaccgtattctctggctacggaaggtctgggctcccggtccggccctttcccgcggccctacgtccgagggtcgggaccgttcccgggaccggacgggaactggacggtcttaggaacttaattacgtacgtcgtacgtaggtttcgggagttggacccgtaggttcgttagtagttcgggtccgacgggttcgttcggggacgggtacgggtaccggaagtcggtaacggtacccgttacggtacggtccacggtccccgaacggtcccgtaccgtccccccggg

SEQ ID NO: 83180 - DNA, 558 bp, Homo sapiens
  misc_feature: GYAE6OF02JG7ZO.25.23.C01.1.454.CMB.1.raw
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
  modified_base (321)..(321): a, c, t, g, unknown or other
  misc_feature (321)..(321): n is a, c, g, or t
  modified_base (423)..(423): a, c, t, g, unknown or other
  misc_feature (423)..(423): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggancagctccgacgtcggaaatagtttgctactggtaccagcagctcccagaaacggcccccaagctcctcatctataggaatgatcagcggccctnagggactacctgaccgattctctggctcgaagtctggctctcgcctccctggccatcagtcgggctccggtccgaggatggaggctagaatagttactgtgntaggtttggatgacctagtcgtggtaggtcggtccggtaggttcggttcgggcgggacgggaccaggcgttcggaccgttaccgtacggtccgacgtacccgaggccgttccggcccccgttcggtacctacccg

SEQ ID NO: 83181 - DNA, 576 bp, Homo sapiens
  misc_feature: GYAE6OF02F6SBJ.25.23.C01.1.454.CMB.1.raw
  modified_base (206)..(206): a, c, t, g, unknown or other
  misc_feature (206)..(206): n is a, c, g, or t
  modified_base (234)..(234): a, c, t, g, unknown or other
  misc_feature (234)..(234): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggancagctccgacgtcggaaataagtttgtctactggtaccagcagctcccagaacggcccccaagctcctcatctataggaatgatcagccggccctcgagggatacctgaccgattctctggctcgaagtctggctcctcggccctccctggccatcagtcgggcgtccggtccgaggagtgacggtctagaattacttactgtgtcgtaggtttgggattgcctaggtctggagtcggtaccgtacgggttgttcgggacgggacgggtaacccgaaggtccgtcggtacccgttccgtaacgggttccacggccccgaagggtcccgtccggtccccccgg

SEQ ID NO: 83182 - DNA, 549 bp, Homo sapiens
  misc_feature: GYAE6OF02HK0GX.25.23.C01.1.454.CMB.1.raw
  modified_base (206)..(206): a, c, t, g, unknown or other
  misc_feature (206)..(206): n is a, c, g, or t
  modified_base (234)..(234): a, c, t, g, unknown or other
  misc_feature (234)..(234): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggancagctccgacgtcggaaataagtttgtctactggtaccagcagctcccagaaacggccccaagctcctcatctataggaatgatcagcggccctcagggatacctgaccgattctctggctcgaagtctggctcctcgcctccctggccatcgagtgggctccggtccgaggatgaggctagaatattactgtgctagtttgggatgccagttctgtaggtggtccgtacggttggttcgggcgggtacgggaccgaaggccgtacggtacccgtccgtaggtccgacggtccccgaagggtcctcgtccccccg

SEQ ID NO: 83183 - DNA, 531 bp, Homo sapiens
  misc_feature: GYAE6OF02GBGPS.25.23.C01.1.454.CMB.1.raw
  modified_base (191)..(191): a, c, t, g, unknown or other
  misc_feature (191)..(191): n is a, c, g, or t
  modified_base (437)..(437): a, c, t, g, unknown or other
  misc_feature (437)..(437): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggagcagctccgacgtcggaaataagtttgtctactggtaccagcagctcccagaaacggcccccaagctcctcatctataggaatgatcagcggccctcagggatacctgaccgattctctggctcgaagtctggctcctcggcctcctggccatcagtgggctccggtccgaggatggaggctgaattattactgtgctagtttgggatgcctagtctgngtggtccgacgtgttcggcggaggaccaagcgtgaccgtccgtaggtcagcccgaaggcctcgcccctcggtccactccttcgtcccctacccg

SEQ ID NO: 83184 - DNA, 509 bp, Homo sapiens
  misc_feature: GYAE6OF02FNMDX.25.23.C01.1.454.CMB.1.raw
  modified_base (413)..(413): a, c, t, g, unknown or other
  misc_feature (413)..(413): n is a, c, g, or t
  modified_base (424)..(424): a, c, t, g, unknown or other
  misc_feature (424)..(424): n is a, c, g, or t
tcagactgtacagtcacgaccggtgctcgatttagtacacgtgattagggattggggggaagctcagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggcagagggtctccatctcttgttctgggagcagctccgacgtcggaaataagtttgtctactggtaccagcagctcccagaaacggcccccaagctcctcatctataggatgatcagcggccctcaggatacctgaccgatttctctggctcgaagtctggctcctcggcctccctggccatcagtggctccggtccgagntgagctgaatnttactgtgctagtttggatgcctagtctgagtggtccgaggtgttcggcggagggaccagctgaccgtcctaggtcagccaacgg

SEQ ID NO: 83185 - DNA, 499 bp, Homo sapiens
  misc_feature: GYAE6OF02FOU0Q.25.23.C01.1.454.CMB.1.raw
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
  modified_base (406)..(406): a, c, t, g, unknown or other
  misc_feature (406)..(406): n is a, c, g, or t
  modified_base (411)..(411): a, c, t, g, unknown or other
  misc_feature (411)..(411): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggancagctccgagtcggaaatagtttgctactggtaccagcagctcccagaaacggcccccaaagctcctcatctataggaatgatcagcggccctcagggatacctgaccgattctctggctcgaagtctggctcctcggcctcctggccatcagtggctcggtcgaggatgagctgaatnttacngtgcagttggatgccagtctgagtggtccgacggtgttcggcgaggccagctgaccgtctagtcagccaggctcgcccctggtctccg

SEQ ID NO: 83186 - DNA, 516 bp, Homo sapiens
  misc_feature: GYAE6OF02HGEM5.25.23.C01.1.454.CMB.1.raw
  modified_base (228)..(228): a, c, t, g, unknown or other
  misc_feature (228)..(228): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccgggcagagggtctccatctcttgttctgggancagctccgacgtcggaaaatagtttgtctactggtaccagcagctccagaaacggcccccaagctcctcatctataggaatgatcagcggcctcagggatacctgaccgattctctggctcgaagtctggctccgtcgcctcccgtggccatcgagtcgggctccggtccgaggatgaggctgaatattactgtgctagttggattgctagtctgagtggtccaggtgtcggcggaggaccagcgtgccgttcgtaggtcagcccaggcctcggcccctggtcctacg

SEQ ID NO: 83187 - DNA, 514 bp, Homo sapiens
  misc_feature: GYAE6OF02FMM9C.25.23.C01.1.454.CMB.1.raw
  modified_base (200)..(200): a, c, t, g, unknown or other
  misc_feature (200)..(200): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggagcagctccgacgtcggaaaatagtttgctactggtaccagcagctcccagaaacggcccccaagctcctcatctataggaatgatcagcggccctcagggatacctgaccgattctctggctcgaagtctggctcctcggcctccctggccatcagtgggctccgggtccgaggatgaggctgaattattactgtgctagtttggatgcagtctgagtggtccgaggtgttcggcggaggaccaagcgtgaccgtcgtagtcagcccaggcctcgccccgtgctacg

SEQ ID NO: 83188 - DNA, 504 bp, Homo sapiens
  misc_feature: GYAE6OF02FNWCB.25.23.C01.1.454.CMB.1.raw
  modified_base (200)..(200): a, c, t, g, unknown or other
  misc_feature (200)..(200): n is a, c, g, or t
  modified_base (228)..(228): a, c, t, g, unknown or other
  misc_feature (228)..(228): n is a, c, g, or t
  modified_base (400)..(400): a, c, t, g, unknown or other
  misc_feature (400)..(400): n is a, c, g, or t
  modified_base (416)..(416): a, c, t, g, unknown or other
  misc_feature (416)..(416): n is a, c, g, or t
  modified_base (438)..(438): a, c, t, g, unknown or other
  misc_feature (438)..(438): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggancagctccgacgtcggaaatagtttgtctactggtaccagcagctcccagaaacggcccccaagctcctcatctataggaatgatcagcggccctcagggataccgtgaccgattctctggctcgaagtctggctcctcggcctccctggccatcagtggctccggtcgaggntgaggctgatattacngtgcagttggatgctagtctgngtgtcgacgtgtcggcggaggcagcgtgaccgtctaggtcagcccaggctcgccccgtgtcctacg

SEQ ID NO: 83189 - DNA, 662 bp, Homo sapiens
  misc_feature: GYAE6OF02HK0KA.25.23.C01.1.454.CMB.1.raw
  modified_base (247)..(247): a, c, t, g, unknown or other
  misc_feature (247)..(247): n is a, c, g, or t
  modified_base (512)..(512): a, c, t, g, unknown or other
  misc_feature (512)..(512): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcgactgtcgtcgagggtccggtcgggtcccgacgtacggtcggtcgacttaggactcagccaccctcagtgtctgggacccccggcagagggtctccatctcttgttctgggancagctccgacgtcggaaatagtttgtctactggtaccagcagctcccagaaacgccccaagctcctcatctataggaatgatcagcggcctcagggatacctgaccgattctctggctcgaagtctcggctccgtccggcccttcccgtggaccattcaggtcgggctcccgggtccgagggtacgtggacggtcgtagtaaacgttagtttaccgttggttgtaccgtagggtttttagggattcggccgtagttccgtagggngtttcgggtcccggttacgggttcgggtttaccggggcgggaacgggacccgaacggtcgttacgggacccggttcccggttaagggtcccgtacggaccccgtaacgggtcccgttaccccggtcccccggttcgggttacccttcccg

SEQ ID NO: 83190 - DNA, 518 bp, Homo sapiens
  misc_feature: GYAE6OF02F479O.25.23.C01.1.454.CMB.1.raw
  modified_base (199)..(199): a, c, t, g, unknown or other
  misc_feature (199)..(199): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggagcagctccgacgtcggaaatagtttgctactggtaccagcagctcccagaaaccggcccccaagctcctcatctataggaatgatcagcggccctcagggatacctgaccgattctctggctcgaagtctggctcctcgccctccctggccatcagtgggctccggtccgaggatgaggctgaatattactgtgcagtttggatgccagtctgagtggtccgacgtgttcggcggaggacagcgtgaccgtccgtaggtcagcccgaaggcctcgcccccgtcggtctaccg

SEQ ID NO: 83191 - DNA, 548 bp, Homo sapiens
  misc_feature: GYAE6OF02FHB5M.25.23.C01.1.454.CMB.1.raw
  modified_base (171)..(171): a, c, t, g, unknown or other
  misc_feature (171)..(171): n is a, c, g, or t
  modified_base (191)..(191): a, c, t, g, unknown or other
  misc_feature (191)..(191): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctnagtgtctgggacccccgggnagagggtctccatctcttgttctgggagcagctccgacgtcggaaatagtttgctactggtaccagcagctccagaacggcccccaagctcctcatctataggaatgatcagcggccctcagggatacctgaccgattctctggctcgaagtctggctcctcggcctcctggccatccagtgggcctccgggtccgaggatgaggctgaatagttactgtgctagtttgggatgccagtctgagtggtccgaggttgttcggcgggaggaccaaggcctggaccgtcgtagggtcacggcccgaaggtcctcggcccccgttcgggtacctaccgtccttcggttcccctacccccg

SEQ ID NO: 83192 - DNA, 537 bp, Homo sapiens
  misc_feature: GYAE6OF02JKJ8B.25.23.C01.1.454.CMB.1.raw
  modified_base (191)..(191): a, c, t, g, unknown or other
  misc_feature (191)..(191): n is a, c, g, or t
  modified_base (389)..(389): a, c, t, g, unknown or other
  misc_feature (389)..(389): n is a, c, g, or t
  modified_base (400)..(400): a, c, t, g, unknown or other
  misc_feature (400)..(400): n is a, c, g, or t
  modified_base (406)..(406): a, c, t, g, unknown or other
  misc_feature (406)..(406): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggagcagctccgacgtcggaaataagtttgtctactggtaccagcagctcccagaaacggcccccaagctcctcatctataggaatgatcagcggccctcagggatacctgaccgattctctggctcgaagtctggctcctcggcctcctggccatcagtggctccggtcgagntgagctgaatnttacgngtgcgtagtttggatgctagtctgagtggtccgacggtgttcggcggaggaccaagctcgtaccgtcgtaggtcacggcccgaacggtctcgcccccgtggtcctaccgtccgttcggttaccccgtcccg

SEQ ID NO: 83193 - DNA, 591 bp, Homo sapiens
  misc_feature: GYAE6OF02GBMJ0.25.23.C01.1.454.CMB.1.raw
  modified_base (191)..(191): a, c, t, g, unknown or other
  misc_feature (191)..(191): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggagcagctccgacgtcggaaataagtttgtctactggtaccagcagctcccagaaacggcccccaagctcctcatctataggaatgatcagcggccctcgagggatacctgaccgattctctggctcgaagtctgctcctcggcctccgtgccatcagtcgggctccggtccgaggatgaggctgaatattactgtgctaggtttgggatcggccctagtccgtggaggttcgggtccggtacgggttggttacgggcgggtaacgggaccaaggtccgtacggtacccgttccgtagggtccaacggtaccccgaagggcctccggaccccccttcgggtccctaccgttccgttcccgttacccctacccccg

SEQ ID NO: 83194 - DNA, 514 bp, Homo sapiens
  misc_feature: GYAE6OF02F1TLK.25.23.C01.1.454.CMB.1.raw
  modified_base (203)..(203): a, c, t, g, unknown or other
  misc_feature (203)..(203): n is a, c, g, or t
  modified_base (227)..(227): a, c, t, g, unknown or other
  misc_feature (227)..(227): n is a, c, g, or t
  modified_base (263)..(263): a, c, t, g, unknown or other
  misc_feature (263)..(263): n is a, c, g, or t
  modified_base (292)..(292): a, c, t, g, unknown or other
  misc_feature (292)..(292): n is a, c, g, or t
  modified_base (295)..(295): a, c, t, g, unknown or other
  misc_feature (295)..(295): n is a, c, g, or t
  modified_base (328)..(328): a, c, t, g, unknown or other
  misc_feature (328)..(328): n is a, c, g, or t
tcagactgtacagtcacgaccggtgctcgattagtacacgtgattagggattgggagcttcagctgtggtagagaagacaggattcaggacaatctccagcatggccggcctccctctcctcctcaccctcctcactcactgtgcaggtcctggcccagtctgtgctgactcagcccaccctcagtgtctgggaccccccggnagacggtctcccatctcttgttcnggagcagctccgacgtcggaatatgctactggtccngcagctcccagaaccgcccccaagctctnatntatagaatgatcagccgccctcgaggactaccngacccgattctctggctcgaagtctggcctcccgtcggccctcccgtggcccatccgagtcggcctccggtccgaggatgaggctgaatctactgtgctagttggatgccagtctggatcggtccgacggtgtcggcggaggaccagctgaccgtcgtaggtccacgcccaaggtcctcgcccccg

SEQ ID NO: 83195 - DNA, 590 bp, Homo sapiens
  misc_feature: GYAE6OF02G1DY1.25.23.C01.1.454.CMB.1.raw
  modified_base (191)..(191): a, c, t, g, unknown or other
  misc_feature (191)..(191): n is a, c, g, or t
  modified_base (220)..(220): a, c, t, g, unknown or other
  misc_feature (220)..(220): n is a, c, g, or t
  modified_base (292)..(292): a, c, t, g, unknown or other
  misc_feature (292)..(292): n is a, c, g, or t
  modified_base (319)..(319): a, c, t, g, unknown or other
  misc_feature (319)..(319): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccgggnaggagggtctccatctcttgttctgggancagctccgacgtcggaaatagtttgctactggtaccagcagctccagaaacggccccaagctcctcatctanagaatgatcagcgcctcgaggataccngaccgattctactggctcgaagtctaggcctccgtcggctactccctggccctatccgagtcgggtcctccggtaccgaggatcggaggctagaacttatacgtgtgactagggtttgggatcgaccgtagtcgtcggtagtcgggtaccggtacgggtttcggtcggggtccgggaacggtaccgaagtccgtacggaccgttcgtacggtacgccgaacccgtacggctacccggtccccgttcggacctaccttcgtccgttcccccg

SEQ ID NO: 83196 - DNA, 647 bp, Homo sapiens
  misc_feature: GYAE6OF02I5JLB.25.23.C01.1.454.CMB.1.raw
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagcccaccctcagtgtctcgggacccccgggcaggagggtctccatctcttgttctgggagcagctccgacgtcggaaatagttgtctactggtaccagcagcctcccagaaaccggccccaagctcctcatctataggatgatcagccgcctcgagggactacctgaccgatttcctctggctcgaagtctggcctccgtccggccctcccgtggccctatcgacggtcgggccgtcccggtccgaggacgtggaggtcctagaaattacgttaccgtggtcgtcgtaagggttttcgggattcggaccgtagttccgtaggtacggttcgggttccggtaacgggttcgggttaccggggaccggggtaacggggaacccgtaaggtcccggttaacggaccccggtttaccggttacgggtacccggaaccggaccccggaaaggttccccgtcccgtacccccccgg

SEQ ID NO: 83197 - DNA, 661 bp, Homo sapiens
  misc_feature: GYAE6OF02F4PEY.25.23.C01.1.454.CMB.1.raw
  modified_base (138)..(138): a, c, t, g, unknown or other
  misc_feature (138)..(138): n is a, c, g, or t
  modified_base (172)..(172): a, c, t, g, unknown or other
  misc_feature (172)..(172): n is a, c, g, or t
  modified_base (174)..(174): a, c, t, g, unknown or other
  misc_feature (174)..(174): n is a, c, g, or t
  modified_base (179)..(179): a, c, t, g, unknown or other
  misc_feature (179)..(179): n is a, c, g, or t
  modified_base (182)..(182): a, c, t, g, unknown or other
  misc_feature (182)..(182): n is a, c, g, or t
  modified_base (185)..(185): a, c, t, g, unknown or other
  misc_feature (185)..(185): n is a, c, g, or t
  modified_base (194)..(194): a, c, t, g, unknown or other
  misc_feature (194)..(194): n is a, c, g, or t
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
  modified_base (219)..(219): a, c, t, g, unknown or other
  misc_feature (219)..(219): n is a, c, g, or t
  modified_base (243)..(243): a, c, t, g, unknown or other
  misc_feature (243)..(243): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactgtacngtctgaggtccggtgtcgcacgcgtcactagctnancactngtntcnggacccggnagnggtcncatctcttgtcgnggancagctcgacgtacgaaattagttnctactgtaccagcacgcctaccaagaacccgaccccaagtcctcctacactctagtagatgactcgacggtccggcctacgaacgggtactaccgtacgaaccgtattctacgtacggtctacggtaacgttcgtcggtccttccgtccggtccctccgtacgcctagtcgtacggtcggtccgtccggtacggtaggtacgtacggtacgtacgtacgtaagttacgttacgtacgtcgtacgtaggttacggtacgtacgtacgtacgtacgtcgtacggtacgggtacggtacggttacggttccgggtacgggtaccgggtacggtaacggtacggtaccggtaccggtaccggtacggtaccgtaccggaccggtaccggtaccgtcccggtcccgttaccggtaccgtaccg

SEQ ID NO: 83198 - DNA, 734 bp, Homo sapiens
  misc_feature: GYAE6OF02FE0R9.25.23.C01.1.454.CMB.1.raw
  modified_base (226)..(226): a, c, t, g, unknown or other
  misc_feature (226)..(226): n is a, c, g, or t
  modified_base (287)..(287): a, c, t, g, unknown or other
  misc_feature (287)..(287): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccggcagagggtctccatctcttgtctgggancagctcgacgtcggaaatagtttgctactggtaccagcagctccagaacgccccaagctcncatctatagaatgatcagcggccctgacgggactacctgaccgtattctctggctacgaagtctcggcctcccgtcggtccctcccgtggccctagtccgacggtcgggaccttcccgggtccgaagggtactcggaaggtccgtagtaaacttagtttacgtggttgaccgttagggttttcgggaacttcgggtaccctaggttcccgttagggtacggttaccggggtttacccgggtaaccgggtttcgggtttacccgggggaccgggggtaaaccgggggtaccccgtaaacgggtcccggtttaaccggggtaacccccgggtttacccggttaaccggggttacccgtaaacccggggtaccccccggtaaacgggggttcccccgttacccggggtaccccccccccggtttacggggtttaccccttaaccccccgg

SEQ ID NO: 83199 - DNA, 532 bp, Homo sapiens
  misc_feature: GYAE6OF02HJ41I.25.23.C01.1.454.CMB.1.raw
  modified_base (206)..(206): a, c, t, g, unknown or other
  misc_feature (206)..(206): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggagcagctccgacgtcggaaaataagtttgtctactggtaccagcagctcccagaaacggcccccaagctcctcatctataggaatgatcagcggccctcagggatacctgaccgattctctggctcgaagtctgctcctcggcctccctgccatcagtggctccggcgagatgagctgaatattactgtgctagtttgggatgcctagtctgagtcggtccgaggttgttcgggcggagggaccaagtcgtagtacccgtccgtagggtccacggacccgaagggtcctccggtcccccg

SEQ ID NO: 83200 - DNA, 742 bp, Homo sapiens
  misc_feature: GYAE6OF02H8RE3.25.23.C01.1.454.CMB.1.raw
  modified_base (182)..(182): a, c, t, g, unknown or other
  misc_feature (182)..(182): n is a, c, g, or t
  modified_base (203)..(203): a, c, t, g, unknown or other
  misc_feature (203)..(203): n is a, c, g, or t
  modified_base (243)..(243): a, c, t, g, unknown or other
  misc_feature (243)..(243): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtaggctgactcagccaccctnagtgtctgggaccccccgggnaggtacggtcctccattccttctttggttccgtggggacncgagcctaccggacggttacggaaaatttacggttttcgtaccttacgtcggtaccagcacgcctacccgaaggaaacccggccccctaagcctaccctacacttcgttaagtaacggaatcgactcgacggcccggtccctacggaacgggtactaacccgtacggaaccgtattcctcgtacggcctacgtaacgttcgtcggtcccttcccgtccggtcccttacccggtcggacctacgttccggtacgggtccgggtcccgttacccgggtaccggaagggtacgtacgggacggtactaaggtaacttacgttacgtggtcggtacgttagggttagggacgttcggtaccgtaggttccgtagggtacggttcgggttaccggtcgggttggtaccggggacgggaccggtaccgtacggtccgtacggtaccggtcgtacggtcgaccggtacccgacggtcccgtcccggtccccgttacggtcctaccg

SEQ ID NO: 83201 - DNA, 568 bp, Homo sapiens
  misc_feature: GYAE6OF02I4NXX.25.23.C01.1.454.CMB.1.raw
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggancagctccgacgtcggaaataagtttgtctactggtaccagcagctccagaaaccggcccccaagctcctcatctataggaatgatcagcggccctcgagggactaccgtgaccgtattctctggctcgaagtctggctccgtcggccctcccgtggccctatcgaggtcgggcctcccgggtccggaggactggacggtctagaattattacgtgtgctaggtttggattgcctagtctggtaggtcgggtccgtaggttggttcgggcggacgggaccaaggtccgtggacccgttcgtaggtcgacgcccgaaggcctccggcccccgtggtcctaccg

SEQ ID NO: 83202 - DNA, 663 bp, Homo sapiens
  misc_feature: GYAE6OF02JZV90.25.23.C01.1.454.CMB.1.raw
  modified_base (192)..(192): a, c, t, g, unknown or other
  misc_feature (192)..(192): n is a, c, g, or t
  modified_base (290)..(290): a, c, t, g, unknown or other
  misc_feature (290)..(290): n is a, c, g, or t
  modified_base (317)..(317): a, c, t, g, unknown or other
  misc_feature (317)..(317): n is a, c, g, or t
  modified_base (329)..(329): a, c, t, g, unknown or other
  misc_feature (329)..(329): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctcggggacccccggnaggagggtctccatctcttgttctgggagcagctccgacgtacggaaataagtttgtctactggtaccagcagctccaagaaaccgccccaagctccncatctataggaatgatcagccggcctnagggactaccgnggaccgatttcctcgtggcctacgtaacgtctgggccttccgtcggccctacctcgggcctatccgaggtcgggcttcccgggtacgaggtacgtggacgggtctaggtaaattacgttaccgttggtacggtacgttagggttttagggaagtccgaccgttagtccgttaggtacggttcgggtacccggtagggttcgggttccgggacgggtacgggaccgtaacggtcgtaccggtcccgtacggtacggtccgaaccggtccgtaacggcccgtaccgtcccccggtacggttccgaccgttccggttcccgttacccccgtaccccg

SEQ ID NO: 83203 - DNA, 543 bp, Homo sapiens
  misc_feature: GYAE6OF02JX5C6.25.23.C01.1.454.CMB.1.raw
  modified_base (185)..(185): a, c, t, g, unknown or other
  misc_feature (185)..(185): n is a, c, g, or t
  modified_base (200)..(200): a, c, t, g, unknown or other
  misc_feature (200)..(200): n is a, c, g, or t
  modified_base (229)..(229): a, c, t, g, unknown or other
  misc_feature (229)..(229): n is a, c, g, or t
  modified_base (265)..(265): a, c, t, g, unknown or other
  misc_feature (265)..(265): n is a, c, g, or t
  modified_base (294)..(294): a, c, t, g, unknown or other
  misc_feature (294)..(294): n is a, c, g, or t
  modified_base (386)..(386): a, c, t, g, unknown or other
  misc_feature (386)..(386): n is a, c, g, or t
  modified_base (479)..(479): a, c, t, g, unknown or other
  misc_feature (479)..(479): n is a, c, g, or t
tcagactgtacagtcacgaccggtgctcgatttagtacacgtgattaggattgggcagcttcagctgtggtagagaagacaggattcaggacaatctccagcatggccggcctccctctcctcctcaccctctcactcactgtgcaggtcctggcccagtctgtgctgactcagccacctcagtntctgggacccccggnagagggtctccatcgtcttgttcagggancagctccgacgtcggaatagttgctacgtggtaccngcagctaccagaaccgccccaagctcctnactcctataggaattgatcagccgcctgaggacaccgtgaccgtattctctggcctagagtctcggtctcctacggcctccgtagccactcnggtcggcctaccgggtccgagctaggcggtcctaggacttagttcacgtgcgtagtttcgggattcggccgacgtttgcgtagtcggtaccgnggtcgttggcgggacgggactaggccgtcgaaccggttcacgggtcacgcccgagtccctccgg

SEQ ID NO: 83204 - DNA, 602 bp, Homo sapiens
  misc_feature: GYAE6OF02HZ6SL.25.23.C01.1.454.CMB.1.raw
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
  modified_base (292)..(292): a, c, t, g, unknown or other
  misc_feature (292)..(292): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccggnaggaggtctccatctcttgttctgggancagctccgagtcggaaatagtttgctactggtaccagcagctccagaaaccggccccaagctccncatctataggaatgatcagcgccctcgagggactacctgaccgattctctggctcgaagttctcggtctcctcggccctcccgtggcccagtcaggtcgggcctccgggtccgaggactggacggctaggaattattacgtgtgcgtaggtttgggacttggccgtagttccgtagggtacgttgggtcccgttacgggtggtttaccgggcggggaacgggacccgaaggtccggtaggaccccggttccgtaacgggtccaacggccccgaacgggtccgtacccggcccccgttacggtcctacccg

SEQ ID NO: 83205 - DNA, 543 bp, Homo sapiens
  misc_feature: GYAE6OF02GFWIO.25.23.C01.1.454.CMB.1.raw
  modified_base (228)..(228): a, c, t, g, unknown or other
  misc_feature (228)..(228): n is a, c, g, or t
  modified_base (419)..(419): a, c, t, g, unknown or other
  misc_feature (419)..(419): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccgggcagagggtctccatctcttgttctgggancagctccgacgtcggaaataagtttgctactggtaccagcagctcccagaaacggcccccaagctcctcatctataggaatgatcagcggcctcagggatacctgaccgattcctctggctcgaagtctgctcctcggcctccgtggccatcagtgggctccggtcgaggagtgaggctagaatagttacngttgctaggttggatgcctagtcgtgagtggtccgtaggttcgttcgggcggagggaccaaggccgtcggaccgttccgtaggttccgaggcccgaaggtcctacggcccccttcggcctaccg

SEQ ID NO: 83206 - DNA, 565 bp, Homo sapiens
  misc_feature: GYAE6OF02I5YLA.25.23.C01.1.454.CMB.1.raw
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggancagctccgacgtcggaaataagtttgtctactggtaccagcagctccagaaacggcccccaagctcctcatctataggaatgatcagcgccctcagggatacctgaccgattctctgctcgaagtctggctcctcggccctcccgtggccatcagtcgggctccggtccgaggatggaggctagaattattactgtgctagtttgggatcgccagttctgtaggttcgggtccgtacgggtggttccgggcgggtacgggaccaaggcgtcggacccgttccgtaaggtccacggaccccgaaggtcccgtaccggccccccgttcggtccctacccg

SEQ ID NO: 83207 - DNA, 670 bp, Homo sapiens
  misc_feature: GYAE6OF02HASB3.25.23.C01.1.454.CMB.1.raw
  modified_base (205)..(205): a, c, t, g, unknown or other
  misc_feature (205)..(205): n is a, c, g, or t
  modified_base (227)..(227): a, c, t, g, unknown or other
  misc_feature (227)..(227): n is a, c, g, or t
  modified_base (230)..(230): a, c, t, g, unknown or other
  misc_feature (230)..(230): n is a, c, g, or t
tcagactgtacagtcacgaccggtgctcgatttagtacacgtgattagggattggggagcttcagctgtggtagagaagacaggattcaggacaatctccagcatggtcggcctccctctcctcctcaccctcctcactcactgtgcagggtccgtgggcccagtctgtgctgactcagccacctcagtgtctgggacccccggnaggaggtctcatctcttgtcgnggncagcctccgacgtacggtaaattagttgtctacgtcgtaccagcacgctacccgaacgaaacccggccccaagcctcctacactactaagtaaggaatcgactcgacggccggcctacgacggtactaccgtacgaccgtacttcgtcgtcggtactacggtacgttcgtcggtcccttcccgtcccggtcccttcccggtcggtaccctagtccggtacgggtcgggtacccgttccgggtaccggagggtagtacggacggtacgtaagtaaacttacgttacgtggtacgtacgttagggttgggtacgttcgtaccgtacgttcgtcggtacggtcggtccgggtacggttcggttccggggacggtacgggaaccgtaggtcgtacggtacccgttacgtacggtccaccggacccgtacggtcctcccgtcccg

SEQ ID NO: 83208 - DNA, 501 bp, Homo sapiens
  misc_feature: GYAE6OF02FL71G.25.23.C01.1.454.CMB.1.raw
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
  modified_base (417)..(417): a, c, t, g, unknown or other
  misc_feature (417)..(417): n is a, c, g, or t
  modified_base (446)..(446): a, c, t, g, unknown or other
  misc_feature (446)..(446): n is a, c, g, or t
  modified_base (454)..(454): a, c, t, g, unknown or other
  misc_feature (454)..(454): n is a, c, g, or t
  modified_base (457)..(457): a, c, t, g, unknown or other
  misc_feature (457)..(457): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggancagctccgacgtcggaaaatagtttgctactggtaccagcagctcccagaaacggcccccaagctcctcatctataggaatgatcagcggccctcagggatacctgaccgattctctggctcgaagtctggctcctcggcctccctggccatcagtgggctccggtccgaggatgaggctgaatattacngtgcagtttggatgcagtctgagtgtcgngtgtcggnggnggacagcgtgaccgtcgtaggtcagccaggcctgccccgtgctc

SEQ ID NO: 83209 - DNA, 537 bp, Homo sapiens
  misc_feature: GYAE6OF02JEQ8D.25.23.C01.1.454.CMB.1.raw
  modified_base (206)..(206): a, c, t, g, unknown or other
  misc_feature (206)..(206): n is a, c, g, or t
  modified_base (329)..(329): a, c, t, g, unknown or other
  misc_feature (329)..(329): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgtctgggagcagctccgacgtcggaaaataagtttgtctactggtaccagcagctccagaaacggccccaagctacctcatcctataggaatgatcagcggcctnagggctacctgaccgattctctggctcgaagtctggcctccgtcggcctccctggccatcgagtgggcctccggtccagggatggagctagaatattactgtgctagtttgggatggccagtctgagtcggtcgacggttgttcggcggtagggaccaagtctcgaccgtccgttaggaccaggtccccaaggtcctcggtccccccg

SEQ ID NO: 83210 - DNA, 539 bp, Homo sapiens
  misc_feature: GYAE6OF02INM6V.25.23.C01.1.454.CMB.1.raw
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccgggcagagggtctccatctcttgttctgggagcagcctccgacgtcggaaatagtttgctactggtaccagcagctccagaaaccggccccaagctcctcatctataggaatgatcagcgcctcgaggactacctgaccgattctctggtctacgaagtcgtggctccgtcggccctcccgtggccctatcgaggtcgggccgtccgggtccgaggagtggaggtctagtaatattacgtgtcgctaggttggatgcagtctgagtggtccgtaggtggtcggcggaggaccagcgtcgaccgtcgtaggtcgacgcccgaggcctcgccccgtggtcctccg

SEQ ID NO: 83211 - DNA, 535 bp, Homo sapiens
  misc_feature: GYAE6OF02GNAQX.25.23.C01.1.454.CMB.1.raw
  modified_base (191)..(191): a, c, t, g, unknown or other
  misc_feature (191)..(191): n is a, c, g, or t
  modified_base (219)..(219): a, c, t, g, unknown or other
  misc_feature (219)..(219): n is a, c, g, or t
  modified_base (312)..(312): a, c, t, g, unknown or other
  misc_feature (312)..(312): n is a, c, g, or t
  modified_base (452)..(452): a, c, t, g, unknown or other
  misc_feature (452)..(452): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcaaccaccctcagtgtctgggacccccgggnagagggtctccatctcttgttctgggancagctccgacgtcggaaataagtttgctactggtaccagcagctccagaaacggccccaagctcctcatctataggaatgatcagcggccctnagggatacctgaccgattctctggctcgaagtctggctctcggcctcctggccatcagtgggcctccggtcgaggatgaggctgaatattactgtgctaggtttggatgccagtctgagtggtccgacgggtgttcgggnggagggaccagcgtcgaccgtcgtaggtcacgcccaaggcctcgcccccgtcggtcctaccgtcctcgttccccacccttccc

SEQ ID NO: 83212 - DNA, 540 bp, Homo sapiens
  misc_feature: GYAE6OF02FWFXS.25.23.C01.1.454.CMB.1.raw
  modified_base (191)..(191): a, c, t, g, unknown or other
  misc_feature (191)..(191): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggagcagctccgacgtcggaaataagtttgtctactggtaccagcagctcccagaaacggcccccaagctcctcatctataggaatgatcagccggccctcagggatacctgaccgattctctggctcgaagtctggctcctcggcctcctggccatcagtgggctccggtccgaggatgaggctgaatattactgtgctagtttgggatgccagtctgagtggtccgacggttgttcgggcggagggaccaaggctgaccgtccgtaggtcacggcccgaaggcctcggcccccgtcggtccacgtccttcgttcccctacccc

SEQ ID NO: 83213 - DNA, 713 bp, Homo sapiens
  misc_feature: GYAE6OF02IKO3N.25.23.C01.1.454.CMB.1.raw
  modified_base (192)..(192): a, c, t, g, unknown or other
  misc_feature (192)..(192): n is a, c, g, or t
  modified_base (224)..(224): a, c, t, g, unknown or other
  misc_feature (224)..(224): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctggcccagtctgtgctgactcagccaccctcagtgtcctggggaccccccggnaggtacggtcctccatctcttgttcgtgggancagtcctaccggacgtacggtaaaattaggtttgtctacgtcggtaaccagcacgcctacccgaacggaaacccggcccccaagcctcctcactctagtagaatgactcgacgccgccctacgacgggtactaccgtcgaccgtacttcgtcgtcggtcctacgtaacgtcgtcggtccttcccgtaccggtcccttcccgtcggtaccctacgttccgtacggtccgggtcccgttcccgggtaccggtacgggtacgtcggtacggtcgtaggtaaacgttacgttacgtgtcgtcgttaggtttacgggtacgtcgtccgtagtcgtaggtacggttcgggtaccggtacgggttcggttccgggacgggtaacgggaccgtaacggtccgtaccggtacccgttcggtacggtaccgaccggtacccgtaacggtccgtcccgtccccgtcggtcccgtaccgttccgttccgttcccctacccg

SEQ ID NO: 83214 - DNA, 514 bp, Homo sapiens
  misc_feature: GYAE6OF02IM7AF.25.23.C01.1.454.CMB.1.raw
  modified_base (205)..(205): a, c, t, g, unknown or other
  misc_feature (205)..(205): n is a, c, g, or t
  modified_base (325)..(325): a, c, t, g, unknown or other
  misc_feature (325)..(325): n is a, c, g, or t
  modified_base (464)..(464): a, c, t, g, unknown or other
  misc_feature (464)..(464): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggagcagctccgacgtcggaaataagtttgtctactggtaccagcagctccagaaacgccccaagctcctcatctataggaatgatcagcgccctnagggatacctgaccgattctctggctcgaagtctggctctcgcctcctggccatcagtggctccggtcgaggatgaggctagaattacttactgtcgctaggtttggatgccagtctgtagtggtccgaggtgttcggnggacgggacaaggctgaccgtcgtaggtccagcccaggtcctcgtccccg

SEQ ID NO: 83215 - DNA, 580 bp, Homo sapiens
  misc_feature: GYAE6OF02HO5XT.25.23.C01.1.454.CMB.1.raw
  modified_base (200)..(200): a, c, t, g, unknown or other
  misc_feature (200)..(200): n is a, c, g, or t
  modified_base (228)..(228): a, c, t, g, unknown or other
  misc_feature (228)..(228): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctcgggacccccggnagagggtctccatctcttgttctgggancagcctccgacgtcggaaatagtttgtctactggtaccagcagctccagaaaccggcccccaagcctcctcatctataggaatgatcgacgcgccctcgagggactaccgtgaccgtattcgtctggctcgaagtcgtggcctccgtccggcctcccgtggccagtcgaggtcgggcgtccggtcgaggagtggacggtctagaatattactgtgtcgtaggttggatgcctagtcgtgtagtcggtccgcgggttggtcgggacgggacgggaccgaaggtcgtacggtacccgttcgtacggtccgacggacccgaacgggcctccggacccccgttcggtacctacccg

SEQ ID NO: 83216 - DNA, 526 bp, Homo sapiens
  misc_feature: GYAE6OF02IM3C1.25.23.C01.1.454.CMB.1.raw
  modified_base (185)..(185): a, c, t, g, unknown or other
  misc_feature (185)..(185): n is a, c, g, or t
  modified_base (282)..(282): a, c, t, g, unknown or other
  misc_feature (282)..(282): n is a, c, g, or t
  modified_base (384)..(384): a, c, t, g, unknown or other
  misc_feature (384)..(384): n is a, c, g, or t
tcagactgtacagtcacgaccggtgctcgatttagtacacgtgattagggattggggacaggattcaggacaatctccagcatggccggcctccctctcctcctcaccctcctcactcactgtgcagggtcctgggcccagtctgtgctgactcagccaccctcagtgtctcgggacccccgggnagagggtctccatctcttgttctgggagcagctccgacgtcggaaattaagtttgtctactggtaccagcagctcccagaaacggccccaagctccncatctataggaatgatcagcggccctcgagggatacctgaccgtattctctggctgaagtctggctcctcggccctcctggccatcagtcggctccggtcgngatgagctgaatatactgtgctaggtttggatcgcagttctgagtggtccgaggtgttcgggcggaggacaagctcgaccgtctaggcacgcccgaaggcctcgcccctcggctaccgtctcgtccccacctccctataccg

SEQ ID NO: 83217 - DNA, 626 bp, Homo sapiens
  misc_feature: GYAE6OF02IQUFW.25.23.C01.1.454.CMB.1.raw
  modified_base (211)..(211): a, c, t, g, unknown or other
  misc_feature (211)..(211): n is a, c, g, or t
  modified_base (241)..(241): a, c, t, g, unknown or other
  misc_feature (241)..(241): n is a, c, g, or t
  modified_base (358)..(358): a, c, t, g, unknown or other
  misc_feature (358)..(358): n is a, c, g, or t
  modified_base (423)..(423): a, c, t, g, unknown or other
  misc_feature (423)..(423): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagcccaccctcagtgtccgtggggaccccccgggnaggagggtcctccatctcttgttctgggancagctcgacgtcggaaatagttgtctactggtaccagcagctcccagaaaccggccccaagcctctcatctataggaatgatcagccggcctcgagggactacctcgaccgatttcnctggcttacgaagtctggcctccgtcggtcctccgtggcctatcgagtcggcctccggtcgaggntgagtcgccgtagtaattcgtttaacgtgtcggtacgtagggtttgggactttcggaccgtaggttcgttggacggttcgggtcccgggtacgggttcgggtttacgggccggggtaacgggtacccaaggggtcccgttacgggacccggttcccggtagggtacccgtacgggaccccggtaaggtccccgttaccccggg

SEQ ID NO: 83218 - DNA, 545 bp, Homo sapiens
  misc_feature: GYAE6OF02HIZFR.25.23.C01.1.454.CMB.1.raw
  modified_base (199)..(199): a, c, t, g, unknown or other
  misc_feature (199)..(199): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggagcagctccgacgtcggaaatagtttgtctactggtaccagcagctccagaacgccccaagctcctcatctataggaatgatcagcggccctcgaggatacctgaccgattctcgtgctcgaagtctggctcctcgcctcctggccatcagtcggctccggtccgaggatgaggctagaatattacgtgtgcgtagtttggatgcctagttctgtagtcggtccgagggttcgttacgggcgggagggaccaaggtccgtaggacccgttccgtaggtccacggcccgaaggcctaccggcccccgttcggtacctaccg

SEQ ID NO: 83219 - DNA, 600 bp, Homo sapiens
  misc_feature: GYAE6OF02HSTXD.25.23.C01.1.454.CMB.1.raw
  modified_base (341)..(341): a, c, t, g, unknown or other
  misc_feature (341)..(341): n is a, c, g, or t
tcagactgtacagtcacgaccggtgctcgatttagtacacgtgattagggattggggggggaagctcagcttcagctgtggtagagaagacaggattcaggacaatctccagcatggccggcctccctctcctcctcaccctcctcactcactgtgcagggtcctgggcccagtctgtgctgactcagcccaccctcagtgtctcggggacccccgggcaggagggtctccatctcttgttctgggagcagctccgacgtcggaaataagtttgtctactggtaccagcagctccagaaccgcccccaagctcctcatctatagaatgatcggcggccctnaggggactaccgtgacgtatctcgtggctcgaagtctggcctctccggcctcctcggccatcaggtcgggccgttccgggccgaggacgtggacggtctagtaattacgttactggtgcgttaggtttgggattcggaccgtagtcgtgtaggtcggtccggtacgggttcggttcggggcgggtaccggggacctaaggccgttacggtacccggttaccggtacgggtaccgaccggtacccggtaaggtcccccgg

SEQ ID NO: 83220 - DNA, 618 bp, Homo sapiens
  misc_feature: GYAE6OF02HY45O.25.23.C01.1.454.CMB.1.raw
  modified_base (203)..(203): a, c, t, g, unknown or other
  misc_feature (203)..(203): n is a, c, g, or t
  modified_base (353)..(353): a, c, t, g, unknown or other
  misc_feature (353)..(353): n is a, c, g, or t
  modified_base (371)..(371): a, c, t, g, unknown or other
  misc_feature (371)..(371): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctcggggaccccccgggnagagggtcctccatctcttgttctgggagcagcctccgacgtcggaaataagtttgtctactggtaccagcagcctcccaaggaaaccggcccccaagcctcctcatctataggaatgatcacgccgccctcgaggactacctgaccgtnttctcgtggctcgagtcnggcctccgtcggccctccgtggcctagtcgaggtcgggccgttccgggtccggaggagtggacggcgtagtaaattattacgtgtgcgttaggttgggatgccgtagttcgtgtacggttcggtccgtacgggttcggtacggggcgggtaacgggaccaacggtccgtcggtacccggttcggtacggtccgaaccggtcccgtaacgggtcccttacccggtccccccgttacggtccctaaccg

SEQ ID NO: 83221 - DNA, 709 bp, Homo sapiens
  misc_feature: GYAE6OF02JXWX2.25.23.C01.1.454.CMB.1.raw
tcagactgtacagtcacgaccggtgctcgatttagtacacgtgattagggattggggagctgtggtagagaagacaggattcaggacaatctccagcatggccggcctccctctcctcctcaccctcctccactcactcgtgcaggtcctgggcccagtctgtgctgactcagccaccctcacgtgtctcgggacccccggcagacgggtctcccgatccgtcttcgtctagggatcagctccggacgtcggaaatagtttgtcctactcggtaccagtcagtctacccaaggtaaaccgcccccaaggcctacctcgactcctagtacgaagtcgaatccacggtaccgcccctacgagggtactaccgtcgaaccggtactttacgccgttggacctacggtaagtccgtcgggaccttccgcgggtccctcccgtgggaccctacgttcgacgtcgggtcccgttccgggtaccgtacgggtcgtacggacggtccgtacggtaaacgttactttaacggtcggttacgccgttaaggtttgggtacgttcgtccgttaagtccgtaggcggttacgggtcccgtacgggtttcgttccggggtacggacggggtaccgaggtccgacggtaacccggttccgtacgggttaccgacggtacccggaacggccgttcccgggtacccctccgggttcccgtacccg

SEQ ID NO: 83222 - DNA, 685 bp, Homo sapiens
  misc_feature: GYAE6OF02F0U5W.25.23.C01.1.454.CMB.1.raw
  modified_base (215)..(215): a, c, t, g, unknown or other
  misc_feature (215)..(215): n is a, c, g, or t
  modified_base (244)..(244): a, c, t, g, unknown or other
  misc_feature (244)..(244): n is a, c, g, or t
tcagactgtacagtcacgaccggtgctcgatttagtacacgtgattagggattgggggggaagctcagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggnagagggtcctccatctcttgttctgggancagctccgacgtcgaaataagtttgtctactggtaccagcagcctcccagaaaccggcccccaagcctcctcatctataggaatgatcagcgccctcgaggactacctgaccgatttctctggctcgaagtctggcctccgtcggccctcccgtcggccagtccgaggtcgggccgtcccgggtccgagggtacgtcggagggtaccttaggaaacttacgtttaacgttggtcgtaccgttaggggttttacggggtaagttcggtacccgtaagggttccgttacggggtaacgggttccggggttacccggttaacggggttcgggttttcccgggggacggggtaaccgggggtaacccgtaaacgggtccgttacccgggttacccgggttacccggttaaccgggtccgtacccgggaccccggtaaacccgggg

SEQ ID NO: 83223 - DNA, 634 bp, Homo sapiens
  misc_feature: GYAE6OF02HT9VJ.25.23.C01.1.454.CMB.1.raw
  modified_base (170)..(170): a, c, t, g, unknown or other
  misc_feature (170)..(170): n is a, c, g, or t
  modified_base (222)..(222): a, c, t, g, unknown or other
  misc_feature (222)..(222): n is a, c, g, or t
  modified_base (234)..(234): a, c, t, g, unknown or other
  misc_feature (234)..(234): n is a, c, g, or t
  modified_base (304)..(304): a, c, t, g, unknown or other
  misc_feature (304)..(304): n is a, c, g, or t
  modified_base (368)..(368): a, c, t, g, unknown or other
  misc_feature (368)..(368): n is a, c, g, or t
  modified_base (471)..(471): a, c, t, g, unknown or other
  misc_feature (471)..(471): n is a, c, g, or t
  modified_base (474)..(474): a, c, t, g, unknown or other
  misc_feature (474)..(474): n is a, c, g, or t
  modified_base (479)..(479): a, c, t, g, unknown or other
  misc_feature (479)..(479): n is a, c, g, or t
tcagactgtacagtcacgaccggtgctcgatttagtacacgtgattaggggattggggcagcttcgagctgtggtacgagaagacaggtattcaggacaatctccagcatggccggcctcccgtctcctcctcaccctcctcacctcactgtcgcgaggtccgtggcccngtcgtgtgcgtcgacctcacgccacctcaggttcgtcgcgggacccccgggntaggtacggtcnccatcctcttagtctagggatcacgtctccgacgtaggaattaacgttcgtacgtactggtacccagacncgcctaccaaggtaaaccggccccaagtccttccgacggtactccggtaatacggaatgtaacncgagccgaccctggacggtatacctcgtaacctctctcgtcgtactacgaagttccgcggtctccgcggtaaccctccgtggctatcgagtcgtctcggtcgngancgagnttagtaatacgttactgacgtagtggttacgggatacgcgtagtacgttggacgtccggttcgacgggttcgtccgggtacggaaccggtacgacgtccgttccggaccttccggttaacgggccctaacgtacccggtagtacccgttacccgg

SEQ ID NO: 83224 - DNA, 535 bp, Homo sapiens
  misc_feature: GYAE6OF02GFI8E.25.23.C01.1.454.CMB.1.raw
  modified_base (206)..(206): a, c, t, g, unknown or other
  misc_feature (206)..(206): n is a, c, g, or t
  modified_base (234)..(234): a, c, t, g, unknown or other
  misc_feature (234)..(234): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggancagctccgacgtcggaaataagtttgtctactggtaccagcagctcccagaaaccggccccaagctcctcatctataggaatgatcagcgcctgaggatacctgaccgattctctggctcgaagtctgctccgtcggccctcccgtggccatcagtcgggccttcccgggtccgaggatggaggctagaattattactgtgcgtagtttgggatgcctagtctgagtggtccgaggtgttcggcggagggaccaagcgtcgaccgtccgtacggtcacgcccgaaggcctccgtcccccgg

SEQ ID NO: 83225 - DNA, 622 bp, Homo sapiens
  misc_feature: GYAE6OF02G8AHL.25.23.C01.1.454.CMB.1.raw
  modified_base (228)..(228): a, c, t, g, unknown or other
  misc_feature (228)..(228): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccgggcagagggtctccatctcttgttctgggancagctccgacgtcggaaataagtttgtctactggtaccagcagctcccagaacgcccccaagctcctcatctataggaatgatcagcggccctcgagggatacctgaccgattctctggctcgaagtctggcctccgtcgccctccctcggccatcgagtcgggctccgggtccggaggatggaggctagaatagttactgtgcgtaggtttgggatcgaccgtaggtctaggtacggttcgggtaccgtacggggttcggttcgggcggggtaacgggtaccgtaaggtcccggttacggtaccccggttcccggttaaggtcccgtaacggcccccggtaaagggtccccgtcccgggtacccccccgttcggggttaccccttaaccccgg

SEQ ID NO: 83226 - DNA, 526 bp, Homo sapiens
  misc_feature: GYAE6OF02GNGTI.25.23.C01.1.454.CMB.1.raw
  modified_base (191)..(191): a, c, t, g, unknown or other
  misc_feature (191)..(191): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggagcagctccgacgtcggaaataagtttgtctactggtaccagcagctcccagaaacggcccccaagctcctcatctataggaatgatcagcggccctcagggatacctgaccgattctctggctcgaagtctggctcctcgcctccctgccatcagtgggctccggtccgaggatgaggctagaatattactgtgctagtttgggatgccagtctgagtggtccgacggtgttcgggcggagggaccaagcgtgaccgtccgtaggtcagcccaaggctcgccccgtggtccactctcgtccctacccg

SEQ ID NO: 83227 - DNA, 520 bp, Homo sapiens
  misc_feature: GYAE6OF02F8WKR.25.23.C01.1.454.CMB.1.raw
  modified_base (313)..(313): a, c, t, g, unknown or other
  misc_feature (313)..(313): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccgggcagagggtctccatctcttgttctgggagcagctccgacgtcggaaatagtttgctactggtaccagcagctcccagaaacggcccccaagctcctcatctataggaatgatcagcggccctnagggatacctgaccgattctctggctcgagtctggctcctcgcctcctggccatcagtcgggctccggtcgaggatgaggctgaatagttactgtgcgtagtttgggatgccagtctgagtggtccgagggtgttcgggcggaggaccaagctgaccgtcgtaggtcagcccaaggctcgcccctggtccacgtctcgtccctaccc

SEQ ID NO: 83228 - DNA, 598 bp, Homo sapiens
  misc_feature: GYAE6OF02HZN0P.25.23.C01.1.454.CMB.1.raw
  modified_base (205)..(205): a, c, t, g, unknown or other
  misc_feature (205)..(205): n is a, c, g, or t
  modified_base (233)..(233): a, c, t, g, unknown or other
  misc_feature (233)..(233): n is a, c, g, or t
  modified_base (417)..(417): a, c, t, g, unknown or other
  misc_feature (417)..(417): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgcgcagggtcctgggcccagtctgtgctgactcagccaccctcagtgtctgggacccccggnagagggtctccatctcttgttctgggancagctccgacgtcgaaataagtttgtctactggtaccagcagctcccagaaccggccccaagctcctcatctataggaatgatcagcgccctacgagggactaccgtgaccgtattctcgtggctcgaagtctggcctcctccggccctcccgtggccatcaggtcgggcctccgggtcgaggntggagctagaattattactgtgcgtaggtttgggatcgccgtagtcgtgtaggtcggtaccggtacgggttggttccgggacgggtacggggaacccaagggtccgtacggtaaccccggttcccgtaacgggttccgaaccggaccccggtaaacgggtcccgtcccggtacccccccgg

SEQ ID NO: 83229 - DNA, 979 bp, Homo sapiens
  misc_feature: GYAE6OF02JXJ8W.25.23.C01.1.454.CMB.1.raw
tcagactgtacagtcacgaccggtgctcgatttagtacacgtgattaggattgggagagaagacaggattcaggacaatctccagcatggccggcctccctctcctcctcaccctcctccactcactgtgccagggtcctggcccagtctgtcgctcgactcacgccacctcacgtcgtccgtcgggaccccggtcacggtacgggtcctccagttccgttccgtttcgttccggtagggacgccgtacgtccgttacccggacggtaacggtaaactttaggttttcgtaccgttacgtcgggtaaccaggtactaacgttcccgacccgaaacggaaaccccggcccccaagtcctaccccgtactactccgtaactaacgggaactcggtaccttccggaacgtcccgggtaccccttaacggaccggggttaaaccttacccggtacggtaaacccgtttcttcccggtcgttacgggtaaccgtaaccggttaacggtcccggtttccggtaccctttccccggtccccggttccccgttaacccggttcgggacccccttagggttaaccgggcccggggtttccggggttacccgtttacccggggtaaccgggaacggttaccgggtacgggttaacccgggtaccgttaaacggttaaactttccgggttaacgtccggtttaacgggtaccggtttaaggggttttcggggtaacctccgggttaaacgttccggtttacgggttacgggttacgggttcccggttaccggggttaggggtttccgggtaccggggtaccggtaaaccggggtaccgacgggtttaccgtacccgggtacccgttacggggtttaccgacccgggttccgggtaaaccgtccccgggttccggttaccccgtaccccggggttttaccgacccggttttaaccccggtccccgttttcccccggtaccccggttcccgg

SEQ ID NO: 83230 - DNA, 664 bp, Homo sapiens
  misc_feature: GYAE6OF02JC72T.25.23.C01.1.454.CMB.1.raw
  modified_base (192)..(192): a, c, t, g, unknown or other
  misc_feature (192)..(192): n is a, c, g, or t
  modified_base (222)..(222): a, c, t, g, unknown or other
  misc_feature (222)..(222): n is a, c, g, or t
  modified_base (468)..(468): a, c, t, g, unknown or other
  misc_feature (468)..(468): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctcgggacccccgggnaggaggtcctccatcttcttgttctgggancagctccgacgtacggaaattagtttgtactactggtaccagcagcctccgaagaaaccgccccaagctcctcatctagtagaatgactacgagccggcctacgacggactaccgtcgacgtacttctacgtcggctacgagtcgtaggcctccgtcgtcctccgtcggcctagtcgtacggtcggcctccgggtcgaggactggacggtctagaattacttacgtcggagtcgttaggtttaggngttcgcctaggtcgtaggtaggttaccgggtccggtacgggttcggtttaccggggacgggtaacgggtaaccgagggtccgtacgggtacccgttacggtaccgggttaccggaaccgacccggtaacgtcccggttacccggtccccccgttggtacccctacgttccccgtttacccgtacccccgtaccccg

SEQ ID NO: 83231 - DNA, 589 bp, Homo sapiens
  misc_feature: GYAE6OF02GR9QA.25.23.C01.1.454.CMB.1.raw
  modified_base (191)..(191): a, c, t, g, unknown or other
  misc_feature (191)..(191): n is a, c, g, or t
  modified_base (219)..(219): a, c, t, g, unknown or other
  misc_feature (219)..(219): n is a, c, g, or t
  modified_base (416)..(416): a, c, t, g, unknown or other
  misc_feature (416)..(416): n is a, c, g, or t
  modified_base (426)..(426): a, c, t, g, unknown or other
  misc_feature (426)..(426): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggancagctccgacgtcggaaataagtttgtctactggtaccagcagctcccagaaaccgcccccaagctcctcatctataggaatgatcagcggccctcagggactacctgaccgattcctcgtggctacgaagtctggctccgtcggcctcctgccatcaggtcggctccggtcgagatgaggctagaatattactgtngtaggttggnttcgcctagtcgtggtaggtcggtccggtacgggttcggttccgggcgggacgggaaccgaaggtcgtcgacccgttaccgtagggtccacggacccgtaacggtccgtaccggccccccgttcgggtccctaccgtccgtttacccgtcccccgtacccccg

SEQ ID NO: 83232 - DNA, 509 bp, Homo sapiens
  misc_feature: GYAE6OF02FL83X.25.23.C01.1.454.CMB.1.raw
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggcagagggtctccatctcttgttctgggagcagctccgacgtcggaaataagtttgtctactggtaccagcagctcccagaacggcccccaagctcctcatctataggaatgatcagcgccctcagggatacctgaccgattctctggctcgaagtctggctcctcggcctccctggccatcagtgggctccggtccgaggatgaggctgaatattactgtgcagtttggatgccagtctgagtggtccgacggtgtcggcggagggcagcgtgaccgtcgaggtcagcccaggcctgtcccccg

SEQ ID NO: 83233 - DNA, 634 bp, Homo sapiens
  misc_feature: GYAE6OF02I6NGQ.25.23.C01.1.454.CMB.1.raw
  modified_base (239)..(239): a, c, t, g, unknown or other
  misc_feature (239)..(239): n is a, c, g, or t
  modified_base (265)..(265): a, c, t, g, unknown or other
  misc_feature (265)..(265): n is a, c, g, or t
  modified_base (277)..(277): a, c, t, g, unknown or other
  misc_feature (277)..(277): n is a, c, g, or t
tcagactgtacagtcacgaccggtgctcgatttagtacacgtgattagggattggggcagcttcagctgtggtagagaagacaggattcaggacaatctccagcatggccggcctccctctcctcctcaccctcctcactcactgtgcagggtcctgggcccagtctgtgctgactcagccaccctcagtgtctcggggaccccccgggaggagggtctccatctcttgttctgggacncagcctccgacgtcggaaatagtttnctactggtaccngcagctccagaaaccggccccaagcctcctcatctataggaactgatcagccggaccctcgagggactaccgtgaaccgattctctggctcgaagtcgtgcctccgtccggtccctcccgtcggaccctacgtcctacgggtcgggtcccgttccgggtcccgggtaaggtacgtcgggacggtacgtaggtaaagtactttaacgtggtcggtacgttaggtttagggtatcggtacctacggttcgtagtaggttcgggtaccgacgggttgggttcgggacgggtacgggacctaggccgttacggtaaccgttcgtacgggttaccgaccggtacccgaaggtcctaccccgg

SEQ ID NO: 83234 - DNA, 618 bp, Homo sapiens
  misc_feature: GYAE6OF02G0IAC.25.23.C01.1.454.CMB.1.raw
  modified_base (210)..(210): a, c, t, g, unknown or other
  misc_feature (210)..(210): n is a, c, g, or t
  modified_base (242)..(242): a, c, t, g, unknown or other
  misc_feature (242)..(242): n is a, c, g, or t
  modified_base (440)..(440): a, c, t, g, unknown or other
  misc_feature (440)..(440): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagcccaccctcagtgtcgtcgggaccccccgggnaggacgggtcctccatcctcttgttctgggancagctccgacgtcggaaatagttgtctactggtaccagcagctacccgagaaaccggccccaagcctcctcatctaataggaatgatcagccggccctacgaggactaccgtgaccgtattctctggctacgaagtctggcctcccgtccggcctcccgtcggccatccgaggtcgggcctcccggtcgaggactggngtctagtaacgttagttacgtgtacgtacttagggtttcggacttcggaccgtagtcgttaggtacggtcggtacccggtacgggttcgtcggggacggaaccgggtaaccgaaggtccgtacggaccgttacccggtaggtccgaccgacccggaaggtcccgtccggtccccccgg

SEQ ID NO: 83235 - DNA, 658 bp, Homo sapiens
  misc_feature: GYAE6OF02ITOFV.25.23.C01.1.454.CMB.1.raw
  modified_base (191)..(191): a, c, t, g, unknown or other
  misc_feature (191)..(191): n is a, c, g, or t
  modified_base (632)..(632): a, c, t, g, unknown or other
  misc_feature (632)..(632): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggagcagctcgacgtcggaaataagttgtctactggtaccagcagctccaagaaacggccccaagcctcctcatctatagaatgatcagcggcctgagggatacctgaccgtattctctggctcgaagtctggcctccgtcggtcctacccgtgcctatcgacggtgggtcccttaccgggtccgaagggtacgtggacggtcgtagtaaacttagttaaccgttgtcggtacgttagggttttgggtaacttggtaccctaggtccgttaggttacgggttacgggttacccgggtaacggggtttcgggttaccgggggacgggtaacggggtaaccgtaacggtccgtacggtacccgttccggtacgggtacaccggacccgtaacggtaccgtccgtcccccgtcggtaccnccgttccgttcccgtcccctaccccg

SEQ ID NO: 83236 - DNA, 723 bp, Homo sapiens
  misc_feature: GYAE6OF02IB9X9.25.23.C01.1.454.CMB.1.raw
  modified_base (203)..(203): a, c, t, g, unknown or other
  misc_feature (203)..(203): n is a, c, g, or t
  modified_base (237)..(237): a, c, t, g, unknown or other
  misc_feature (237)..(237): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccacctcagtgctcgggaccccggnaggaggtctccatccttcgttgttcgtaggggcncgagccgtccggacgtacggtaaaagtaagtttgtctaacgtcggtacagcagtcctaccaacggaaccggaccccaacgtcctcctacacttacctaagtacggaattgactacgacggccggtccctagacgggtactaccgtacgaccgtattcctcgtcgtcgtacgaacgtcgtacgtcctccggtccgacccgtttcccgtcgacctacgtccgtgggtcggtccgtccgggtacggaggtcgtaggacggtctaacgtaagttactttacgtcgtacggtccgttagggtttaggtactcggtacccgtaggttccgttgggttaacgggttccgggttaccggttaccggggttcgggttaccgggggtaaccggggtaccgggaaccggtaacggtccggttacgggtaaccccggttcggttaaccggtccggtaaccgggtacccgacggttccccggtcccggttccccccggg

SEQ ID NO: 83237 - DNA, 727 bp, Homo sapiens
  misc_feature: GYAE6OF02JZBJB.25.23.C01.1.454.CMB.1.raw
  modified_base (201)..(201): a, c, t, g, unknown or other
  misc_feature (201)..(201): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctcggggacccccggnaggacgggtctccatcctcttgttctgggagcagcctccgacgtacggaaattagtttgtctactggtaccagcagctcccagaaacccggcccccaagcctaccctcactctaatagaatgatcacggccggccctagagggacttaccggtacgaccgtactttcctacgttgaccgttacgtaacggttcctcggccttacccgtccggccttccccgtggccctacgtccgtacgggttcgggtacccgtccccgggttaccggaggtactacgggacgggtccttaggtaaccttaacgtttaccgttaggtcggtaccgttagggtttcggggaactttcggaccgttagtccgttagggtacggttcggggttaccggtagggttcggttaccggggacgggtacgggtacccgtaaggtccggtacggtaacccggttccggtaacggttacccgaccggtacccggtaaggggttccccttaccgggtccccccgtttacgggtcccttacccccgg

SEQ ID NO: 83238 - DNA, 561 bp, Homo sapiens
  misc_feature: GYAE6OF02IKOCC.25.23.C01.1.454.CMB.1.raw
  modified_base (195)..(195): a, c, t, g, unknown or other
  misc_feature (195)..(195): n is a, c, g, or t
  modified_base (410)..(410): a, c, t, g, unknown or other
  misc_feature (410)..(410): n is a, c, g, or t
  modified_base (413)..(413): a, c, t, g, unknown or other
  misc_feature (413)..(413): n is a, c, g, or t
  modified_base (546)..(546): a, c, t, g, unknown or other
  misc_feature (546)..(546): n is a, c, g, or t
  modified_base (558)..(558): a, c, t, g, unknown or other
  misc_feature (558)..(558): n is a, c, g, or t
tcagactgtacagtcacgaccggtgctcgatttagtacacgtgattagggattgggggagagaagacagggattcaggacaatctccagcatggccggcctccctctcctcctcacccctcctcactcactgtgcagggtcctgggcccagtctgtgctgactcagccaccctcagtgtctcggggacccccggnagagggtctccatctcttgttctgggagcagcctccgacgtcggaaatagtttgctactggtaccagcagctcccagaaaccggcccccaagcctcctcatctataggaatgatcaggccggccctcgagggactacctgaccgattctctggctacgaagtctggctcctcggcctccgtggccatcacggtcgggcctccggtccgaggtagnggnggctagtaatacttactgtgactaggtttgggatggcctagtgtgaggttgggtccgtacgggttgttcgggcgggtacgggacgtaagcgtgaccgtccgtaggtcacgccgacggtctccgccccgtgccncgtctcgtcccnccc

SEQ ID NO: 83239 - DNA, 672 bp, Homo sapiens
  misc_feature: GYAE6OF02J083O.25.23.C01.1.454.CMB.1.raw
  modified_base (200)..(200): a, c, t, g, unknown or other
  misc_feature (200)..(200): n is a, c, g, or t
  modified_base (232)..(232): a, c, t, g, unknown or other
  misc_feature (232)..(232): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcaggtcctgggcccagtctgtgctgactcagccaccctcagtgtcctgggaccccccggnaggagggtcctccgatctcttgttctgggacncagcctccgacgtcggaaatacgtttgctactggtacagcagctccagaaccgccccaagctcctcactcatacgaatcgataccgagccggtccctagacgggtactaccgtacgacccgtaatttcctaccgtggtcctacggaagttcccgtggtcccttccgtcgggcccttcccgtggaccctagtccgtacggtcgggccgttcccggtccggacggtcgttacggacggtctaggaacgttaacgttccgtggtcggtccgtaggtttcgggacttcggtaccgtcgttaccgtaggtacggttcgggttacccgtaacggggttccggttacggggacgggtacgggtaccgtaaggtccggtacgaccggttcgtaccggttaccgacggacccgtaacgggccgtaccggcccccgttcggtccctaccg

SEQ ID NO: 83240 - DNA, 543 bp, Homo sapiens
  misc_feature: GYAE6OF02GWGAW.25.23.C01.1.454.CMB.1.raw
tcagactgtacagtcacgaccggtgctcgatttagtacacgtgattagggattgggagggctttgttggagaccctgtccctcacctgcagtgtctctggtggctccgtcagtgcttattactggagctggatccgccagtccgccgggaggggactggagtggattgggcgtatatatacgaatggattaaccacctacaacccctccctcaagagtcgagtcaccatatcagcggacacgtccaggggatcaggtgttcctgcatctgacttctgcgactgccgcggacacggccctatactactgtgccagagattcggactgcgacgatttttcggagaattattatcttttgtgtcttttgacatgtggggccaaggggacgacggtcaccgtctcttcagcctccaccaagggcccatcggtccttccccctggccacccctcctccaacgacgccacctctgggggccacgacgcggccctgggctgcctggtcaagacctacttccactcgtacagtctgagcggctggcaacgg

SEQ ID NO: 83241 - DNA, 648 bp, Homo sapiens
  misc_feature: GYAE6OF02JFE3D.25.23.C01.1.454.CMB.1.raw
  modified_base (172)..(172): a, c, t, g, unknown or other
  misc_feature (172)..(172): n is a, c, g, or t
  modified_base (192)..(192): a, c, t, g, unknown or other
  misc_feature (192)..(192): n is a, c, g, or t
  modified_base (196)..(196): a, c, t, g, unknown or other
  misc_feature (196)..(196): n is a, c, g, or t
  modified_base (222)..(222): a, c, t, g, unknown or other
  misc_feature (222)..(222): n is a, c, g, or t
  modified_base (348)..(348): a, c, t, g, unknown or other
  misc_feature (348)..(348): n is a, c, g, or t
  modified_base (353)..(353): a, c, t, g, unknown or other
  misc_feature (353)..(353): n is a, c, g, or t
  modified_base (639)..(639): a, c, t, g, unknown or other
  misc_feature (639)..(639): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagcccaccctnagtgtctggggacccccggnaggngggtcctccatctcttgttctgggancagcctaccgacgtcggaaattagtttgctactggtaccagcagcctaccaagaaaccggcccccaagcctcctcactctaagtaggaatgatcgagccggccctgagggactaccgtgaaccgtntttcncgtcggccttacgaagttcgtggtccctccgtccggacccttcccgtaggcctagttcggtcgggccttcccggtcggaggagtggaggcctagtaatacttacgtgtagtctaggtttcggatcgcctaggtctggtaggttccggtaccggtcggttcgggttcgggacgggaacgggtaccgaacggtcgtacggtaccgttacccgtaggtaccgaaccggtaccgaacgggtcccgtaccggtccccgttcggtacctacccgttcgtcccgggttccccncccttcccg

SEQ ID NO: 83242 - DNA, 747 bp, Homo sapiens
  misc_feature: GYAE6OF02JR19X.25.23.C01.1.454.CMB.1.raw
  modified_base (200)..(200): a, c, t, g, unknown or other
  misc_feature (200)..(200): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctcgggacccccggnagagggtctccatctcttgttctggagcagctccgacgtcggaaatagtttgctactggtaccagcagcctaccgagaaccgccccaagtctcctcatctaatacggaatgactcgacgtccggaccctacgacgggactacccgtagtaaccgtacttccgtaccgtcggtaccgtacggtaaacgtttccgtccggtccttacccgtcccgggtccccttccccggtaggaccctacgttccgaacgggttccgggacccgttcccgggttacccggaaggtacgtcggacgggtccgttaagtaacgttacgtttaccgtcggtacggtaccgttaagggtttaggaacggttaccgtccgtaaggttcgtacgggtacggttacgggttacccgggttacgggttcgggttaccggggacgggtaaccgggacgtaaccgtaccggtacccggtaacccggttaccggtaaccggttacccggaacggtaccccgtaacgggtcccgttaccccggtacccccgttccggtacccttacccgg

SEQ ID NO: 83243 - DNA, 554 bp, Homo sapiens
  misc_feature: GYAE6OF02GGDY0.25.23.C01.1.454.CMB.1.raw
  modified_base (192)..(192): a, c, t, g, unknown or other
  misc_feature (192)..(192): n is a, c, g, or t
  modified_base (220)..(220): a, c, t, g, unknown or other
  misc_feature (220)..(220): n is a, c, g, or t
tcagactgtacagtcacgaccggtgctcgatttagtacacgtgattagggattggggagagaagacaggattcaggacaatctccaacatggccggcctccctctcctcctcaccctcctcactcactgtgcagggtcctgggcccagtctgtgctgactcagccaccctcagtgtctgggaccccccgggnagagggtctccatctcttgttctgggancagctccgacgtcggaaatagtttgtctactggtaccagcagctcccagaaacggcccccaagctcctcatctataggaatgatcagcggccctcagggatacctgaccgattctctggctcgaagtctggctcctcggcctcccgtggccatcaggtggcctccggtccgaggatggaggctaggaattattactgtgcgtaggtttggatgccagtctgagtggtccgaggtgttcgggcggagggaccagctgaccgtcgtaggtcgacgcccgaaggccctacggcccccgttcggtccaccgttccgtcggttcccccgcccttccccg

SEQ ID NO: 83244 - DNA, 614 bp, Homo sapiens
  misc_feature: GYAE6OF02FW4WI.25.23.C01.1.454.CMB.1.raw
  modified_base (206)..(206): a, c, t, g, unknown or other
  misc_feature (206)..(206): n is a, c, g, or t
  modified_base (301)..(301): a, c, t, g, unknown or other
  misc_feature (301)..(301): n is a, c, g, or t
  modified_base (307)..(307): a, c, t, g, unknown or other
  misc_feature (307)..(307): n is a, c, g, or t
  modified_base (343)..(343): a, c, t, g, unknown or other
  misc_feature (343)..(343): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggnagagggtcctccatctcttgttctgggagcagctccgacgtcggaaatagtttgctatggtaccagcagctcccagaaccggccccaagctcctnatctanaggaatgatcagccgccctgaggactacctgaccgnttctctggctcgaagtctggctccgtcggccctccgtgccatcgaggtcgggcctccggtccgaggatcggacggtcgtagtaattagttactggtcgacgttaggtttgggacttcggaccgtaagttcgtaggtacggttcggtacccggtacgggttcggttcggggacgggtaacgggggtaacccaagggttccgtacgggacccgttaccggtaacgggtccgaaccggtaccccggaacggtcccgtaccggttacccccccgg

SEQ ID NO: 83245 - DNA, 656 bp, Homo sapiens
  misc_feature: GYAE6OF02IU2NB.25.23.C01.1.454.CMB.1.raw
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtccgtgggacccccggcagagggtcctcatctcttgttctgggagcagctcgacgtcggaaatagttgtctactggtaccagcagctacccgaagaaccggccccaagcctcctcatctaataggaaatgactcgacgaccggcctacgaagggactaccgtcggaacccgtatttcctcgtggccttacgaagttctcggtcctccgtccggccctcccgtcggccctatccgtagtcgggccttcccgggtccggaaggtctcgggacggacgttaggtaaattagtttaccgtgtacgacgttaggtttgggaagttcgtaccgtaggtcgtaggtacggttcgggtaccggtacggggttcggttaccggggacgggtaacggggaacctaacggtcggtaccggtaccggtacccgttaggtccgaccgtacccgaacgggtcccgtaccggtccccccgg

SEQ ID NO: 83246 - DNA, 603 bp, Homo sapiens
  misc_feature: GYAE6OF02HS83Q.25.23.C01.1.454.CMB.1.raw
  modified_base (210)..(210): a, c, t, g, unknown or other
  misc_feature (210)..(210): n is a, c, g, or t
  modified_base (240)..(240): a, c, t, g, unknown or other
  misc_feature (240)..(240): n is a, c, g, or t
  modified_base (316)..(316): a, c, t, g, unknown or other
  misc_feature (316)..(316): n is a, c, g, or t
  modified_base (358)..(358): a, c, t, g, unknown or other
  misc_feature (358)..(358): n is a, c, g, or t
tcagactgtacagtcacgaccggtgctcgatttagtacacgtgattagggattggggcagcttcagctgtggtagagaagacaggattcaggacaatctccagcatggccggcctccctctcctcctcacccctcctcactcactgtgcagggtcctgggcccagtctgtgctgactcagccaccctcagtgtcctgggaccccccgggnaggagggtctccattctcttgttctgggancagctccgacgtcggaaattaagtttgtctactggtaccagcagctccaagaaccggccccaagcctctcatctanaggaatgatcagccggccctgaggactacctgaccgtattcngtcggctcgagtctgctcctcggccctccgtgcctactcgaggtcggccgtccggtccgaggtagtcggacggtctagaattagttaacgtgtcgcgttaggtttggatcgtaccgtagttcgtggtaggtacggttccggtagggttcggttaccgggacgggaacgggtacccgaagggtccgtaccggtacccggttaccggttacggtaccgacccggacccgtaacggtccgtaccccgg

SEQ ID NO: 83247 - DNA, 746 bp, Homo sapiens
  misc_feature: GYAE6OF02JEBYH.25.23.C01.1.454.CMB.1.raw
  modified_base (199)..(199): a, c, t, g, unknown or other
  misc_feature (199)..(199): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcaggtcctgggcccagtctgtgctgactcagccaccctcagtgtctcgggacccccggnagagggtctccatctcttgttctgggagcagctccgacgtcggaaatagttgtctactgtaccagcagctccagaaccggccccaagctcctcatctataggaatgatcagacgcctcgagggactactgaccgtattctacgtcggctacgaacgtcgtacggcctccgtaccgcccctcccgtacggccctagttccgagggtcgggtcccgttcccgggtccggacgggtagtcgggacggtccgtaggtaaacgttacgtttaacgttgggttacgtaccgtagggtttttagggaacgttcgtacccgtaacggtttccgtagggttaacgggtttcggggttacccgggttaacgggggtttccgggttaacccgggggtaccggggtaacggggtaaccccgtaacgggtacccgttaacccggggtacccccggtttaccgggttaaccggggtaccgtaaccccgggtacccggtaaaccgggtcccccggttaccccgggacccccccggtttcccgggttaaccccttaccccggg

SEQ ID NO: 83248 - DNA, 556 bp, Homo sapiens
  misc_feature: GYAE6OF02GN538.25.23.C01.1.454.CMB.1.raw
  modified_base (228)..(228): a, c, t, g, unknown or other
  misc_feature (228)..(228): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccgggcagagggtctccatctcttgttctgggancagctccgacgtcggaaatagtttgtctactggtaccagcagctccagaaacgcccccaagctcctcatctataggaatgatcagcggccctcagggatacctgaccgattctctggctcgaagtctggctcctcggcctcccgtggccatcagtcgggctccggtcgaggatggacggctggaattattacgtgtcgcgtagtttgggatgccagttcgtgtaggtggtccggtacgggttggttccgggcgggtacgggaccgaagtcgtcggaccggttccgtaaggtccacggcccaaggcctacgccccgtcggtcctacccg

SEQ ID NO: 83249 - DNA, 842 bp, Homo sapiens
  misc_feature: GYAE6OF02GKYPR.25.23.C01.1.454.CMB.1.raw
  modified_base (196)..(196): a, c, t, g, unknown or other
  misc_feature (196)..(196): n is a, c, g, or t
  modified_base (233)..(233): a, c, t, g, unknown or other
  misc_feature (233)..(233): n is a, c, g, or t
tcagactgtacagtcacgaccggtgctcgatttagtacacgtgattagggattggggagagaagacaggattcaggacaatctccagcatggccggcctccctctcctcctcaccctcctcactccactgtcgcagggtcctggcccagtctgtgctgactcagccaccctcagtgtcctacggggacccccgggnaaggcgggtctccattcctcgttcgttcgtaggggancctggcctaccggacggtacggaaaatttacgggttttctacgtacctagggtaacccaggtaccagcccgttacccgaaacgggtaaaacccgggaccccccccttaaggacccctaccccgttcctaaccttacctttaaaccgtaacgggtaaactttggaaacgtttcccgaaacgggtcccggacccccgtttaaccggaaggggaccttaaaccccgtttagggaaccccggtaattttcccgtacgttcggggtacctacggtaaacgttccgttagggtccctcccggttccggtaaccccgtcccgtacgggacccctaagttcccgtaggttcgggtccgtccccggttaccgacgggtacgttcggagggtccgtagtaacgttaacttacgtgtacggtcgttacggttgggtaattcggaccgtacgttccgtagccggttacggtccggtaccgggttggttcggaccgggttaacgggacccgagtacgtaccggtccgtaaccggtttcgaccgggacctacccggaagggtacccctccgggtaccccttccggggtaccctaccggttccttacggtccccttaacccccg

SEQ ID NO: 83250 - DNA, 632 bp, Homo sapiens
  misc_feature: GYAE6OF02F44CC.25.23.C01.1.454.CMB.1.raw
  modified_base (205)..(205): a, c, t, g, unknown or other
  misc_feature (205)..(205): n is a, c, g, or t
  modified_base (233)..(233): a, c, t, g, unknown or other
  misc_feature (233)..(233): n is a, c, g, or t
  modified_base (333)..(333): a, c, t, g, unknown or other
  misc_feature (333)..(333): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggancagctccgagtcgaaatagttgtctactggtaccagcagctccagaacgccccaagctcctcatctaataggaatgatcagcggccctcgagggataccngaccgattctctggctcgaagtctggctcctcggccctccgtggccatcaggtcgggcctccgggtccgagggtactggacgggcttagaattattaacgtgtcgtcgtaggtttgggattcggacctaggttcgtaggtacggttcgggtacccggtacgggtttcggtttacggggaccgggtaacgggggtaaccctaaacgggtccgttaaccgggtaaccccggtttacccggtaacggggttcccaacccgggaccccggtaaacgggtcccttacccgggtaccccccccgg

SEQ ID NO: 83251 - DNA, 573 bp, Homo sapiens
  misc_feature: GYAE6OF02GBSVN.25.23.C01.1.454.CMB.1.raw
  modified_base (191)..(191): a, c, t, g, unknown or other
  misc_feature (191)..(191): n is a, c, g, or t
  modified_base (312)..(312): a, c, t, g, unknown or other
  misc_feature (312)..(312): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggagcagctccgacgtcggaaatagtttgctactggtaccagcagctccagaaaccgcccccaagctcctcatctataggaatgatcagcggccctnagggatacctgaccgattctcgtggctacgaagtctggacctcctccggcctcccgtggcccatccgaggtcgggacctccgggtccgaggatggaggctagaattacttacgtgtcggctaggtttcgggattcgcctagtctggagttcgggtccgtaggttcggtcggcgggtaacggaccaagcgtacgaccgtcgtacgggtcacggtacccgaaggcctcggcccctcggtccacgtctaccgttcccctacccg

SEQ ID NO: 83252 - DNA, 637 bp, Homo sapiens
  misc_feature: GYAE6OF02IEKXY.25.23.C01.1.454.CMB.1.raw
  modified_base (238)..(238): a, c, t, g, unknown or other
  misc_feature (238)..(238): n is a, c, g, or t
tcagactgtacagtcacgaccggtgctcgatttagtacacgtgattagggattggggcagcttcagctgtggtagagaagacaggattcaggacaatctccagcatggccggcctccctctcctcctcaccctcctcactcactgtgcagggtcctggcccagtctgtgctgactcacgccaccctcagttgtctcggggaccccccgggcagagggtctccatctcttgtctgggancagctccgagtcgaaataagtttgctactggtacagcagctccagaaaccgccccaagcctcctcatctatagatgatcagccgcctgacggactaccgtgaaccgtattctctcggtcgttacggaagttcctcggccttccccgtcgggtcccccttaccgtcggccctacgtcgtacgggtcggtaccgttcccgggtaccggaagggacgtaggacggtacttaggtaaattacgttaacgtgtcggtactagggtttgggatcgaccgtagttcgtggtacggtcggttaccggtacgggttgggttaccgggacgggaaccgggaaccaggtacccgtacgtacccggttaccgttacgggtaccgaccggacccgtaagggtccctacccgg

SEQ ID NO: 83253 - DNA, 562 bp, Homo sapiens
  misc_feature: GYAE6OF02H5Z9Y.25.23.C01.1.454.CMB.1.raw
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
  modified_base (406)..(406): a, c, t, g, unknown or other
  misc_feature (406)..(406): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggancagctccgacgtcggaaatagtttgtctactggtaccagcagctccagaacggccccaagctcctcatctataggaatgatcagccggccctcgagggactacctgaccgattctctgctcgaagtctggctccgtcgcctcccgtcgccactcagtcgggtccgtccgggtccgaggntggaggtctagtaatattactgtgcttaggttggatcgccgtagtctggagtcgggtaccgtacgggttcgttcgggcgggaggaccgaaggccgtcggacccgtccgtaggtccacggcccgaacggtcctccggcccccgttcggtcctacccg

SEQ ID NO: 83254 - DNA, 584 bp, Homo sapiens
  misc_feature: GYAE6OF02GHEMF.25.23.C01.1.454.CMB.1.raw
  modified_base (191)..(191): a, c, t, g, unknown or other
  misc_feature (191)..(191): n is a, c, g, or t
  modified_base (399)..(399): a, c, t, g, unknown or other
  misc_feature (399)..(399): n is a, c, g, or t
  modified_base (424)..(424): a, c, t, g, unknown or other
  misc_feature (424)..(424): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggagcagcctccgacgtcggaaattagtttgtctactggtaccagcagcctcccagaaaccggcccccaagcctcctcatctataggaatgatcagccggccctcgagggactaccgtgaccgattctctggctcgaagtctgctccgtcgcctcctgccatcgagtcgggctccggtcgaggntgaggctagtaatacttacgtgtgngttaggttggatcgcgtgtcgtgtaggtcggtccgtcgggttggttcgggacgggacgggaccgaaggtcgtacgtaccgtcgtacggtcgacggcccgaacggtccgtccggcccccgttcggtaccctaccgttcccgttcccgttccccgtcccccg

SEQ ID NO: 83255 - DNA, 594 bp, Homo sapiens
  misc_feature: GYAE6OF02I4ZJT.25.23.C01.1.454.CMB.1.raw
  modified_base (235)..(235): a, c, t, g, unknown or other
  misc_feature (235)..(235): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagcccaccctcagtgtctcgggacccccgggcagagggtctccatctcttgtctgggancagctcgacgtcggaaataagttgtctactggtaccagcagctccagaaccggccccaagctcctcatctataggaatgatcagccgcctgagggactaccgtgaccgtattcctctggctacgtaagtctcgctccgtcggccctcccgtggcctagtcgtaggtcggccgtccggtccgagtcgtaggacgactaggtaacttagttaccgtgtcgcgttaggtttgggactcggacctaggttccgttagaggttccggtaccggtacgggttggttaccgggcgggtaaccgggtacgacgtcgtacggtaccgttccgtaggtccgaacgccgtaacggtctcccggtcccccg

SEQ ID NO: 83256 - DNA, 540 bp, Homo sapiens
  misc_feature: GYAE6OF02I262I.25.23.C01.1.454.CMB.1.raw
  modified_base (206)..(206): a, c, t, g, unknown or other
  misc_feature (206)..(206): n is a, c, g, or t
  modified_base (408)..(408): a, c, t, g, unknown or other
  misc_feature (408)..(408): n is a, c, g, or t
  modified_base (411)..(411): a, c, t, g, unknown or other
  misc_feature (411)..(411): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggagcagctccgacgtcggaaataagtttgtctactggtaccagcagctcccagaacggcccccaagctcctcatctataggatgatcagcggccctcgagggatacctgaccgattctctggctcgagtctggctccgtcggccctcccgtgcccatccagtcggctccggtcgagntgngctgatattactgtcgctaggttggatcgccagtctggagtcggtccggtacggtgttcgggcggacgggacaacggctacggcccgttacgtaggtccaggtcccgaagggtcctccggtccccccgg

SEQ ID NO: 83257 - DNA, 609 bp, Homo sapiens
  misc_feature: GYAE6OF02H3TN4.25.23.C01.1.454.CMB.1.raw
  modified_base (205)..(205): a, c, t, g, unknown or other
  misc_feature (205)..(205): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggaccccggnagagggtctcatctcttgttctgggagcagcctccgacgtcggaaattaagtttgtctactggtaccagcagctccagaaaccgccccaagctcctcatctataggaatgatcgacgcggccctcgacgggataccgtgaccgtattcctctggctcgaagtctcgctccgtccggcccttcccgtcggccctagtccgaggtcgggcctccgggtcgaggagtcgacggtctagtaattagttacgtgtgtgtaggtttgggactcggacctagtcgtggtaggttcgggtccggtacggtgggttaccgggcggggaacggtaccgaacggtccgttacggtacccgtaccggttacgggacgtacccgtacccggaagggtcccgttcccggtccccccgg

SEQ ID NO: 83258 - DNA, 584 bp, Homo sapiens
  misc_feature: GYAE6OF02H29S0.25.23.C01.1.454.CMB.1.raw
  modified_base (199)..(199): a, c, t, g, unknown or other
  misc_feature (199)..(199): n is a, c, g, or t
  modified_base (329)..(329): a, c, t, g, unknown or other
  misc_feature (329)..(329): n is a, c, g, or t
  modified_base (365)..(365): a, c, t, g, unknown or other
  misc_feature (365)..(365): n is a, c, g, or t
tcagactgtacagtcacgaccggtgctcgatttagtacacgtgattagggattggggagctgtggtagagaagacaggattcaggacaatctccagcatggccggcctccctctcctcctccaccctctcatcactgtgcagggtcctgggcccagtctgtgctgactcagccacctcagtcgtctcgggacccccggnagagggtctccatctcttgttctgggagcagctccgacgtcggaaatagttgctatggtaccagcagctccagaaaccgccccaagctcctcatcataggatgatcagcgcctcagggactactgaccgnttctctggctagagtctggcctcctgcccttcccgnggcctagtcagtcgggcctccgggtcgagggattggacggtctagtaacttattacgtggtcgcgtagtttcggattcggacctagtcgtagtacggtcggtaccgcgggttcggttcgggccgggtagggaccaacggtccgtcggtaacccgttccgtaggtaccgacggtaccccgaagggcccttaccggacccccctttcgggtacctacccgg

SEQ ID NO: 83259 - DNA, 707 bp, Homo sapiens
  misc_feature: GYAE6OF02I99QF.25.23.C01.1.454.CMB.1.raw
  modified_base (200)..(200): a, c, t, g, unknown or other
  misc_feature (200)..(200): n is a, c, g, or t
  modified_base (229)..(229): a, c, t, g, unknown or other
  misc_feature (229)..(229): n is a, c, g, or t
  modified_base (267)..(267): a, c, t, g, unknown or other
  misc_feature (267)..(267): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctcgggacccccggnaggagggtctccatctcttgttctgggancagctccgacgtcggaaatagtttgtctactggtaccngcagctccagaaccggcccccaagcctcctcatctataggatgatcgacgccggccctacgagggtactaccgtgaaccgtattccgtcgtcggcctacggtaagttccgtcggtccttacccgtccgggtccccttccccggtggacccctagttccggtacgggttccggggtcccgtttccccggggtaccggagggtacgttcgggaacgggtcttacggtaaactttacgtttaccgttggtacggtaccgttagggttttacggggattcggacccgtaggttccggttaggtacgggttccgggttacccgggttagggttcgggttcggggacgggtacgggaccaacggtccgtacgggtacccgttccggtacggtcccgaacggaccccgagggtccccgtcccggccccccggttcggtacctacccg

SEQ ID NO: 83260 - DNA, 620 bp, Homo sapiens
  misc_feature: GYAE6OF02IMYFJ.25.23.C01.1.454.CMB.1.raw
  modified_base (199)..(199): a, c, t, g, unknown or other
  misc_feature (199)..(199): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggagcagctccgacgtcggaaaataagtttgtctactggtaccagcagctccagaaacggcccccaagctcctcatctataggaatgatcagcggccctcgagggatacctgaccgtattctcgtgctcgaagtctaggcctccgtcggtccctcccgtggccctatcgtacggtcgggtaccgtcccgggtcgagggtagtcggaggtcctagtaaattacttaacgtgtgtacgtacggtttgggactcgtacccgtaggttctaggtggttacgggtacccggtacgggttggttccgggacggggtacggacccgaaggtccgtcggtaacccgtccgtacggtaccgacgtacccgaacggtccgtaccggtcccccgtcggtcctaacccg

SEQ ID NO: 83261 - DNA, 704 bp, Homo sapiens
  misc_feature: GYAE6OF02IEYEZ.25.23.C01.1.454.CMB.1.raw
  modified_base (216)..(216): a, c, t, g, unknown or other
  misc_feature (216)..(216): n is a, c, g, or t
tcagactgtacagtcacgaccggtgctcgatttagtacacgtgattagggattgggggggaagctcagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggnaggagggtcctccatctcttgttctgggagcagctccgacgtcggaaataagtttgtctactggtaccagcagcctcccagaaacccggcccccaagcctcctcatctataggaatgatcacgcgccctcgaggactacctcgaccgtatttctcgtcgtcgtacgaagtcgtggccttcccgtccggtccctcccgttcggccctacgtccgtagggttcggggcccgttcccggggtcccggtaaggggtaacgttgggtaacgggttcgttaggtaaacgtttacgtttaaccgttgggttcggtaccggttagggttttacgggggtattccgggaccgtaggttccgtagggttacgggttccggggttacccgggtaccggggtttcgggtttccggggacggggtaaccggggtacccgaacggtccgtcggtaacccggttaccggttaacgggtccgacccggtacccgtaacccgggg

SEQ ID NO: 83262 - DNA, 608 bp, Homo sapiens
  misc_feature: GYAE6OF02I1KLM.25.23.C01.1.454.CMB.1.raw
  modified_base (199)..(199): a, c, t, g, unknown or other
  misc_feature (199)..(199): n is a, c, g, or t
  modified_base (226)..(226): a, c, t, g, unknown or other
  misc_feature (226)..(226): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccggnagaggtctccatctcttgttctgggancagctccgacgtcggaaatagtttgtctactggtaccagcagctccagaaaccggcccccaagctcctcatctataggatgatcagccgccctcagggactaccgtgaccgtattctctggctcgaagtcgtgctccgtcggtccctccgtcggccatcaggtcgggccgtccggtcgaggactggacggtctaggtaattacgttactgttcgacgtagtttcgggagtcgtaccgtacggttcgtagtaggttcgggtaccgtcgggttcggttccggggacgggtacgggaccgaacggtcgtcggtaccggttccgtacgggtaccgacggtacccgtaacgggtcccgtacccggtccccccgtcggtccctacccg

SEQ ID NO: 83263 - DNA, 646 bp, Homo sapiens
  misc_feature: GYAE6OF02JD0TN.25.23.C01.1.454.CMB.1.raw
  modified_base (201)..(201): a, c, t, g, unknown or other
  misc_feature (201)..(201): n is a, c, g, or t
  modified_base (229)..(229): a, c, t, g, unknown or other
  misc_feature (229)..(229): n is a, c, g, or t
  modified_base (255)..(255): a, c, t, g, unknown or other
  misc_feature (255)..(255): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtcgtctcgggacccccggnagagggtctccatctcttgttctgggancagctccgacgtcggaaattagtttntctactggtaccagcagtctaccagaaaccgcccccaagctcctcatctataggaatgatcgagtccggacctgaggactacccgtagaccgtacttcgtctacggactcgaacgttcgtcggtcctcccgtcgtccctcccgcggaccatcgacggtcggtccgttccggtaccggaggacgttggacggtactaggtaaattagttaaccgttgtgtaccgttaggtttcgggtaagttcggacgttacgtgtcgggtaaggtcgggttccgggtaaggttcgggttacgggacgggtacggacgtacggtccgtcggaacccgttcgtaaccggccgtaaccggacccggaacggtcccgtacccgtccccggtacgtccgttacccg

SEQ ID NO: 83264 - DNA, 556 bp, Homo sapiens
  misc_feature: GYAE6OF02GG818.25.23.C01.1.454.CMB.1.raw
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggancagctccgacgtcggaaataagtttgtctactggtaccagcagctcccagaaaccggcccccaagctcctcatctataggaatgatcagccgccctgagggactacctgaccgattctctggctcgaagtctggctccctcggtccctcccgtggccctatccgaggtcgggccttccgggtcccggaggtatggacggtctagaattattacgtgtgcgttagtttgggatgcctagtctggaggttcggtcggtacggttggttcgggacgggaggaccagcgtcgaccgtcgtaggtcagaccgaggcctcgccccgtgtctaccg

SEQ ID NO: 83265 - DNA, 661 bp, Homo sapiens
  misc_feature: GYAE6OF02F9V2Z.25.23.C01.1.454.CMB.1.raw
  modified_base (199)..(199): a, c, t, g, unknown or other
  misc_feature (199)..(199): n is a, c, g, or t
  modified_base (409)..(409): a, c, t, g, unknown or other
  misc_feature (409)..(409): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccggnagaggtctccatctcttgttctgggagcagcctccgacgtcggaaataagtttgtctactggtaccagcagctccagaaaccggcccccaagctcctcatctataggaatgatcagccgccctgagggataccgtgaccgattctctggctcgaagtctggctccgtcgccctccctggccatcaggtcgggcctccgggtccgaggtanggacggctagaaattattaactgttgcgtaggtttggggacttcggcccgtaaggttccgttagggtacgggttcggggttacccgggttacgggtttcggtttaccgggggaccggggtaaccggggtaacccgaaacgggtccgttaacgggtaacccccggttaccggttaaccggggtaccgtaaccgggaccccgtaaagggtccccgtacccggtccccccccggttacgggtcccttaaccccgg

SEQ ID NO: 83266 - DNA, 209 bp, Homo sapiens
  misc_feature: GYAE6OF02GIIOI.25.23.C01.1.454.CMB.1.raw
  modified_base (179)..(209): a, c, t, g, unknown or other
  misc_feature (179)..(209): n is a, c, g, or t
tcagactgtacagtcacgaccggtgctcgatttagtacacgtgattagggtagttgggggaagaggaagactgacggtcccccctaggagttcaggtgcgtgggcacagcggccctgggctgcctggtcaaggctacttccactgtaccagtctgagcgggctggccaaggcgcatagnnnnnnnnnnnnnnnnnnnnnnnnnnnnnnn

SEQ ID NO: 83267 - DNA, 549 bp, Homo sapiens
  misc_feature: GYAE6OF02I3WFG.25.23.C01.1.454.CMB.1.raw
  modified_base (186)..(186): a, c, t, g, unknown or other
  misc_feature (186)..(186): n is a, c, g, or t
  modified_base (205)..(205): a, c, t, g, unknown or other
  misc_feature (205)..(205): n is a, c, g, or t
  modified_base (233)..(233): a, c, t, g, unknown or other
  misc_feature (233)..(233): n is a, c, g, or t
  modified_base (495)..(495): a, c, t, g, unknown or other
  misc_feature (495)..(495): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctnagtgtctgggacccccggnagagggtctccatctcttgttctgggancagctccgacgtcggaaataagtttgtctactggtaccagcagctcccagaaccgccccaagctcctcatctataggaatgatcagcggcctgagggataccgtgaccgatttcctctggctacgaagtctggccttcccgtcggccctcccgtggcccagtccaggtcgggtcctcccgggtccgagggtatggaggctagaattattacgtgtgcgtaggttgggatcgctagtctgaggtcggtcgacggttgtcgggnggacgggcctaaggctacgccgtcgtacggtcacgcccgaggcctcgtcccccg

SEQ ID NO: 83268 - DNA, 665 bp, Homo sapiens
  misc_feature: GYAE6OF02GP6ZN.25.23.C01.1.454.CMB.1.raw
tcagactgtacagtcacgaccggtgctcgatttagtacacgtgattagggattggggcagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggcaggagggtctccatctcttgttctgggagcagctccgacgtcggaaataagtttgtctactggtaccagcagctccagaaccggccccaagcctcctcatctatagaatgatcgagccggccctcgaggtactaccgtgaccgtattctctggctcgtaagtctggtcctccgtccggccctcccgtggcctagtccgagggtcgggccgttaccgggtccggagggtactggacgggtctaggaaactttagttacgtggtcgtacgttagggtttcgggatcgggacctaggtcccgttaggtaccggttacggggttccccggtagggttcggggtttacccgggacgggggtaaccggggtaacctaacgggtcccgttaacgggtaccccgggtttacccggttaacgggtcccgaaccgggtaccccgtaacggggccccgttacccccggg

SEQ ID NO: 83269 - DNA, 681 bp, Homo sapiens
  misc_feature: GYAE6OF02FV0OD.25.23.C01.1.454.CMB.1.raw
  modified_base (401)..(401): a, c, t, g, unknown or other
  misc_feature (401)..(401): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctcggggacccccgggcagagggtctccatctcttgtctgggagcagctccgacgtcggaaataagttgtctactggtaccagcagctccagaaaccggccccaagctcctcatctataggaatgatcagccggccctcgagggactacctgaccgattctctggctcgaagtctggcctccgtcggcctccgtggccatcgagtgggcctccgggtccgaggtntggagggtctagaattacgttaccgtggtacgtccgttagggtttgggattcggccctagttccgtggacggttcgggtacccgggtacgggtttgggttcccggggacggggtaacgggacccgtaagggtcccgttaccgggtaccccgttaccggtacgggttcccgaaccgggtacccccggaaaggggtccccttccccgggtacccccccggttcggggttaccccaacccgggttttccccgttaccccggtttacccccccgtaaccccccg

SEQ ID NO: 83270 - DNA, 663 bp, Homo sapiens
  misc_feature: GYAE6OF02HARYG.25.23.C01.1.454.CMB.1.raw
  modified_base (201)..(201): a, c, t, g, unknown or other
  misc_feature (201)..(201): n is a, c, g, or t
  modified_base (328)..(328): a, c, t, g, unknown or other
  misc_feature (328)..(328): n is a, c, g, or t
tcagactgtacagtcacgaccggtgctcgatttagtacacgtgattagggattgggagctgtggtagagaagacaggattcaggacaatctccagcatggccggcctcctctcctcctcaccctcctcactcactgtcgcaggtcctcgggcccagtctgtgctgactcagcccaccctcagtcgtctcgggacccccggnacggacgggtcctccagtctctttgttaccgtgggacgcagtctccgacgtccggaaaattagttttcgactacgtggtacagctagctaccgagaaaccggccccctaagcctcctacactactanacggaatgatcagccggcctgaggactaccgagaccgtattctcgtgctacgaatcgcggacctctccggctccgtgccatccgagtcggcctccggtccgacggtatcggaacggtccgtaagaacttaacgttaacgtcggtactacgttaggtttacgggaattcggtaccgtagttcccgttagggacggtttcgggtaccgggtaaccgggttggttccggggaccggggtaaccgggacgtaacggtcgtaccgggtacccgttccgtaaagggtccgaacggtcccggaacgggtcctcccgggtacccccgttcggacgttaacccc

SEQ ID NO: 83271 - DNA, 735 bp, Homo sapiens
  misc_feature: GYAE6OF02F114Q.25.23.C01.1.454.CMB.1.raw
  modified_base (226)..(226): a, c, t, g, unknown or other
  misc_feature (226)..(226): n is a, c, g, or t
tcagactgtacagtcacgaccggtgctcgatttagtacacgtgattaggggattggggggggaagctcagcctttcaggctgtggtacgaggaagacaggattcaggacaatcgtccagcatggccggcctccctctcctcctcaccctcctcactcactgtgcagggtcctgggcccagtctgtgctgactcaggccaccctcagtcgtctcgggacccccgggnacggagggtctccgatctcgttggttcctggggagccagcctaccggacggtacgggaaattaagttttcgtactaccgtgggtaccaggcaacggccttacccgaaggaaacccggccccccaaggcctacctcactacctaagtacggtaaatcgactcgacggcccggccccttcgagggtactaccgtggaccgtagtttcctcgtcggtcctacggtaacgttcgtaggtcctccgtacggcccttcccgcggaccctagtcgaggtcgggtcccgtccgggtaccggacgggtacgtcggacgggtctaggtaacttacgttacgttggtacgtacgtagggttttacgggattccggccgttacggttccgtagggacgggttccgggttaccgggacgggtttcgggttaccgggacggggtaaccgggaaccctacgggttcccgtaccgggtacccggttaccggtacgggttacccgaccggtaccccggtaaccggg

SEQ ID NO: 83272 - DNA, 751 bp, Homo sapiens
  misc_feature: GYAE6OF02H6G1E.25.23.C01.1.454.CMB.1.raw
  modified_base (234)..(234): a, c, t, g, unknown or other
  misc_feature (234)..(234): n is a, c, g, or t
  modified_base (454)..(454): a, c, t, g, unknown or other
  misc_feature (454)..(454): n is a, c, g, or t
tcagactgtacagtcacgaccggtgctcgatttagtacacgtgattagggattggggagagaagacaggattcaggacaatctccagcatggccggcctccctcctcctcctcaccctcctcactcactgtgcagggtcctcgggcccagtctgtgctgactcagccaccctcagtcgtccgtcgggacccccggcaggacgggtcctaccgatcttccttggtttcgtggganctaggccttccggacggtacggaaattaagtttgctaagtcggtaccagcagtcctaccaacgaaccggccccaagcctacctacatactaagtaacggaaacttgactacgacggccgcctacgaagggtactaccgtcggaacctctttcctcggtcgtctacgtaacggttcctcgggtacctcccgttcccggacccttcccggtcggacccttanaccggtacgggttccgggcccggtttcccgggtaccggaacgggtacgtacgggacggtaccgtaagtaacgttaacttacgtggtcgacgttacgggtttacggagtcgacgtagttcgtaggtacggttacgggtaccgggttacgggttcggtaccgggtaccgggaacgggtaacctacggtacgtacggacccggtttacggtaccggaaccgtaccgaaccgtaaccggttccctaccggttcccccgtacggtcccttaaccggtccctttacccgtcccccgttaaccc

SEQ ID NO: 83273 - DNA, 752 bp, Homo sapiens
  misc_feature: GYAE6OF02JF8W9.25.23.C01.1.454.CMB.1.raw
  modified_base (231)..(231): a, c, t, g, unknown or other
  misc_feature (231)..(231): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctcgggacccccgggcaggagggtctccgatctcttgttctgggancagctccgacgtcggaaatagtttgtctactggtaccagcagctcccagaaccggcccccaagctcctcactactataggaatgaactcaggccggccctcgagggtactaccgtgaccggtactttccgtcgtacggtctaccggtaagtttccgtcgggccttcccgtccggtcccttccccgtcggtacccagttaccgacgggttcggggtacccgtccccggggtacccgtagggtaacgttggaacgggtcttaggtaaactttacgttacgttggttcgaccggttaaggttttggggaacgttccggacctacggttcgtacgggtacgggttcggggtacccgggttacgggttcgggttcccgggggacgggtaaccggggtacccgtaaacgggtcccgttaaccggggtaccccggttaccgggtaacggtcccgaacccggaccccggtaaaccgggtcccgttcccccgggtacccccccggttcggggttaccccttaacccccgg

SEQ ID NO: 83274 - DNA, 598 bp, Homo sapiens
  misc_feature: GYAE6OF02JCW4P.25.23.C01.1.454.CMB.1.raw
  modified_base (190)..(190): a, c, t, g, unknown or other
  misc_feature (190)..(190): n is a, c, g, or t
  modified_base (218)..(218): a, c, t, g, unknown or other
  misc_feature (218)..(218): n is a, c, g, or t
  modified_base (257)..(257): a, c, t, g, unknown or other
  misc_feature (257)..(257): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggancagctccgacgtcggaaatagtttgctactggtaccaanagctcccagaaaccggcccccaagctcctcatctataggaatgatcagcggccctcagggactacctgaccgtattctcgtggctcgaagtctggctcctcggccctccctggccatcgaggtcgggtcctccgggtccgaggtactggacggtctggaaattacgtttacgtggtgacgtaggtttggatgccagttctaggtagtggtccggtacggttgttccgggacgggagggacccaaggtccgtacggacccgttccgtaggtcgacggccccgaagggtcctccggcccccgttcggtacccacgttcccgtcggttaccccctcccttcccg

SEQ ID NO: 83275 - DNA, 636 bp, Homo sapiens
  misc_feature: GYAE6OF02FU3IV.25.23.C01.1.454.CMB.1.raw
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccgggcagagggtctccatctcttgttctgggagcagctccgacgtcggaaatagtttgtctactggtaccagcacgctccagaaacggccccaagctcctcatctatagaatgatcagcgccctcgagggatacctgaccgattctcgtggctgaagtctggctccgtcggcctccgtgccatcgagtcggctccggtcgaggtatggaggtctaggaaattagttacgtgtacgtcgttagggtttgggattcgccgtagttccgtggtaggttcgggtccggtacggttcggttccgggacggggtaacgggaccgtaaggtccgttacggtacccggttccgtacgggttaccgaaccggtaccccggtaaagggtccccttacccgggcccccggttacgggtaccctaccgtttcccggtttaccggttccccccgttacccccg

SEQ ID NO: 83276 - DNA, 672 bp, Homo sapiens
  misc_feature: GYAE6OF02I2L98.25.23.C01.1.454.CMB.1.raw
  modified_base (311)..(311): a, c, t, g, unknown or other
  misc_feature (311)..(311): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccgggaggaggtctccatctcttgttctgggagcagctccgagtcggaaatagtttgctactggtaccagcagctcccagaaaccgcccccaagcctcctcatctataggaatgatcagcgccctnaggatacctgaccgattctctggctcgaagtctggctcctcggccctccctaggccatcgtacggtcgggccttcccgggtccgagggtacttgggacggtctaggtaaacttacgtttaccgtgttcgccgttaaggtttttggggaactttcggcccgtaaggttccgttagggtaggtttccgggtacccggtacggggttcgggtttccgggcgggtaacgggaaccctaaggcgttacgtacccgggttacccgttaagggtccgaacgggtccccgtaagggtcccttacccgggtccccccgttacgggttaccctaaccgtttcccggttacccggttacccccctacccccg

SEQ ID NO: 83277 - DNA, 764 bp, Homo sapiens
  misc_feature: GYAE6OF02JJ6UY.25.23.C01.1.454.CMB.1.raw
  modified_base (148)..(148): a, c, t, g, unknown or other
  misc_feature (148)..(148): n is a, c, g, or t
  modified_base (188)..(188): a, c, t, g, unknown or other
  misc_feature (188)..(188): n is a, c, g, or t
  modified_base (212)..(212): a, c, t, g, unknown or other
  misc_feature (212)..(212): n is a, c, g, or t
  modified_base (250)..(250): a, c, t, g, unknown or other
  misc_feature (250)..(250): n is a, c, g, or t
tcagactgtacagtcacgaccggtgctcgatttagtacacgtgattagggattggggagcttcagctgtggtagagaagacaggattcaggacaatctccagcatggccggcctccctctcctcctccaccctcctcactcacctgtncaggtcctgggcccagtctgtgctgactcacgccaccctnacgtgtccgtcgggacccccgggnacgacgggtctccgatcctcgttgttcctagggggacncagccgtacccggacgtcggaaaattagtttggttacctacgtggttaccagtcaagtcgtaccaacggaaaccggtccccaaagcccgtcctcaacgtctaactaggaactgacttcgaggtccgcctacgagggaactaccgtcgaaccgtactttcgtccgtacggtcctacggtaacgtcgtacgggtccttcccggtcccgggtacccctttccccggtcgggtacccctacgttacccggtacggttccgggtacccgttcccggggtacccggtaacgggtacgttccggggtaaccgggtacgttaaccgggtaaacttttaccgggttaaccgttcgttacgggtacccggtttagggtttaccggggtacgttcgggttacccgtagttacccggtggttaaccggttcgggtacgtacgggttcggtcggggtacggcgggtaacggacgtacggacggtaccgtacggtcgttcgacgcccgtaagtccgtacccgtcccgg

SEQ ID NO: 83278 - DNA, 704 bp, Homo sapiens
  misc_feature: GYAE6OF02JZGGJ.25.23.C01.1.454.CMB.1.raw
  modified_base (210)..(210): a, c, t, g, unknown or other
  misc_feature (210)..(210): n is a, c, g, or t
  modified_base (214)..(214): a, c, t, g, unknown or other
  misc_feature (214)..(214): n is a, c, g, or t
  modified_base (241)..(241): a, c, t, g, unknown or other
  misc_feature (241)..(241): n is a, c, g, or t
  modified_base (516)..(516): a, c, t, g, unknown or other
  misc_feature (516)..(516): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcacgccaccctcagtgtccgtcgggacccccgggnaggngggtcctccatcctcttgttctgggancagcctccggacgtcggaaatagtttgtactactggtaccagcagctcccagaaccggccccaagcctcctcatactagtaggaactgatcacggtccggacccgtgacgggactacccgtcggacccgtactttcctcgtacggtccttacggtaacgttcgtacgggcccttccgttcccggcccgttccccgtacgggccctagtccgaggtcgggaccttcccgggtacgacggtactcggacggcgttaacgtaacttaacgtttaccgnggttcgtacgttacgggttttaggggaccttacggtacccgtaaggtttccgtagggtaccggttcgggttacccgggtacgggtttcgggttccgggacggggtaaccgggtaaccggaggtccggtacgtacccggttcgttacggtaccgacggtacccgaacggtcccgtcccggtacccccgg

SEQ ID NO: 83279 - DNA, 651 bp, Homo sapiens
  misc_feature: GYAE6OF02HZ1BI.25.23.C01.1.454.CMB.1.raw
  modified_base (207)..(207): a, c, t, g, unknown or other
  misc_feature (207)..(207): n is a, c, g, or t
  modified_base (236)..(236): a, c, t, g, unknown or other
  misc_feature (236)..(236): n is a, c, g, or t
  modified_base (448)..(448): a, c, t, g, unknown or other
  misc_feature (448)..(448): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggnaggagggtctccatctcttgttctgggancagcctccgacgtacggaaattaagtttgtctacgtggtaccagcagctcccgagaaaccggccccaagcctcctacactactataacggatgactcgacggccggtccctacgagggactacctagacccgtatttcctcgtggctacgaagtctggtcctccgtccggccctcccgtggccagtcgacggtcgggcctccggtacgaggngtggaggctagattacgttacgtgtcgtcgtaggtttggagtcgtaccgtaggtcgttaggtacggttcggtacccgggtacgggttcgggttacgggaccggggtacggggaacccgaacggtccggtaccggtacccggttaccggtaacgggtaccgacccggtaccccggtaacgggtccgtaccccggtaccccccgg

SEQ ID NO: 83280 - DNA, 691 bp, Homo sapiens
  misc_feature: GYAE6OF02FODXL.25.23.C01.1.454.CMB.1.raw
  modified_base (180)..(180): a, c, t, g, unknown or other
  misc_feature (180)..(180): n is a, c, g, or t
  modified_base (203)..(203): a, c, t, g, unknown or other
  misc_feature (203)..(203): n is a, c, g, or t
  modified_base (237)..(237): a, c, t, g, unknown or other
  misc_feature (237)..(237): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcaggtcctgggcccagtctgtgctgactcagcccaccctnagtgtcctggggaccccccgggnaggagggtcctccgattcctctttgttctgggancagctccgacggttcggaaattaagtttgtctactggtaccagcagcctacccgaagaaacccggcccccaagtcctcctcattctataggaatgaactcgagccgccctgagggtactacctgaaccgattcctacgtgcctcgaacgtctcggcctccgtcggcccttccgtcgcctatcgagttcgggcctccgggtccaggtactggaacggtcctagaactttacgttctgtacgtacgttagggttcggacttacgaccgttacgttcgtagggttacggtttaccggtaccgggtagtttccgggttaccgggacgggtaacccggtaccacggttaccggttacccgggtaccccggttaccggttaaccgggtaccgtaacccgggtaccccggtaaggtcccccgttccccggtacccccggtttacggtaccttaacccccgg

SEQ ID NO: 83281 - DNA, 779 bp, Homo sapiens
  misc_feature: GYAE6OF02F26WV.25.23.C01.1.454.CMB.1.raw
  modified_base (205)..(205): a, c, t, g, unknown or other
  misc_feature (205)..(205): n is a, c, g, or t
  modified_base (298)..(298): a, c, t, g, unknown or other
  misc_feature (298)..(298): n is a, c, g, or t
  modified_base (333)..(333): a, c, t, g, unknown or other
  misc_feature (333)..(333): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggagcagctccgacgtcgaaatagtttgtctactggtaccagcagctaccagaaccgccccaagctccncatcataggatgatcagcggccctgaggactaccngacccgtattcctcgtggcctacggaacgtcgtcgggcctacccggttccggtcccctcccgtcggaccctaacgttcggaacggtcggggtaccttccccggggtaccgaaggggtacttacggggacggtaccgttacggtaaacgtttacgtttaacgttcgggtacggttaccggttaacgggttttttacgggggactttccggggtaacccgttaacggggtttccgtttacggggtaaacgggtttcccggggtttaccccggggtaacggggttttccgggtttcccggggggaccggggtaaacggggtaaccccgtaaacggggttcccggttaacccgggttaccccgggttaccgggtttaaccggggttacccgtaaacccgggtcccccggttaaacgggggtccccttaccccggggttacccccccccgg

SEQ ID NO: 83282 - DNA, 669 bp, Homo sapiens
  misc_feature: GYAE6OF02GVA69.25.23.C01.1.454.CMB.1.raw
  modified_base (192)..(192): a, c, t, g, unknown or other
  misc_feature (192)..(192): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctggggacccccgggnagagggtctccatctcttgttctgggagcagctccgacgtcggaaataagtttgtctactggtaccagcagctccagaaaccggcccccaagctcctcatctataggaactgatcagccggccctgagggtactacctgacctattctctggctcgaagtctggctccgtccggcctccgtcgccagtcgacggtcgggcttcccgggtccgaggtacgtggaggtcgttagaaacttagttacgtggtcgtcgtagggttttgggattcgcgtaggttcgtggtaggtcgggtccggtaacgggtttggttaccgggacggggaacgggacctaacggtccgttacggtaccccggttccgttaacgggtccgaaccgggtaccccggtaaacgggtccccgttaccccgggaccccccggtttacggtcccgttaacccgtttcccgttacccggtttaccccccttaacccccg

SEQ ID NO: 83283 - DNA, 599 bp, Homo sapiens
  misc_feature: GYAE6OF02J17D5.25.23.C01.1.454.CMB.1.raw
  modified_base (202)..(202): a, c, t, g, unknown or other
  misc_feature (202)..(202): n is a, c, g, or t
  modified_base (232)..(232): a, c, t, g, unknown or other
  misc_feature (232)..(232): n is a, c, g, or t
  modified_base (272)..(272): a, c, t, g, unknown or other
  misc_feature (272)..(272): n is a, c, g, or t
  modified_base (344)..(344): a, c, t, g, unknown or other
  misc_feature (344)..(344): n is a, c, g, or t
  modified_base (352)..(352): a, c, t, g, unknown or other
  misc_feature (352)..(352): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctcggggacccccgggnaggacgggtctccatctcttgttctgggancagcctccgacgtcggaaattagtttgtctactggtaccngcagcctccaaggaacccgccccaagcctcctcatctataggaatgatcgacgccgccacgaggactaccgngaaccgtnttcctcgtggtctacgacgtcgtcggtcctccgtccggccctcccgtcgcctatcgaggtcggcctccgggtcgaggctgcggtctagatacttacgtgtcgtcgtaggttggactgtaccgtagtcgtggtacgtcgggtaccggtcggttcggtcgggacgtacgggacgaacggtcgtacggtaccgttcgacggttaccgaccgccggtaaccggcctcccggtaccccgttcggtacctccg

SEQ ID NO: 83284 - DNA, 709 bp, Homo sapiens
  misc_feature: GYAE6OF02I2LWS.25.23.C01.1.454.CMB.1.raw
  modified_base (209)..(209): a, c, t, g, unknown or other
  misc_feature (209)..(209): n is a, c, g, or t
  modified_base (243)..(243): a, c, t, g, unknown or other
  misc_feature (243)..(243): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagcccaccctcagtgtcgtcggggacccccggnaggagggtcctccatcttcttgttccgtgggacncaggcctccgaacgttacggaaattagtttgtctacgtcggtaccagcagcctacccgaagaaaccggcccccaaggcctccctctactacgtataaggtaactgactacgacgccggtacccctagaacgggtacttaccgtacggaacccgtatttccgtcgtcgggtacctacggtaaggttccgtacggcccttcccgtcccggtcccttcccgtacggcccgtaagtccgacggtcgggtcccgtccgggtccggaggtacgtcggtacgtacgttagtaaacgttacttaccgttggttcgtacgttacgggtttcgggaacgttcggaccctaggttaccgtggttacggttcggtaccggtacgggttcgttacgggaccgggtaacggaacccgtagtccgtaccggtacccgtccggtaggtaccaccggtcccgaacggtccctccggtaccccg

SEQ ID NO: 83285 - DNA, 734 bp, Homo sapiens
  misc_feature: GYAE6OF02F7NK6.25.23.C01.1.454.CMB.1.raw
  modified_base (201)..(201): a, c, t, g, unknown or other
  misc_feature (201)..(201): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccacctcagtgtcgtcggggacccccggnaggagggtctccatctcttgttctagggagcagcctccgacgtacggaaatagtttgctactggtaccagcagctccaagaaaccggccccaagtcctcctcatctataggatgatcgagccggcctagaggactaccgtgaccgtattctcgtggcctacgtaacgtcgtcggccttcccgtccggtccccttcccgtcggtcccaagttccgtagggttccgggcccgtttcccggggtacccggtaagggtacggtcggtaacggaccgtacggttaaattaccggttttaacgtcggttacggtacgtttaggggtttagggacgttcggtaccgtacgttcgtaggtaaccggggtttcgggtacccgggttaaggggttcgggtttaccggggacggggtaacggggtacccgaacggtccgttaaccgggtaacccgttccgggttaacggtacccgtaacggtacccccgtaacgggttacccgtaccccgggtccccccgtttacccgggtcccgttaaccccg

SEQ ID NO: 83286 - DNA, 766 bp, Homo sapiens
  misc_feature: GYAE6OF02GZ5R1.25.23.C01.1.454.CMB.1.raw
  modified_base (191)..(191): a, c, t, g, unknown or other
  misc_feature (191)..(191): n is a, c, g, or t
  modified_base (219)..(219): a, c, t, g, unknown or other
  misc_feature (219)..(219): n is a, c, g, or t
  modified_base (284)..(284): a, c, t, g, unknown or other
  misc_feature (284)..(284): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctcgggacccccggnaggagggtctccatctcttgtctgggancagctccgacgtcggaaatagtttgctactggtaccagcagctccagaaaccgccccaagctccncatctataggaatgatcacgcggccctcgagggactaccgtacgaccgtattcctcgtggctacgaacgtcgtcggccttccgtccggtcccttccgtcggccctaagttccgtacgggtcgggtcccgttacccggggtaccgaacgggtacgttacgggaacggtcccgttaaggtaaacgtttaaacgtttaccggttgggtacgtacggttaacgggtttttgggaacgtttccggacccgttaggtttaccgttacggtaacggggttccgggttacccgggtacgggttttacgggttacccggggacggggtaaaccgggtaaccgtaaacgggtcgttaccggtacccggttaacggtaccgggtaccgtaacccggtaccccggtaaacgggtccccgttacccgggtaccccccgttacgggtaccccgtaaccgtttccccggtttacccgttcccccccgttaacccccg

SEQ ID NO: 83287 - DNA, 725 bp, Homo sapiens
  misc_feature: GYAE6OF02G5HEK.25.23.C01.1.454.CMB.1.raw
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagcccaccctcagtgtccgtcggggacccccgggcagagggtctccatctcttgtcgtgggagcagctccgacgtacggtaaattaagtttgtctacgtcggtaccagcagcctacccaacgaaccggccccaagcctcctcactctagtaggatgactcagccggtccctacgagggtactaccgtacgaccgtacttctcgtacgtcgtacgtaacgtctcggtcctcccgtccggtcccctcccgtcggtaccacgttacggacggtcgggtcccgttcccgggtaccggagggtacttgggaccgggtacgttaagtaacgttacgttacgtcggtacggttacggttacgggttttgggaacgttccgggccgttaaggttccgttagggtacgggttccgggtaaccggtcggggtttccgggtaccggggtaccggggtaacgggaacccgtacgggtccgtaccggtaccccggttacccgttacgggtacccgaaccggtaccccggtaaccggttcccccgttaccccccggtcccggg

SEQ ID NO: 83288 - DNA, 622 bp, Homo sapiens
  misc_feature: GYAE6OF02GL7J1.25.23.C01.1.454.CMB.1.raw
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
tcagactgtacagtcacgaccggtgctcgatttagtacacgtgattagggattggggagctgtggtagagaagacaggattcaggacaatctccagcatggccgacctccctctcctcctcaccctcctcactcactgtgcagggtcctgggcccagtctgtgctgactcagccaccctcagtgtctgggacccccggnagagggtctccatctcttgttctgggancagcctccgacgtcggaaatagtttgctactggtaccagcagctccagaaacgccccaagcctcctcatctaataggaatgatcacgcggccctcgagggataccgtgaccgattctcgtggctcgaacgtctcggctccgtcggcccttcccgtggccctagtccaggtcgggtcctccgggtccgaggtacgtggacggcgtagaaattaacgttacgtggttcgtcgtagggttttgggacgttcgccgtacgttcgtaggtaggttcgggttacccggtacgggttcggttccggggcgggtaagggaccgaaggtccggtcggacccgttccggtacggtccgaccggacccgaacgggccctcccggtcccccgttcggtccctacccg

SEQ ID NO: 83289 - DNA, 543 bp, Homo sapiens
  misc_feature: GYAE6OF02FM3DH.25.23.C01.1.454.CMB.1.raw
  modified_base (191)..(191): a, c, t, g, unknown or other
  misc_feature (191)..(191): n is a, c, g, or t
  modified_base (219)..(219): a, c, t, g, unknown or other
  misc_feature (219)..(219): n is a, c, g, or t
  modified_base (314)..(314): a, c, t, g, unknown or other
  misc_feature (314)..(314): n is a, c, g, or t
  modified_base (335)..(335): a, c, t, g, unknown or other
  misc_feature (335)..(335): n is a, c, g, or t
  modified_base (413)..(413): a, c, t, g, unknown or other
  misc_feature (413)..(413): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggancagctccgacgtcggaaatagtttgctactggtaccagcagctcccagaaacggcccccaaagctcctcatctataggaatgatcagcggccctnagggataccgtgaccgattcnctggctcgaagtctggctcctcggcctcctggccatcagtcgggctccggtccgaggactggaggctgaattattacngtgctagttgggatgctagtctgagtggtccgacggttgtcgggcggagggaccaagcgtcggacctcgtaggtcacggcccgaaggtctccggcccccgttggtccactccgttaccgttccctacccc

SEQ ID NO: 83290 - DNA, 706 bp, Homo sapiens
  misc_feature: GYAE6OF02JF1GT.25.23.C01.1.454.CMB.1.raw
  modified_base (195)..(195): a, c, t, g, unknown or other
  misc_feature (195)..(195): n is a, c, g, or t
  modified_base (346)..(346): a, c, t, g, unknown or other
  misc_feature (346)..(346): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagcccaccctcagtgtcgtcggggacccccgggnaggacgggtctccatctcttgttctgggagcagcctaccgacgtacggaaattagtttgctacgtggtaccagcagcctaccaagaaaccggccccaagcctcctcatctataggaatgatcgagccggtaccctgaagggtacttaccgngaccgtattcctcgtggactacggtaagtcctcgggtcccttccgtcccggcccttcccgtcggtaccctacgttaccgtacggggttccgggacccgttacccggggtaccgtaacggtaacggtcggtacggtacgttaacgtaaactttacgttacgtacggtcggtacgttaacgggtttcggagtcggtaccgtaggttacgtaacggtcggttaccgtacgggttcgtacgggcgggaacggtactacggtacgtcggtaccgtacgtcggaccgtacggaccgaacggtccgtacccggtccccgttacgggtacctaccggttcccgtacccggtttccccgcccttacccg

SEQ ID NO: 83291 - DNA, 664 bp, Homo sapiens
  misc_feature: GYAE6OF02GWW3Q.25.23.C01.1.454.CMB.1.raw
  modified_base (215)..(215): a, c, t, g, unknown or other
  misc_feature (215)..(215): n is a, c, g, or t
  modified_base (242)..(242): a, c, t, g, unknown or other
  misc_feature (242)..(242): n is a, c, g, or t
  modified_base (310)..(310): a, c, t, g, unknown or other
  misc_feature (310)..(310): n is a, c, g, or t
  modified_base (349)..(349): a, c, t, g, unknown or other
  misc_feature (349)..(349): n is a, c, g, or t
tcagactgtacagtcacgaccggtgctcgatttagtacacgtgattagggattgggggggaagctcagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccggnagagggtctccatctcttgttctggancagctccgacgtcggaaataagtttgtctactcggtacagcagcctccagaaccgccccaagcctccncatctataggaatgatcgagccgcctgaggtactaccgngaccgactttctctggacttacgaagttcgtcggccttccgtccggtcccttcccgtggaccctagtccgtaacggtcggggtccttccgggtacccggaagggtacgtcggacggtcttaggtaaatttacgttacgttggtcgtacgttacgggtttacggggattcggtaccgtagttaccgttagggacggttcgggtacccgggtaggttcgggtttcgggaaccggggtacgggtaacccgaaacggtccgttacgggtaaccccggtttaccggttaaccgggtcgtaacccggtccccgtaaacggg

SEQ ID NO: 83292 - DNA, 847 bp, Homo sapiens
  misc_feature: GYAE6OF02JHS5N.25.23.C01.1.454.CMB.1.raw
  modified_base (213)..(213): a, c, t, g, unknown or other
  misc_feature (213)..(213): n is a, c, g, or t
tcagactgtacagtcacgaccggtgctcgatttagtacacgtgattagggattggggagctgtggtagagaagacaggattcaggacaatctccagcatggccggcctccctctcctcctcacccctcctccactccactcgtcgccagggtccctgggccccagtcctgtcgactgactcagcccaccctcagtgtctacgggacccccggnagacgggtcctcccgatcctcttcggttccgtaggggactcacggtcctcccggacgttacgggaaaaattacggttttcgaccttaactcggggttaacccaaggtcctaaggcccttaccccgaaggaaaaccccgggtcccccccaaaagggccttaccccgtacgaacttaccgtaacgttaacgggaaacttacggaacttcccgaaacggccccggaccccccccgtaaggggtaaccttaccccgttaggaaccccggtaatttcccgtaccgtagggtcccttaccggaagttcgtccgtcggggtaccttccccgccgggtccctaccccgttgggacccctagtccgtacggtccggtcgtccccgggtccggaacggtcgtacggacggtcgtacggtaacttaccgttaacgtgtacgtccggtaggtttaccgggagttacggaccgtagttaccgtggtacggtacgggttcccgggttacggttccgggttacgggtacggggtaaccgggtacccgtaacgggtccgtaaccgggtacccgttaccggtaccggttaccgaccggtacccgaaccggtccggtaaccgtcccccggttaccgtacccggttaacccgg

SEQ ID NO: 83293 - DNA, 648 bp, Homo sapiens
  misc_feature: GYAE6OF02HSHLE.25.23.C01.1.454.CMB.1.raw
  modified_base (292)..(292): a, c, t, g, unknown or other
  misc_feature (292)..(292): n is a, c, g, or t
  modified_base (591)..(591): a, c, t, g, unknown or other
  misc_feature (591)..(591): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctctcactcactgtgcgaggtccgtcggccgacgtcgtgtgctgactccagaccaccctccagtgtcgtcgggaccccgggccgagagggtctccatctcttgttcgtcgggaggcagctccgaccgtacggaaaataagttttcgtctactggtaccgtancagctacccagaaaccggaccccacgctcctcactctaagtaggtaagagtatccgaaggcccggcccgttacaaggggtactacctacggccggtaactttcgtcgtcgggacttacggaacgtctcgggtccctaccgttccggacctccccgttggcctactcgtaggtcgggtcgtcccgggtccggaagtaggtggtacgcgtagtagtaattaccgtgtgcgtaggttcggtagtcgcgagtctggtacgttcggtcggtacgtggttcgggacgggacgggaccgtaacggngtcccgtaccgtacggttacggccgtaaccggaccgtaacggcggtcccggtccccg

SEQ ID NO: 83294 - DNA, 661 bp, Homo sapiens
  misc_feature: GYAE6OF02HBI1H.25.23.C01.1.454.CMB.1.raw
  modified_base (202)..(202): a, c, t, g, unknown or other
  misc_feature (202)..(202): n is a, c, g, or t
  modified_base (231)..(231): a, c, t, g, unknown or other
  misc_feature (231)..(231): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagcccaccctcagtgtcgtcgggacccccggnaggaggtctccatctcttgttcgtgggancagcctcgacgtacggaaaattagttcgtctacgtggtaccagcagcctaccgaacgaaaccgacccccaagcctacctactatacctaagtaaggaatggatcgacggccgacccgtacgaagggactaccgtacgtaccgtacttcgtcgtcggtactacgtaacgtcggtacggtccttcccgtccgggtaccccttcccggtcggtacccctagttaccgagggttccgggtacccgttcccgggtaccggtaacgggtacgtcgggacggtacgtagtaaagttacgtttacgtggttacgtcgttaggttcggattcgacgtagtcgtagtcggtcggtaccgttacgggttcggacgggtacgacagcgtcgtaccgtgtacgcgacgaccgtacgccgtccgtcccgtcgtactacgttccg

SEQ ID NO: 83295 - DNA, 550 bp, Homo sapiens
  misc_feature: GYAE6OF02HMNDB.25.23.C01.1.454.CMB.1.raw
  modified_base (200)..(200): a, c, t, g, unknown or other
  misc_feature (200)..(200): n is a, c, g, or t
  modified_base (216)..(216): a, c, t, g, unknown or other
  misc_feature (216)..(216): n is a, c, g, or t
  modified_base (295)..(295): a, c, t, g, unknown or other
  misc_feature (295)..(295): n is a, c, g, or t
  modified_base (378)..(378): a, c, t, g, unknown or other
  misc_feature (378)..(378): n is a, c, g, or t
  modified_base (430)..(430): a, c, t, g, unknown or other
  misc_feature (430)..(430): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctnttgttctgggagcagctccgagtcggaaatagtttgtctactggtaccagcagctccagaaaccggccccaagctcctnatctataggaatgatcagccgcctgaaggtactacctgacctatttcacgtggctcgaagtctggcctcctcggcccttccgnggccatcgagtcgggctccggtcgagagtgagcgtgtaatattacgtgtagngtagtttggatcgctagtcgtagtggtcggtccgtagggttcgtcgggaccgagggaccgaagcgtcgtacccgtctacggtacacgaccgacggccgtccgccccgtcggtacctaccg

SEQ ID NO: 83296 - DNA, 641 bp, Homo sapiens
  misc_feature: GYAE6OF02F9B0H.25.23.C01.1.454.CMB.1.raw
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggcaggagggtctccatctcttgttctgggagcagctccgacgtcggaaattaagtttgtctactggtaccagcagctccagaaccgccccaagcctcctcatctaataggaatgactcgacgcgccctcgagggactaccgtcgaccgtatttcctcgtcggctacggaacgttccgtgggtcccttcccgtccgggtccccttccccgtacgggccctaagtccgtagggttcggggtcccgttcccggggtaccgacgggtaagttcgggaggtccgtaagtaaacgtttacttacgttaggtcgtacgttaagggtttgggacttcggacctaggtcttagggtacgtgggttcgtacggttggtcgggcgggtacgggaacacggtcgtacggtaccgtcgtacggtcaccgcccgaaggcctccgtccccg

SEQ ID NO: 83297 - DNA, 633 bp, Homo sapiens
  misc_feature: GYAE6OF02H5BI8.25.23.C01.1.454.CMB.1.raw
  modified_base (192)..(192): a, c, t, g, unknown or other
  misc_feature (192)..(192): n is a, c, g, or t
  modified_base (216)..(216): a, c, t, g, unknown or other
  misc_feature (216)..(216): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctcggggacccccggnagagggtcctccatctcttgttcngggagcagctccgacgtcggaaattagttgtctacgtggtaccagcagcctcccgaagaaacccggcccccaagcctcctcatctagtaaggaatgatcgaggcccggccctcgagggtactaccgtacgaccgtacttccgtcgtcggccttacgaacgttcgtcggccttccgtccggtcctcccgtgaccctagtcgaggtcgggtcctccggggtacgacggtgtagaggtctagtaattacgtacgtgtacgcgttaggtttgggacttcgacgtagtcgtaggacgttccgggtcgtaggttcggtacgggacggtaacggacaagtccgtcggaccgttcgacggtcaccggtaccgacggtcgtccccgtccccgtcggtacctaccgttccgttccctaccccgtccc

SEQ ID NO: 83298 - DNA, 630 bp, Homo sapiens
  misc_feature: GYAE6OF02FYPYZ.25.23.C01.1.454.CMB.1.raw
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggancagctccgacgtcggaaattaagtttgtctactggtaccagcagcctaccagaaaccggcccccaagcctcctcatctataggaatgatcagcgccctcgagggactaccgtgaccgtattcgtctggctcgaagtctggcctccgtccgccctcccgtggccatcgaggtcgggccgtcccgggtccgaggtatggacggtctaggaaattacgtttacgtggttcgtacgtagggttttgggacttcggacctaggttcgtggtaggttcgggtccggtaacgggttcggttaccgggacgggtacgggaccgaggtccggttcggacccgttcggtacggtcccaaccggtacccgaacgggtcccgtcccgggtccccccgttacggtcccttacccgg

SEQ ID NO: 83299 - DNA, 652 bp, Homo sapiens
  misc_feature: GYAE6OF02GKW5M.25.23.C01.1.454.CMB.1.raw
  modified_base (193)..(193): a, c, t, g, unknown or other
  misc_feature (193)..(193): n is a, c, g, or t
  modified_base (222)..(222): a, c, t, g, unknown or other
  misc_feature (222)..(222): n is a, c, g, or t
  modified_base (328)..(328): a, c, t, g, unknown or other
  misc_feature (328)..(328): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctggggaccccccgggnaggagggtctccatctcttgttctgggancagctccgacggtacggaaatagtttgctactggtaccagcagcctccagaaaccggccccaagctcctcatctaataggaatgatcagcgcctgagggactaccngaccgattccgtcgtcggctacgaagtcgtggtcctccgtccggcccttcccgtcggcctatccgtaggtcgggcctcccgggtccgacggtacgtcggacggtcgtagtaacttattacgtggtcgtcgtaggtttgggacttcggcgtaggttcgtggtacggttcgggtccggtacgggttcggttccggggtcgggaacgggtaccgaaggccgtggtacccggttccgtacgggtaccgaccggacccggaacggtccgtcccggtcccccggtccggtacccgtaccgttccggttaccccgttaccccggtcccccg

SEQ ID NO: 83300 - DNA, 732 bp, Homo sapiens
  misc_feature: GYAE6OF02H5DG0.25.23.C01.1.454.CMB.1.raw
  modified_base (191)..(191): a, c, t, g, unknown or other
  misc_feature (191)..(191): n is a, c, g, or t
  modified_base (219)..(219): a, c, t, g, unknown or other
  misc_feature (219)..(219): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggancagctcgacgtcggaaatagtttgtctactggtaccagcagctcccagaaccggcccccaagcctcctcatctataggaatgatcagccggccctacgagggactaccgtcggaccgtatttcgtcgtggtcctcggaagttctgggtcctcccgtacggccccttccgtcgggacctacgtccgtacggttcggggtcccttcccggggtaccggaacgggtacgtacgggtaacgggtcgttaaggtaaacgtttaacgtttaccgtcggttacggtaccgttaagggtttttggggacttcgggtacccgtagttccggttagggtacgggttcgggtacccgggtaacggggttcggtttaccggggccgggtaacggggaccctaacgggtccgtacggtaccccggttaccgtagggtacccgaaccggtcccggtaacggtccctacccgggtccccccgttcggggtaccctacccgtttccgttcccggttcccccgtaccccg

SEQ ID NO: 83301 - DNA, 673 bp, Homo sapiens
  misc_feature: GYAE6OF02HU37L.25.23.C01.1.454.CMB.1.raw
  modified_base (201)..(201): a, c, t, g, unknown or other
  misc_feature (201)..(201): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctcggggacccccggnaggagggtctccatctcttgttctgggagcagcctccgacgtcggaaattaagtttgtctactggtaccagcagcctccaagaaaccggcccccaagcctccctactatctataggaatgatcgagccggccctgaagggtactaccagaccgtatttcctcgtcggtacctcggaagttctcgggtcctccgtccggcccttcccgtcggaccctatccgaggttcgggccctcccgggtaccggagggtagtacggacgggtaccgtaattacttacgtggtcgacgttaaggtttgggatcggccgtagttcgtagtacgggttcggtaccgggtacggttcggttcgggacgggtacgggaccgtaagtcccggttacggaacccggttaccggtagggtacccgtaaccggaccccgaacggttcccgtccccggttacccccgtcgggttacctaccgttccccgg

SEQ ID NO: 83302 - DNA, 895 bp, Homo sapiens
  misc_feature: GYAE6OF02JW6BS.25.23.C01.1.454.CMB.1.raw
  modified_base (170)..(170): a, c, t, g, unknown or other
  misc_feature (170)..(170): n is a, c, g, or t
tcagactgtacagtcacgaccggtgctcgatttagtacacgtgattagggattgggggagcttcagctgtgttagagaagacaggattcaggacaatctccagcatggccggcctccctctcctcctcaccctcctcactcactgtgcagggtcctgggcccagtctgtnctgactcacgccaccctcagtgtcgtgggactccgtggacaggtccggtcacccgatcctaccctgccaacgttacgggaaccgtacggcccggttagaaccgtagttcggtcgtactttaaagttaaacctattcggtccgttccgttacggttacccccaaaccaaaccctaaccccgaagggaccgtaaacccggaccccccaaaaccttaccaacgttacctaatttaccttaggtacttgggttaaccagttaccgtaacgttccccggtaccccgttcggttacggggtttaaccgtttcccggttcggggtttacccggttccttttcccgttccggttcggggtaacccctttacccgtaaggttcccgttaacgggaccccgttaaacccggtcccgggtttaccccttaccccggttaccgtaccccgtacgttaccgggtcccggggttacctaccccggtacggtccggttacgggaccgggtaacggtaccggtacccttaacgtttagtttaacttcggtaccttacgtttacctaagttaaccgtacgtaaacccgtaaccgaaccttaacgtccggttacggttaccgggtttaccgggtccggggtaaccgggtaaccgggtaacccgttaaacgggttacccggttacccggttacccggttaccgggtaccccgtaccggggttaccccgtaacgggttcccccgg

SEQ ID NO: 83303 - DNA, 751 bp, Homo sapiens
  misc_feature: GYAE6OF02JTJJJ.25.23.C01.1.454.CMB.1.raw
  modified_base (202)..(202): a, c, t, g, unknown or other
  misc_feature (202)..(202): n is a, c, g, or t
  modified_base (231)..(231): a, c, t, g, unknown or other
  misc_feature (231)..(231): n is a, c, g, or t
  modified_base (265)..(265): a, c, t, g, unknown or other
  misc_feature (265)..(265): n is a, c, g, or t
  modified_base (303)..(303): a, c, t, g, unknown or other
  misc_feature (303)..(303): n is a, c, g, or t
  modified_base (307)..(307): a, c, t, g, unknown or other
  misc_feature (307)..(307): n is a, c, g, or t
  modified_base (315)..(315): a, c, t, g, unknown or other
  misc_feature (315)..(315): n is a, c, g, or t
  modified_base (339)..(339): a, c, t, g, unknown or other
  misc_feature (339)..(339): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcaggtcctcgggcccagtctcgtgctgactcagccaccctcagtgtcctgggaccccccggnacgagggtcctccatctcttgtctgggancagctcgactggaaatagtttgctactggtaccngcagctacccagtaaaccgccccaagctcctcatctanagantcccgganccgactcggagtctacgcgacctntctgtcgtctacgacttcgacgtccgtacggtccgtcccgttccggccgtacctacgtacgtacgggtccggtaccggttcccgggacgtaccggtacgtacgggtaccgtcggtaaacggttaccgtttacgttaaccggttggttaccgtacggtttagggttacgaacgtttcgggaacgtttcggttaccggtagggtttaccgggttccgggtacccgggtttggggtttacccgggtaccggggtaacggggttaacccgggtaaccggaccggtttaccgggtacccggttaacccgggttacccgggttaacggtacccggtaacccgggtaacgggtacccggttccccgggtacccccggttaccccgggtttacgtacccccgttaccggtttacccccgg

SEQ ID NO: 83304 - DNA, 666 bp, Homo sapiens
  misc_feature: GYAE6OF02GMRXP.25.23.C01.1.454.CMB.1.raw
  modified_base (202)..(202): a, c, t, g, unknown or other
  misc_feature (202)..(202): n is a, c, g, or t
  modified_base (233)..(233): a, c, t, g, unknown or other
  misc_feature (233)..(233): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtcgtcgggacccccgggnaggagggtcctccatctcttgttcgtgggancagctccgacgtacggaaatagtttgctacgtgtaccagcagcctacccaagaaacccggcccccaagctcctcatctagtagatgatcacgccggcctagagggtactaccgtcgaccgtacttctcgtcggcctacggtaagttcgtcggtccttcccggtccgcccttcccgtggaccctagtccgtacggtcgggtcccgtcccgggtacggacggtagtacgggacgggtctacggtaattacgtttacgtggtcgtacgttagggtttacgggattcggaccgtaggttcgtagggtacggttccgggtccggttaacggttcgggttacgggacgggtaacgggaccgtacggtccgtacggacccggttacgacggtaccgacggtacccgacggtccgtacccggccccgttcggtactacccg

SEQ ID NO: 83305 - DNA, 640 bp, Homo sapiens
  misc_feature: GYAE6OF02FM6JB.25.23.C01.1.454.CMB.1.raw
  modified_base (228)..(228): a, c, t, g, unknown or other
  misc_feature (228)..(228): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccggcagagggtctccgatctcttgttctgggancagctccgacgtcggaaatagtttgctactggtaccagcagctccagaacgccccaagcctcctcatctataggatgatcacgccggccctgagggtactaccgtcgaaccgtattctcgtggtcctacggaacgtcgtcggtctcccgtccggcccttcccgtggccagtcgaggtcgggcctccgggtcgagggtagtcggacggtactagtaacgttacttacgtcggttagtccgttagggttttcgggagttccgacgtacgttcgtaggtaggttccgggttaccggtacgggttcgggtacgggaccggggtacggaccgtaggccgttcggacccgtaccgttacgggtaccgacggaccccgaacgggtcccgttcccgtaccccgttcggtaccttacccgg

SEQ ID NO: 83306 - DNA, 683 bp, Homo sapiens
  misc_feature: GYAE6OF02FZQED.25.23.C01.1.454.CMB.1.raw
  modified_base (229)..(229): a, c, t, g, unknown or other
  misc_feature (229)..(229): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctcggggacccccggcagagggtctccatctcttgttctgggancagctccgacgtcggaaattaagttgtctactggtaccagcagcctaccagaaccggccccaagcctcctcatctataggaatgatcagccgcctcgagggactaccgtgaccgtattccgtcgtcggctacgtaacgtctgggtacccttcccgtccggacccttccccgtccggtaccctacgttaccgtacgggtcgggtcccggtacccgggttcccggtaacgggacgttgggacgggtacgttacgtaaagttactttaacgtgttcgtaccggttaggtttcggtagtcgttaccgcgttacgttggtaggttccgggtccggtcggttagggttccgggtacgggtacgggtaccgaacgtccggtcggtaacccggtccggtacggtaccgaacgtcccggtaacggtcccgtacccggtcccccggtaccgtcccgttacccgg

SEQ ID NO: 83307 - DNA, 642 bp, Homo sapiens
  misc_feature: GYAE6OF02I5EFF.25.23.C01.1.454.CMB.1.raw
  modified_base (236)..(236): a, c, t, g, unknown or other
  misc_feature (236)..(236): n is a, c, g, or t
  modified_base (306)..(306): a, c, t, g, unknown or other
  misc_feature (306)..(306): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggcagacgggtctccatctcttgttctgggancagctccgacgtcggaaatagtttgtctactggtaccagcagcctccgaacgaaaccgccccaagctccncatctagtagaatgatcgagccgccctagacggtatacctagaccgtatttctcgtcgacgtacgagtcgtggcctcccgtccggccctccgtcggccctagtccgaggtcgggtcccgttcccggtacggacggacgtcggacggtcgttaggtaactttacgttaccgtggttcgaccgttagggtttgggacttccggtaccgtcgttcgtggttaacggttcggtaccgggcggtttcgggttccgggacgggtacgggaacccgtaaggtccgtaccggtacccgtcggttaacggccgtaccgacccgtacggtccgtcccgtcccccgg

SEQ ID NO: 83308 - DNA, 566 bp, Homo sapiens
  misc_feature: GYAE6OF02FXQMM.25.23.C01.1.454.CMB.1.raw
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccgggcagagggtctccatctcttgttctgggagcagctccgacgtcggaaataagttgtctactggtaccagcagctcccagaaacggccccaagctcctcatctataggaatgatcagcggccctcgagggactaccgtgaccgattctctggctcgaagtctggccttcctccggcctcccgtggcccatcgaggtcgggctccgggtccgaggatgaggctgaatattactgtgctagttgggatgctagtctgagtcggtccgaggtggttcgggcgggacggaccgaagtccgtacgtaccgtccgtacgggtccacggacccaagggcctccggcccccgtggtcccgaccgtccgttaccggtccccgtcccc

SEQ ID NO: 83309 - DNA, 636 bp, Homo sapiens
  misc_feature: GYAE6OF02F5RF3.25.23.C01.1.454.CMB.1.raw
  modified_base (234)..(234): a, c, t, g, unknown or other
  misc_feature (234)..(234): n is a, c, g, or t
  modified_base (345)..(345): a, c, t, g, unknown or other
  misc_feature (345)..(345): n is a, c, g, or t
  modified_base (350)..(350): a, c, t, g, unknown or other
  misc_feature (350)..(350): n is a, c, g, or t
tcagactgtacagtcacgaccggtgctcgatttagtacacgtgattagggattggggagctgtggtagagaagacaggattcaggacaatctccagcatggccggcctccctctcctcctcacccctcctcactcactgtgcagggtcctgggcccaagtctgtgctgactcagcccaccctcagtgtctcggggaccccccggaggagggtcctccatctcttgttctgggancagctccgacgtcggaaattagtttgtctactggtacccagcagcctcccgaagaaacccggcccccaagcctcctcatctatagatgatcgagcgcctcgaggtctaccngaccnttcctgtcgctacgagtctggtcctccgtccgtccctcctgtaccctatccgtaggtcgggccgttccgggtccgaggtacgtggacgggcttaagtaattaacttgtcgtagtcgtagggtttggacttcggacccgtaggtcgtaggtacggttccgggtaccgtaccgggttggttaccgggaccgggtagggacccgaaggtcccgtcggaacccggttccgttaacggccgtaaccggcccgtaacggtcctccccggtcccccgttcggtaccctacccg

SEQ ID NO: 83310 - DNA, 643 bp, Homo sapiens
  misc_feature: GYAE6OF02FZCQC.25.23.C01.1.454.CMB.1.raw
  modified_base (216)..(216): a, c, t, g, unknown or other
  misc_feature (216)..(216): n is a, c, g, or t
  modified_base (244)..(244): a, c, t, g, unknown or other
  misc_feature (244)..(244): n is a, c, g, or t
tcagactgtacagtcacgaccggtgctcgatttagtacacgtgattagggattgggggggaagctcagcttcagctgtggtagagaagacaggattcaggacaatctccagcatggccggcctccctctcctcctcaccctcctcactcactgtgcagggtcctgggcccagtctgtgctgactcagcccaccctcagtgtctcgggacccccggnaggagggtctccatctcttgtctgggancagctcgacgtcggaaatagtttgtctactggtaccagcagcctccagaaccggcccccaagctcctcatctataggatgatcagccgcctgaggactaccgtgaccgactttctcgtggctacgaacgtctcgcctccgtccggtccctcccgtcggcccagtcgaggtccgggtccgtacccgggtccgaggtatcggacggtacgtagtaacttacttaaccgtggttcgacgttagggttttacgggactccgggtacctacgttcgtagggtaccggttgggttcccgtaacggggttcggtttacccggggacgggtaaccgggtaaccgttaacggccgttaccggtacccggttacccggtacggtaccggtaccggaccccgtaaccggg

SEQ ID NO: 83311 - DNA, 170 bp, Homo sapiens
  misc_feature: GYAE6OF02I4TA1.25.23.C01.1.454.CMB.1.raw
  modified_base (156)..(156): a, c, t, g, unknown or other
  misc_feature (156)..(156): n is a, c, g, or t
  modified_base (161)..(170): a, c, t, g, unknown or other
  misc_feature (161)..(170): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgcngactnnnnnnnnnn

SEQ ID NO: 83312 - DNA, 663 bp, Homo sapiens
  misc_feature: GYAE6OF02F943D.25.23.C01.1.454.CMB.1.raw
  modified_base (229)..(229): a, c, t, g, unknown or other
  misc_feature (229)..(229): n is a, c, g, or t
  modified_base (298)..(298): a, c, t, g, unknown or other
  misc_feature (298)..(298): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccgggcaggagggtctccatctcttgttctgggancaggctccgacgtcggaaattaagtttgtctactggtaccagcagctccagaaccggccccaagctccncatctataggatgatcagccggccctcgagggactaccgtgacccgtattccgtcgtgtctcggaacgtcgtcgggccttcccgtaccggcccttcccgttcggcctagtccgaggtcgggtccgttcccgggtcccggagggtacgtgggacggtctaggaacttacttaacgtgtgtccgtaggtttgggattcgaccgttagtcgtaggtcggttcgggtaccggtacgggttcggttcggggtacgggacggggaccgaacggtccggttcgggaacccggttccgttaacgggtacccgtaacggtaccccggtaacgggtcccgttacccggtccccccgttacgggtccctaacccgg

SEQ ID NO: 83313 - DNA, 918 bp, Homo sapiens
  misc_feature: GYAE6OF02JYK6R.25.23.C01.1.454.CMB.1.raw
  modified_base (147)..(147): a, c, t, g, unknown or other
  misc_feature (147)..(147): n is a, c, g, or t
  modified_base (211)..(211): a, c, t, g, unknown or other
  misc_feature (211)..(211): n is a, c, g, or t
  modified_base (482)..(482): a, c, t, g, unknown or other
  misc_feature (482)..(482): n is a, c, g, or t
tcagactgtacagtcacgaccggtgctcgatttagtacacgtgattagggattggggcagcttcagctgtggtagagaagacaggattcaggacaatctccagcatggccgcctccctctcctcctcaccctcctcactcactgtcncagggtcctgggcccagtcctgtgctgacctcagccaccctcagtcgtctacgggacccccggnaggacgggtcctccgattccgttccgttagttccgtggggacgccgtacggcctacccggaacgttaccgggtaaaatttaaggtttcggtaccttaacgttcggttaacccaggacctaacggtcccttaccccggaaacgggaaaaccccgggtcccccccaaaaggtccccttacccgttacctaacttaccgttaaacgtaacgggtaaactcgtaacgtaccgaacggtcccggtaccccctaaggaacgggtaaccttaacccgngtaaacccgtacgtttccttaccgggtacgtccgttaacggtaacgttcccgtcgggttaaccctcccggttaccggtcccccgtttaccgtaccggtcccgtacgtttacgaccggggttcgggtacccgttcccgggttaaccgaagggtccgtacgggtacggtaccgttacgtaaacgtttaccgttacgttagggtaaccgttcggttaaacggttttcggggacttcgggtaccctttaggttacgttacgggtaaccggttccgggggttaaccgttcggggtttccgggtttaccggggaccggggtaaaccgggttaacccggtaaacgggttcccggttaccccggtaacccgggtttaccgttaccggggttaacccggtaacccggtacccggggttaacccggtcccccggttaccccccggg

SEQ ID NO: 83314 - DNA, 706 bp, Homo sapiens
  misc_feature: GYAE6OF02J0JQU.25.23.C01.1.454.CMB.1.raw
  modified_base (677)..(677): a, c, t, g, unknown or other
  misc_feature (677)..(677): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcacgtgtctcgggacccccggcaggacgggtctccacttcctcctttggttctgggacgctacgccgtccggacggttacggaaacttaagttttgtcctacgttggaacctagcgagcctacccgaacgaaccggcccccaaggcctccctacactactataacggtaataggtactacacggtaccggtccctacggaacgggacttaccgtaccgtaccggtaactttcgtcgtcggtcgtacgtaacgttcgcgtccgttccgtccggtaccctcccggtcgcctacgtccggacggttcgggtacccgttccgggtaccgaagggtacgttcgggaacggtcgtaagttaaacctttgttaacgtcggttagtaccgtagggttttacgacgttcgaacccgtgttacgtcggtaacggtcggtccggacggttggttccgggacggtacggacaaggtcgacgtacgtccgtaggtcgacgtccgaacgtccgcgtacccncggttacctcgtacctccgtccctacccg

SEQ ID NO: 83315 - DNA, 835 bp, Homo sapiens
  misc_feature: GYAE6OF02H86IS.25.23.C01.1.454.CMB.1.raw
  modified_base (180)..(180): a, c, t, g, unknown or other
  misc_feature (180)..(180): n is a, c, g, or t
  modified_base (203)..(203): a, c, t, g, unknown or other
  misc_feature (203)..(203): n is a, c, g, or t
  modified_base (234)..(234): a, c, t, g, unknown or other
  misc_feature (234)..(234): n is a, c, g, or t
  modified_base (335)..(335): a, c, t, g, unknown or other
  misc_feature (335)..(335): n is a, c, g, or t
tcagactgtacagtcacgaccggtgctcgatttagtacacgtgattagggattggggagctgtggtagagaagacaggattcaggacaatctccagcatggccggctccctctcctcctcaccctcctcactcactgtgcaggtcctgggcccagtctgtgctgactcacgcccaccctnagtgtcgtccggggacccccggnaggacggtcctccatctcttgttcgagggancacgccgtccggacggtacggaaattagttgtcctacgtcggtaccagacgacgtcctacccgaacgggtaaaccccggacccctaagtccctacccctanaacgttacctaagtaacgggtaaattaggacttaccggacgggtcccgtcccgtacggaacggggtaccttaacccggtcggtaaacccgtctttacccgttcggtccggtaaccgttaccggggtaacgtttcccggttcggtcccttccccgggtacccgggttcccccctcccgggtacggacccttacggtccggtacgggttcccgggtccgttcccggggtacgtaacgggtcgtacgggtacgggtacgttagtaaacttacgttaccgttggttacggtacggttacgggtttcggagtaccggtacgtacgttcggtaagggaccgggttaccggtaccgtacgggttcggtcggggtaaccgggacggttaaccgggtaacgtcccggttaaccggtacccggttacccggttaaccgggacccgaacccgttacccgggaaccggtcccgttaccccccgggccccggttacccggtaccgttccccgg

SEQ ID NO: 83316 - DNA, 746 bp, Homo sapiens
  misc_feature: GYAE6OF02F368S.25.23.C01.1.454.CMB.1.raw
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctggcccagtctgtgctgactcacgccaccctcagtgtcgtcggggacccccggcaggacgggtctccgatctcttgttcgtggagcagcctccgacgtacggaattagttctactacgtggtaccagtcacgcctacccgaacgtaacccggaccccaagtcctcctcgactctaacgtaggaatgactacgacggccggcccgtacggaacggtacctaccgtacgtaacccgtcgttactccgtcggtccgtacggtaacgtcgtcggtccctcccgtccggtccctccgcggtcctagtcgtaggtccggtcccgttccggtaccggaggtcgtacgacggtactaaggtaacttacgttacgtaggtacgttaccggttagggttacgggacttccggtaccgtaacggttcggtacgggttacgggttaccgggttccggtacggggtttaccggggttcgggggacccgggtaaccgggtaaccggtaaccggttcccggttacccgggtaacccgggttacggttaccggacccgggtacccggtacccgggtaaccggtccccggtccccggttaccccccggg

SEQ ID NO: 83317 - DNA, 753 bp, Homo sapiens
  misc_feature: GYAE6OF02HB0JI.25.23.C01.1.454.CMB.1.raw
  modified_base (196)..(196): a, c, t, g, unknown or other
  misc_feature (196)..(196): n is a, c, g, or t
  modified_base (227)..(227): a, c, t, g, unknown or other
  misc_feature (227)..(227): n is a, c, g, or t
tcagactgtacagtcacgaccggtgctcgatttagtacacgtgattagggagttgggggagagaagacaggattcaggacaatctccagcatggccggcctccctctcctcctcaccctcctcactcactgtgcagggtcctgggcccagtctgtgctgactcagcccacctcagtgtccgtcggggacccccggnaggacggtctccattctcttgttcgtgggancagcctccgacggtacggtaaaattaggttttgtacctacgtcggtaaccagccaacgtccttacccggaacggtaaaacccggcccccaagcccgttacctactaacgtacttaagtaaggtaactgaactcgacggcccggcctaggacgggtaactaccgtacggtacctattcctacggtacggtaccgtacggtaacgttcgtacggtcccttcccgtcgtccccgtcgtcgactacgttacggacgggtccgggtccgtacccggtagacgggtacgtcggtaacgggtactaaggtaaacttacgtttaccgtggttacggtacggtttagggtttacggacgttcggtaaccgttagttccggtaggtaacgggttaccgggttcgggtacgggtttcgggtaccgggaacggggtaaccgaccgtaaggcccgtttaccggaccggttcgtacggtaccgacgccggagttcccgaccgcccgttacgtccgtacccgttcgttcccgtcccctccg

SEQ ID NO: 83318 - DNA, 624 bp, Homo sapiens
  misc_feature: GYAE6OF02F5JSQ.25.23.C01.1.454.CMB.1.raw
  modified_base (191)..(191): a, c, t, g, unknown or other
  misc_feature (191)..(191): n is a, c, g, or t
  modified_base (301)..(301): a, c, t, g, unknown or other
  misc_feature (301)..(301): n is a, c, g, or t
  modified_base (339)..(339): a, c, t, g, unknown or other
  misc_feature (339)..(339): n is a, c, g, or t
tcagactgtacagtcacgaccggtgctcgatttagtacacgtgattagggattggggacagaagacaggattcaggacaatctccagcatggccggcctccctctcctcctcaccctcctcactcactgtgcagggtcctgggcccagtctgtgctgactcagccaccctcagtgtctcgggacccccggnaggagggtctccatctcttgttctgggagcagctccgagtacggaaatagtttgctacgtcggtaccagcagcctccaacggaaaccggcccccaagcctcctcatctanaggatgatcaggccgcctgaggtactaccgtcgacgtnttctcgtggctacgagtcgtcggccttccgtcggtccctccgtacgcctatcgaggtcgggcctccgggtacgaggagtggacgtctagtaattacgttagtgtcgtacgttaggtttcgggattcgacccgtgttaccgtggtaggttccggtccggtagggtttcggtcgggacgggacggtaccgagccgtaccggtacccgtacggtacggtccaaccggacccgtaggtccccgtccgtacccgtcggtaccctccgttccggtacccgttcccctcccc

SEQ ID NO: 83319 - DNA, 625 bp, Homo sapiens
  misc_feature: GYAE6OF02F7HGY.25.23.C01.1.454.CMB.1.raw
  modified_base (304)..(304): a, c, t, g, unknown or other
  misc_feature (304)..(304): n is a, c, g, or t
tcagactgtacagtcacgaccggtgctcgatttagtacacgtgattagggattggggagcttcagctgtggtagagaagacaggattcaggacaatctccagcatgaccggcctccctctcctcctcaccctcctcactcactgtgcagggtcctgggcccagtctgtgctgactcagccaccctcagtgtctcgggacccccgggcaggagggtctccatctcttgttctgggagcagctccgacgtacggaaataagtttgtctactggtaccagcagcctccagaaccgccccaagctccncatctataggaatgactcacgcggccctcgagggactaccgcgaccgtattctcgtcggctacggaagtcgtcggccttcccgtccggccctcccgtgcctactccgaggtcgggcccgtccgggtccggaggacgtcggacggtctagtaacttattacgtgtgcgttaggtttgggattcggacgtacgtcgtagtaggtcgggtccggtacgggttcggttcggggacgggtacgggaaccgtaacggtccggtccggtaccggttccgtacggtaccgtaccggacccggtaacggtcccgtcccggtaccccccgg

SEQ ID NO: 83320 - DNA, 841 bp, Homo sapiens
  misc_feature: GYAE6OF02GSDOU.25.23.C01.1.454.CMB.1.raw
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcgacgccacctcagtcgtcgtccgggacccccggcaggacggtcctccgtatccgttcttgttcgtagggagcagcctcggacgtacggtaaattagttcgtactacgtcgtaccagcacgcctaccgaacgaacccggtccccaagtcctaccgtactacttaccgtaagtacggtaaacgttcgtaactccggacggtcccggtacccgttacggaagggtaccttaacccggtcggtaaccccgttacgtttccgtcggtacgggtaccgttacgggaacgtttccgtaccgggtcccttcccggtcccggtaccccgttacccgtccggacccgtaacgttaccgggtacgggttcccggggtacccgttaccccggggtaccggggtaacggtaccgggtaacggggtaccggtacggttaacggtaaacgtttaacggtttaacggtgggttaccgtacgggtttaagggtttacgggtaccttcggtaaccgttggttacggtagggtacgggttaccgggttccgggttaacgggttcgggttacggggaccgggtaacgggtaccgtacggtccggttaaccgggttacccgtaaccggttaacggtaaccgacccggtaacctacgggtccctaccccggtcccggttccgtaccctacccg

SEQ ID NO: 83321 - DNA, 635 bp, Homo sapiens
  misc_feature: GYAE6OF02JF5X5.25.23.C01.1.454.CMB.1.raw
  modified_base (233)..(233): a, c, t, g, unknown or other
  misc_feature (233)..(233): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccggcagagggtctccatctcttgttctgggancagctccgacgtcggaaattaagttgtctactggtaccagcagctccagaaccgcccccaagctcctcatctataggaatgatcagccgccctgagggtactaccgtcgaccgtattcctcgtcggctcggaagtcgtcggtacctccgtccggtccctacccgtcgggccctacgtccgagggttccggggtccttcccgggtaccggaaggtacgttcgggacggtccgtaggtaaacttacgttaacgtggtcgacgttagggtttacgggacttcggacctaggttcgtggtaggtccggtccggtacggttggtccgggacgggtacggaccaaggtccgtcggtacccgttcgtacggtccaccggtacccgaacggtcccgtacccgtcccccgg

SEQ ID NO: 83322 - DNA, 742 bp, Homo sapiens
  misc_feature: GYAE6OF02GJ5UP.25.23.C01.1.454.CMB.1.raw
  modified_base (205)..(205): a, c, t, g, unknown or other
  misc_feature (205)..(205): n is a, c, g, or t
  modified_base (230)..(230): a, c, t, g, unknown or other
  misc_feature (230)..(230): n is a, c, g, or t
tcagactgtacagtcacgaccggtgctcgatttagtacacgtgattagggattgggggagctgtggtagagaagacaggattcaggacaatctccagcatggccggcctccctctcctcctcaccctcctcactcactgtgcagggtccgtggcccgagtacgtgtgactgactcagccaccctcagtgtctcgggacccccggnagaggtctcatctcttgtctgggancagctccgacgtcggaaatagtttgtctactggtaccagcacgctccagaaaccggcccccaagcctctcatctataggaatgatcgacgccggccctagagggactaccgtgaccgtatttctctggcctcggaacgttcgtcggccttccgtacccgggtccctacccgttcggaccctaagtccgtaacgggttccggggtccgttaccccggggttaccgggaagggttaacgttcgggaacgggtccgttaacggtaaacgtttaactttaccggttaggtacggtacggttacggttttagggaacgtttcgcccgtaaggttccgtaggtacgggttcgggttacccgggtacggttcgggtttacgggaccggggtaacggtaccgaacggttccggtaccggtaacccggtttacccgttaacgggtacccgtaacccggtaccccggtaaccggggtccttaccccggggtacccccttaccggggttaccttaaccccggg

SEQ ID NO: 83323 - DNA, 679 bp, Homo sapiens
  misc_feature: GYAE6OF02GB48T.25.23.C01.1.454.CMB.1.raw
  modified_base (217)..(217): a, c, t, g, unknown or other
  misc_feature (217)..(217): n is a, c, g, or t
  modified_base (246)..(246): a, c, t, g, unknown or other
  misc_feature (246)..(246): n is a, c, g, or t
tcagactgtacagtcacgaccggtgctcgatttagtacacgtgattagggattgggggggaagctcagcttcagctgtggtagagaagacaggattcaggacaatctccagcatggccggcctccctctcctcctcaccctcctcactcactgtgcagggtcctgggcccagtctgtgctgactcagccaccctcagtgtcgtcgggacccccgggnaggagggtctccatctcttgttctgggancagctccgacgtcggaaattagtttgtctacgtcggtaccagcagcctcccaagaacccggcccccaagcctcctcactctataggaatgactcgacggccgtccctcgaggtactaccgtacgaccgtacttcgtcgtggcctacggtaagttcgtacggtccttacccggtccggccccttcccggtcggacctagtccggtacgggtcgggtcccttcccggggtaccgagggtactggacggtacttaggtaaacttcgttacgttcggtcgtacgttaggtttcgggaatcggtacctagtccgttaggtacggttccgggttacccgggtaggtttcgggttccgggacggggtaccggtaacccggtaagtccggttaccgtacccggttccggttacggtacccggaccgtaccccggtaacggg

SEQ ID NO: 83324 - DNA, 689 bp, Homo sapiens
  misc_feature: GYAE6OF02G2ZYP.25.23.C01.1.454.CMB.1.raw
  modified_base (210)..(210): a, c, t, g, unknown or other
  misc_feature (210)..(210): n is a, c, g, or t
  modified_base (240)..(240): a, c, t, g, unknown or other
  misc_feature (240)..(240): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcacgcccaccctcagtcgtctcggggacccccggnaggagggtctccatctcttgttctggggancagctccgacgtacggaaaattagtttgtactactcgggtaccagcacgcctacccaaggtaaaccggccccaagtcctcctcactcctaagtaggaatgatcgacgccgccctgacgggactaccgtgaccgtattcgtcgtggctacggagtcgtcggtcctccgtccggtcccttccggtcggaccctacgtccggtacgggttccgggtacccgttcccggggtacggaacgggtacgtacgggtacgggtaccgttagtaaactttacgtttaccgttggttacgtacgttagggtttcgggtacttcggaccgttaagtcgtagggtacgggttcgggtaccggttacgggttcgggttaccgggacgggtaacgggaccgtaaggtccgtcggtacccgtcggtaggtccgaccgtacccgacggtccctcccggtccccgg

SEQ ID NO: 83325 - DNA, 752 bp, Homo sapiens
  misc_feature: GYAE6OF02IBZHF.25.23.C01.1.454.CMB.1.raw
  modified_base (376)..(376): a, c, t, g, unknown or other
  misc_feature (376)..(376): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccacctcagtgtcgtcggggaccccggcaggagggtctccatctcttgttcgtgggagcagcctccgacggtacggaaaattaagtttgtcttacgtggtaccagcacgcctaccgaagaaccggccccaagcctcctcatctaagtaggaatgactcgacggccggacctcggacgggtactaccgtcggaaccgtntttcctacggtggtccttacggaacgttcgtacggtctcccggtccggaccctcccgtcggacctacgtccgtagggttcgggtaccgttcccgggtaccggtaagggtacgttcgggaacggtacgttaggtaaacttacgttacggttggtacggtacggttacgggttttacggggtaacgttccggtaaccgttggttacgttggtaacggggttccgggttaaccgggttaccgggtttagggtaccggggaccggggtaacgggtaaccggtaaaccggttcgggtacccggtaacccgggtttacggtaaccgggtaccgtaaccccggtacccgggtaaccgggttcccgtaacccggtccccccggg

SEQ ID NO: 83326 - DNA, 712 bp, Homo sapiens
  misc_feature: GYAE6OF02IE9K7.25.23.C01.1.454.CMB.1.raw
  modified_base (199)..(199): a, c, t, g, unknown or other
  misc_feature (199)..(199): n is a, c, g, or t
  modified_base (434)..(434): a, c, t, g, unknown or other
  misc_feature (434)..(434): n is a, c, g, or t
tcagactgtacagtcacgaccggtgctcgatttagtacacgtgattagggattgggggagctgtggtagagaagacaggattcaggacaatctccagcatggccggcctcctctcctcctcaccctctcactcactgtgcagggtcctgggcccagtctgtgctgactcagccaccctcagtcgtctgggacccccggnacgagggtcctccattcctcttgttctgggacgcagcctccgacgtcgaaatagtttgctactggtaccagcagtctacccgaagaaaccggcccccaagcctcctacagttacctaataacgggtaaatcgatacacgtcccgggccctcggaagggaccttacctaggacccgtattccgtcgtcggccttacgggaacttcgtcggtccttcccgtccgggcccttccccgnggccctgtccgtaggtccgggtcgtcccgggttaccggacggtagtcggacggtacgtacgtaagttactttaacgtgtagtaccgtagggtttcggattcggtaccgtaggttcgtaggtacggttacggttccggcgggttcggttccggggaccgggacggggtaccgtaacgggtccgttacgggacccggtttaccggtaacgggttaccgaaccgggtacccggtaacggtcccgttacccgggtccccccggttagggtccccttacccgg

SEQ ID NO: 83327 - DNA, 158 bp, Homo sapiens
  misc_feature: GYAE6OF02IQFCL.25.23.C01.1.454.CMB.1.raw
  modified_base (157)..(158): a, c, t, g, unknown or other
  misc_feature (157)..(158): n is a, c, g, or t
tcagactgtacagtcacgaccggtgctcgatttagtacacgtgattagggattgggaccaaggtcaccgtcctaggtcagcccaaggccaaccccactgtcactctgttcccaccctcctcactgtacagtctgagcgggctggcaaggcgcatagnn

SEQ ID NO: 83328 - DNA, 795 bp, Homo sapiens
  misc_feature: GYAE6OF02JX14C.25.23.C01.1.454.CMB.1.raw
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcacgccacctcagtgtccgtcggggacccccgggcaggacgggtcctccgatccgttctttgttcgtacgggagcacgctaccgacggtacggtaaattaaggtttcgtactacgtggtacccagccgaagcctacccgaaggaaaacccggcccctaaagcctaccgtactactacctaacgtaaggaatgactacgacgccggccctgaacggacttaccagaccgtattccgcgtcgtctacggtaagttcgtacggcccttccggtacccggtcccttacccggtcggtaaccctacgttcgaacgggttccgggcccggttacccgggtacgggtacggtaacggttacggacgggtacgtaaggtaaacgttacgtttacgttcggtaggtaccggttaacgggtttcgggttaacggtaccgggttacgtaccggttacggttacggggtacggttcccgggttaccgggttacgggttcgggtttaccggggacgggtaacgggtaaccgacggtcgtaccgggtcccgtaaccgggttacgaccggaacggtaccgtaacggtcccgtacccgggtccccggtacggcccgttaccggttcccggttaccgtcccccgttaacccg

SEQ ID NO: 83329 - DNA, 728 bp, Homo sapiens
  misc_feature: GYAE6OF02GRP4P.25.23.C01.1.454.CMB.1.raw
tcagactgtacagtcacgaccggtgctcgatttagtacacgtgattagggattggggagagaagacaggattcaggacaatctccagcatggccggcctccctctcctcctcaccctcctcactcactgtgcagggtcctgggccctagtctgtgctgactcacgccaccctcagtgtcgtccgggaccccggcaggacgggtcctacatctcgtttcgttcgtgggacgcaggtcctccggacggtacgaaaagttacggtttcgtctacgtggtaccagcacgtctaccgaacgaaccggaccccaagtcctcctactactcttacgaggtaatgactacgacggcccgtcctacgagggtacctacgcgtaccgacttcgtcgtacggtctaccgtaagtccgtcgtacctcccgtccggtccctaccgtcgtactcgtacgtggtcggtcccgtcccggtaccggtaggtagtcgacgggtacgtataaacgttcgttagtcgttacggtagttagggtttcggaacgtcggtacgtacgttacgtgggttacgggtaccggttccggtacggggttcgttcgggggcgggaacggtaccgagttacgtccggtaccgttacggtagggttcccgaaccggtaccgggaaccgttccccgggtccgttacccccggtcgggttacccttaccggtcccgtttacccgttccccccgttaacccc

SEQ ID NO: 83330 - DNA, 772 bp, Homo sapiens
  misc_feature: GYAE6OF02IVS9K.25.23.C01.1.454.CMB.1.raw
  modified_base (212)..(212): a, c, t, g, unknown or other
  misc_feature (212)..(212): n is a, c, g, or t
  modified_base (243)..(243): a, c, t, g, unknown or other
  misc_feature (243)..(243): n is a, c, g, or t
tcagactgtacagtcacgaccggtgctcgatttagtacacgtgattagggattgggggcagcttcagctgtggtagagaagacaggattcaggacaatctccagcatggcccggcctccctctcctcctcaccctcctcactcactgtgcagggtcctgggcccagtctgtgctgactcagccaccctcagtgtcctcggggacccccgggnaggacggtctccatcttcttcgttcgtgggncagcctccggacgtacggaaagttaagtttgttctacgtcggtacctagcagcctcccgaacggaaaccggcccccaagcctccgtctactctataggaatgatcagccgtccgtcgacggactaccgtagaaccgtacttctctggtcctacgaacgtgtcggtccgttaccgtcccggtcccttacccgtcgtacccctagtccgtagggtccggggtcccgttacccgggggtccggtaacggggtaacgttcggggtaacggtcgtttaaggtaaacctttaagttttacccggttggtagggtaccgtttagggggtttttacgggtaacgtttccgggaccgttaaggttcgttaaggggttccgggttacggggttcccgggttaacggggtttcgggggtttacccggggtacggggggtaaccgggggtaacccgtaacggggccggttaccgggtacccgggtttacggtaccgggttaccggtaaccggacccgggtaacgggtcccggtaccccggg

SEQ ID NO: 83331 - DNA, 777 bp, Homo sapiens
  misc_feature: GYAE6OF02GZQHZ.25.23.C01.1.454.CMB.1.raw
  modified_base (192)..(192): a, c, t, g, unknown or other
  misc_feature (192)..(192): n is a, c, g, or t
  modified_base (326)..(326): a, c, t, g, unknown or other
  misc_feature (326)..(326): n is a, c, g, or t
  modified_base (349)..(349): a, c, t, g, unknown or other
  misc_feature (349)..(349): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtcgtcgggacccccggngagacgggtctccactcttcttcgttcgtgggagcacgctaccgacggtacggaaattaagttgttctacgtggtaccagcagcctacccgaacgaaaccggacccccagacctcctcatctaagtagatgtancgacgcggccctagaggactacncggacgtcttctacgtgctacgtagtcgtcgcctctccggccctccgtcgacctacgtcgtaggtccgggcccgttaccgggtccgggaacggtcggtacggtacgggtacgttagtaaagttaacgtttaccgtagggttcgttacgggtttaacgggtttagggttacgtaccggtaccggttaacgttcggttacgggttaacgggttccggttaccccgggttaggggtttcgggttaccgggggtaacggggaacccgggtaacgtaacgggttccgttaaccgggtacccgttaccgggttaccggtaacccggtaaccgggtaacccggtaaccgggtaccccggttacccggttccccccggttacgggttacccgttaacccgttttcccggttcccggtttacccccccgtaccccgg

SEQ ID NO: 83332 - DNA, 689 bp, Homo sapiens
  misc_feature: GYAE6OF02HPWXH.25.23.C01.1.454.CMB.1.raw
  modified_base (171)..(171): a, c, t, g, unknown or other
  misc_feature (171)..(171): n is a, c, g, or t
  modified_base (193)..(193): a, c, t, g, unknown or other
  misc_feature (193)..(193): n is a, c, g, or t
  modified_base (215)..(215): a, c, t, g, unknown or other
  misc_feature (215)..(215): n is a, c, g, or t
  modified_base (219)..(219): a, c, t, g, unknown or other
  misc_feature (219)..(219): n is a, c, g, or t
tcagactgtacagtcacgaccggtgctcgatttagtacacgtgattagggattggggagagaagacaggattcaggacaatcctccagcatggccgcctcctctcctcctcaccctcctcactcactgtgcagggtcctgggcccagtctgtgctgactcacgccaccctnagtgtcgtcgggacccccgggnagaggtctccatctcttgttcnggancagcctccgacgtacgaaattaagtttgtacttacgtggtaaccagtcagcctacccgaacgaaaacccggcccccaaagtcctcctacagtacctagtaggaatgatcgacggccgcctgaggctacctagaccgtattctacgtggctacgtagtctacggccttccgtacggtccctcccgtcgaccattccgaggttcgggcccttcccggggtacgagggtacgtacgggagggtacctagtaaactttaacgttcgtagtcgtacggttaggttttggacgttcgaccgttagttcgtaggtacggttaccgggttaccggtacgggttgggttccggggaagggtaccgggtaacctaagggtccgtaccgtaccggttaccgttacggacctccggaccgaacggtccctacccggtccccgtacggtcctaccgtttcccgttaccgtacccccctacccc

SEQ ID NO: 83333 - DNA, 683 bp, Homo sapiens
  misc_feature: GYAE6OF02FZL7K.25.23.C01.1.454.CMB.1.raw
  modified_base (205)..(205): a, c, t, g, unknown or other
  misc_feature (205)..(205): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgtctgggatcagctccgacgtcggaaattaagttgtctacgtcggtaccagcacgcctacccaagaaacccggcccccaagcctcctcatctagagaatgatcagccgcctcgagggacttaccgtgaccgtatttcctccgtcggtcgtacgaacgttccgtcgggtcccttacccgtccggggtccccttacccgtcgggtaccctacgtcgtacgggtcggggtcccttacccgggtccggaagggtacgttacgggacgggtaccttaagaaacgtttaagttaccgttggttaccgcgtttagggtttagggtaacttcggaccgtaaggttccgttagggtacggttccgggtaccggtacgggttgggtccgggacgggacggtaaccgaaggtcgtaccgtacccggttcgtacggtctaccggacccgtacgggtccctccgtacccccgg

SEQ ID NO: 83334 - DNA, 620 bp, Homo sapiens
  misc_feature: GYAE6OF02JE1G2.25.23.C01.1.454.CMB.1.raw
  modified_base (318)..(318): a, c, t, g, unknown or other
  misc_feature (318)..(318): n is a, c, g, or t
  modified_base (490)..(490): a, c, t, g, unknown or other
  misc_feature (490)..(490): n is a, c, g, or t
tcagactgtacagtcacgaccggtgctcgatttagtacacgtgattagggattgggggggaagctcagcttcagctgtggtagagaagacaggattcaggacaatctccagcatggccggcctccctctcctcctcaccctcctcactcactgtgcagggtcctgggcccagtctgtgctgactcagcccaccctcagtgtcgtcgggacccccgggcaggagggtctccatctcttgttctgggagcagctccgacgtcggaaattagttgtctactggtaccagcacgctcccagaaaccggcccccaagcctccncatctataggaatgatcgacgcggtccctacgaggtactacctaggacctatttctcgtcgctacgaacgtcgtacggtcctccgtccgtccctcccgtcgctatcgaggtcggccgtccggtaccgaggtagtcggaggtctagaattactacgtgtgacgttaggttggngtacgtcctagtacgtgtacggttcggttaccggtcggttcgggttcgggaaccgggtaacgggtaaccgtaacggtcgttacccgggtaccggttaccggtacggtaccgaccggtacccgtaaccggg

SEQ ID NO: 83335 - DNA, 693 bp, Homo sapiens
  misc_feature: GYAE6OF02GUZ67.25.23.C01.1.454.CMB.1.raw
  modified_base (514)..(514): a, c, t, g, unknown or other
  misc_feature (514)..(514): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctcgggcccagtctgtgctgactcagccaccctcagtgtctcgggacccccggcagagggtctccatctcttgttctgggagcagctccgacgtacggaaattagttgtctactggtaccagcacgcctaccaagaaacccggcccccaagcctccctacatctaagtaggaatcgatcacggccgcctacgagggtactacctcggaaccgtcttctcgtcggacctacggaacgttcgtcggtccgttcccgtccggtcccctcccgtcggccctacgtcgaccggttccggggtcccgttcccggggtaccgaagggtacgtacggacgggttacgtagtaaactttacgttacgtacgggttntacggttaaggttttcgggacgttcgtacccgtaggttcgtggtacggttcggtaccgtcggggtttcggttaccggggacgggtacgggaccctaggtccgttcggtacccgttacggtacgggttccgaaccggtacccgtacgggtcctaccccgggtccccgttcggacctcccg

SEQ ID NO: 83336 - DNA, 513 bp, Homo sapiens
  misc_feature: GYAE6OF02F53MR.25.23.C01.1.454.CMB.1.raw
  modified_base (191)..(191): a, c, t, g, unknown or other
  misc_feature (191)..(191): n is a, c, g, or t
  modified_base (248)..(248): a, c, t, g, unknown or other
  misc_feature (248)..(248): n is a, c, g, or t
  modified_base (309)..(309): a, c, t, g, unknown or other
  misc_feature (309)..(309): n is a, c, g, or t
  modified_base (385)..(385): a, c, t, g, unknown or other
  misc_feature (385)..(385): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggagcagctccgagtcggaaatagtttgctacnggtaccagcagctccagaaacggccccaagctcctcatctataggaatgatcagcggcctnagggatacctgaccgattctctggctcgaagtctggctcctcggcctcctggccatcagtgggctccggtcgaggntgaggctgaatattactgtgctagtttggatgccagtctgtagtggtcgacggttgttcgggcggaggaccaagctagcgtcctaggtcagcccgaaggctcgcccctcggtcactctgtcccgtccc

SEQ ID NO: 83337 - DNA, 853 bp, Homo sapiens
  misc_feature: GYAE6OF02I5WN6.25.23.C01.1.454.CMB.1.raw
  modified_base (750)..(750): a, c, t, g, unknown or other
  misc_feature (750)..(750): n is a, c, g, or t
tcagactgtacagtcacgaccggtgctcgatttagtacacgtgattagggattggggagagaagacaggattcaggacaatctccagcatggccggcctccctctcctcctcaccctcctcactcacctgtgcgagggtcctcgggcccagtctgtcgctgactcacgccaccctcaggtcgtccgtccggggacccccgggcaggtacgggtcctccattccgttctttcggttcgtagggacgcgacgccctaccggacggtacgggaaatttacggtttcgtaccgttacgtcgggtaacctaggccacgtccgtacccgaacggaaaaccccggccccctaagcccttcccgtataccttaccggttaataacgggtaacttcggtactaccggaacggcccggtacccttaagggacgggttaaccttaaccgtccgtaaccggttactttaccgtccggttcggtaccgtacggtaaccgttccggtacgtccccttcccggtacccggtccccgttaccgttcgggaccctacggttaccggacgggttccggggtacccttcccgggggttaacccaaggggttacgtcgggaccggttacgttaacggttaaatttccgttaccggttcgggtacttaaccggggttgttttaacggggcttaccggtacccgtggtttacggacgtacgggtttccggttacccgtggggttacggtccgggacggttaacggaaccgtntacccgggtaggttaccccgttcgaaggtacccgaggaccccggtagttcccgtacccgtaccccgtagccggttacccgccgttccgttaccccggtccccg

SEQ ID NO: 83338 - DNA, 669 bp, Homo sapiens
  misc_feature: GYAE6OF02ICSXY.25.23.C01.1.454.CMB.1.raw
  modified_base (65)..(65): a, c, t, g, unknown or other
  misc_feature (65)..(65): n is a, c, g, or t
  modified_base (93)..(93): a, c, t, g, unknown or other
  misc_feature (93)..(93): n is a, c, g, or t
  modified_base (206)..(206): a, c, t, g, unknown or other
  misc_feature (206)..(206): n is a, c, g, or t
  modified_base (227)..(227): a, c, t, g, unknown or other
  misc_feature (227)..(227): n is a, c, g, or t
  modified_base (257)..(257): a, c, t, g, unknown or other
  misc_feature (257)..(257): n is a, c, g, or t
  modified_base (260)..(260): a, c, t, g, unknown or other
  misc_feature (260)..(260): n is a, c, g, or t
  modified_base (304)..(304): a, c, t, g, unknown or other
  misc_feature (304)..(304): n is a, c, g, or t
  modified_base (466)..(466): a, c, t, g, unknown or other
  misc_feature (466)..(466): n is a, c, g, or t
tcagactgtacagtcacgaccggtgctcgatttagtacacgtgattagggagttggggggggaanctcagcttcagctggtggtagagaaganaggattcaggacaatctccgagcatcggcccggcctccctctcctcctccaccctcctcactcactgtcgcgacgggtccgcggcccagtctgtgctagactcacgccacctnagtcgaccgcgggaccccggnaggagggtctccatctcttcgtcgtggganacncgccgtacgacgtaacgtaaagttagtttctcgtacgtcgaacngactacgctacccaaacggaaccccgacccctaagtcctactacacgttactaagaaggtatgaactcgaccgtccggacctaggaacggtacttaccgagaccttcgttctacgtggactagtacgtctcgtctcccgcgtaccctcgacgactagtacgnggtccggccgttaccggacgagtagtacgacggtatagtaacgtacttagtcggtcgtaggttacggttgacgtacgtaccgtaggttctacgggtacgggttcggtacccgggtaaggggtttccggtaacgggaacgggtaccggtacaaaccggtcgtacggtaccggtaccgtaacgggacacccgggtaaccgaacgg

SEQ ID NO: 83339 - DNA, 741 bp, Homo sapiens
  misc_feature: GYAE6OF02JGSR0.25.23.C01.1.454.CMB.1.raw
  modified_base (180)..(180): a, c, t, g, unknown or other
  misc_feature (180)..(180): n is a, c, g, or t
  modified_base (187)..(187): a, c, t, g, unknown or other
  misc_feature (187)..(187): n is a, c, g, or t
  modified_base (199)..(199): a, c, t, g, unknown or other
  misc_feature (199)..(199): n is a, c, g, or t
  modified_base (223)..(223): a, c, t, g, unknown or other
  misc_feature (223)..(223): n is a, c, g, or t
  modified_base (259)..(259): a, c, t, g, unknown or other
  misc_feature (259)..(259): n is a, c, g, or t
tcagactgtacagtcacgaccggtgctcgatttagtacacgtgattagggattgggggggaagctcagcttcagtctgtggttagagaagacaggattcaggacaatctccagcatggccggctcctcgtcctcctcaccctctctactcactgtgtcgagggtcctgggccagtctgtnctgactnacgccgaccctnagtgtccgtcggggacccccgggngacggaggtcctccatcttcgttcgttcgtagggancgtagtccttaccggacgtacggaaacttaggtttcgtctactggtaccagtcacgcctccaacggaaacccggccccgaaggtcctaccgtacgtaattacgtaagtaacgggtaactagggactacgaacggccggtcctacggaacggtataacccgtggaacccgtattctacgtggtacgtacggtaacgtctacggccttcccgtacggcccttacccgtcggacctagttcggacggttcggccgttccggtaccggaggtagtacggacggtcctagtaaacgttacttacgtaggtagtccgttaagggttcggaacttacggtacccttagttaccggttaggtacggtttaccgggtaccgggttacgggtttacggtaaccgggggacggtaaacggggaaccctaacgggttacctacgggttacccggttaccggtacggtaacccgaccgggttaccctaaaccggg

SEQ ID NO: 83340 - DNA, 786 bp, Homo sapiens
  misc_feature: GYAE6OF02H1J2P.25.23.C01.1.454.CMB.1.raw
  modified_base (216)..(216): a, c, t, g, unknown or other
  misc_feature (216)..(216): n is a, c, g, or t
  modified_base (335)..(335): a, c, t, g, unknown or other
  misc_feature (335)..(335): n is a, c, g, or t
  modified_base (341)..(341): a, c, t, g, unknown or other
  misc_feature (341)..(341): n is a, c, g, or t
tcagactgtacagtcacgaccggtgctcgatttagtacacgtgattagggattggggagcttcagctgtggtagagaagacaggattcaggacaatctccagcatggccggcctccctctcctcctccaccctcctcactcactgtgcagggtcctgggcccagtctgtgcttgactcacgcccaccctcgagtcgtccgtcggggacccccgggnacggacgggtcctccacgtccttccgttggttccgtggggacgcctagcctaccggacggtacggtaaaattagtttacgtctacgtcggtacagcacgctaccgaagaaccgcccaancctacncatcaagtacgatgatcacgcggtaccctgacggtactaccgtacgaccgttattctcgtggtacctacggtaagtccgtcgtaccgtcccgtaccggccttacccgtcggaccctacgtacggaccgggtttcgggcccgtaccgggttaccggacgggttacgtacgggtacgttacgttaacggtaactttacggttaaccgtttcggttacggtaaccggttttaaggggttttaccgggggtaactttcccgggacggtttaaccgttccgggtttaaggaccggggtttcgggtaacccgtttaccggggttcgggtaccggggttaccgggaaccgggtaaccggttaaccgtccgggtaaccgggttacccgttaccggtacggtaccggtaacccggtacccggtaacgtaccccggtcccggttaaccccccggg

SEQ ID NO: 83341 - DNA, 658 bp, Homo sapiens
  misc_feature: GYAE6OF02FG7OV.25.23.C01.1.454.CMB.1.raw
  modified_base (220)..(220): a, c, t, g, unknown or other
  misc_feature (220)..(220): n is a, c, g, or t
  modified_base (251)..(251): a, c, t, g, unknown or other
  misc_feature (251)..(251): n is a, c, g, or t
tcagactgtacagtcacgaccggtgctcgatttagtacacgtgattagggattggggggggaagctcagcttcagctgtggtagagaagacaggattcaggacaatctccagcatggccggcctccctctcctcctcaccctcctcactcactgtgcagggtcctgggcccagtctgtgctgactcagcccaccctcagtgtcgtcgggaccccccgggnaggagggtcctccatcctcttgttcgtgggngcagcctccgacgtacggaaattaagtttgtctactggtaccagcagcctacccagaaacccggccccaagcctcctcatctataggatgatcgacgccggccctgaggtactaccgtgacctatttctcgtggcctacggtaagttcgtcggtccttcccgtccggtccctcccgtcggcctagtcgagggtcgggtccgttcccgggtacggaggtacgttggagtcgtagtaattactttacgggtgttcgtacgttagggttttaggacttcgaccgtacggttcgtcgggtaggttccgggtaccggtacggggttcgggttaaccggggcggggtaacgggtacccgaaggttccgtacggtaccccggttacggtacggtccgaccggtacccggaacgg

SEQ ID NO: 83342 - DNA, 759 bp, Homo sapiens
  misc_feature: GYAE6OF02H6SI5.25.23.C01.1.454.CMB.1.raw
  modified_base (183)..(183): a, c, t, g, unknown or other
  misc_feature (183)..(183): n is a, c, g, or t
  modified_base (212)..(212): a, c, t, g, unknown or other
  misc_feature (212)..(212): n is a, c, g, or t
  modified_base (310)..(310): a, c, t, g, unknown or other
  misc_feature (310)..(310): n is a, c, g, or t
  modified_base (341)..(341): a, c, t, g, unknown or other
  misc_feature (341)..(341): n is a, c, g, or t
tcagactgtacagtcacgaccggtgctcgatttagtacacgtgattagggattggggacaggattcaggacaatctccagcatggccggcctccctctcctcctcaccctcctcactcactgtgcagggtctgggcccagtctgtgctgactcagcccaccctcagtgtctcgggaccccggnagaggtctccatcttcttgttcgtgggancacgctccgacggttacggaaattaggttgtacctacgtggtaccagcagcctacccgaacgaacccgccccaagcctcctcatctatagatcgatcngccggccctagaggactacctgaccgtatcnctgctacggagtctcggccctcgtccgcctccgtgccagttcgagtccgggccgttcccgggtcgacggagtcggacgggttactacgtaaattcgtttacgtcggttacgtacggtttagggttttacgggtacgttcccggtacttaacgggtttccgtagggtcggggtttacccggggtacccggggtttaccggggttccgggttcccggggggtaaaccggggaccggtaaacccggtaacgggttcccggtaaccggttttacccccggttaacgggtttacgggaccccggtaccggaaaccccccgggtaggggtcccctttccccgggaaccccccgttttcggacccttacccggtttaccccgtttccccgtacccccccgtacccgtttacccctgttaacccgg

SEQ ID NO: 83343 - DNA, 537 bp, Homo sapiens
  misc_feature: GYAE6OF02GUU2L.25.23.C01.1.454.CMB.1.raw
  modified_base (463)..(463): a, c, t, g, unknown or other
  misc_feature (463)..(463): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggcagagggtctccatctcttgttctgggagcagctccgacgtcggaaataagtttgtctactggtaccagcagctcccagaaaccggcccccaagctcctcatctataggaatgatcagcggccctcacgggataccgtgaccgattctctggctcgaagtctggctcctcggccctcccgtcggccatcaggtgggcctccgggtccgagggactcggaggctgaattattactgtgcgagtttgggatgcagtctgngtggtccgaggtgttcggcggagggacaggctcggacccgtcgtacggtcacgcccgaggtcctcgtcccccgg

SEQ ID NO: 83344 - DNA, 759 bp, Homo sapiens
  misc_feature: GYAE6OF02IWTDS.25.23.C01.1.454.CMB.1.raw
  modified_base (205)..(205): a, c, t, g, unknown or other
  misc_feature (205)..(205): n is a, c, g, or t
  modified_base (219)..(219): a, c, t, g, unknown or other
  misc_feature (219)..(219): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtccgtcgggcccagtcgtgtcgctgactcagcccacctcagtcgtctcgggacccccggnacggacgggttccncccattccttcgttttcgttccgtgggtacgcacggccgttccggaaccggttaccgggtaaaatttaacggttttcgttacccgttaacgtcggttaacccaaggcctaacggtcctaacccaacgggaaaaccccggaccccccaaaggtcccttcccttaccgattaacccttaaggtaacggtaacttaggaacctcgtaaccggcccggtacccgtaccggtaacgggtaacctacccggtagaccccgttaagtttccgtcgttacggccgtacgtaacgtcgtacggtcctccgtccgtccctccgtggcctagcgagtcgggcctccgggtccggaatcgtgacggtctaacgtaattacgttcgtgtcgacgttagttggacgtcgtctaacggttgtacggtacggtcggttaccggcgttacggccgggtaggacggtaccgtaagtccggtacggtacccgtaggtaccggtccgtaacccgccgttaacgggcccttccggtacccccggttaccggtctaccccgg

SEQ ID NO: 83345 - DNA, 637 bp, Homo sapiens
  misc_feature: GYAE6OF02JZQSZ.25.23.C01.1.454.CMB.1.raw
  modified_base (128)..(128): a, c, t, g, unknown or other
  misc_feature (128)..(128): n is a, c, g, or t
  modified_base (170)..(170): a, c, t, g, unknown or other
  misc_feature (170)..(170): n is a, c, g, or t
  modified_base (189)..(189): a, c, t, g, unknown or other
  misc_feature (189)..(189): n is a, c, g, or t
  modified_base (294)..(296): a, c, t, g, unknown or other
  misc_feature (294)..(296): n is a, c, g, or t
  modified_base (362)..(362): a, c, t, g, unknown or other
  misc_feature (362)..(362): n is a, c, g, or t
  modified_base (467)..(467): a, c, t, g, unknown or other
  misc_feature (467)..(467): n is a, c, g, or t
tcagactgtacagtcacgaccggtgctcgatttagtacacgtgattaggattgggagagaagacaggattcaggacaatctccagcatggccggcctccctctcctcctcaccctctcactcactgtncagggtcctggcccagtctgtcgctagactcgagccaccctnagtgtctcgggaccccggnaggcggtctccagtctccttgtcgtagggacgtcagtcctccgacgttacggaaattaagttttcgctaacgtggtaccagcagctccagaaccgcccagcctcnnnctatacgaatgactcagccggtcctcgaggcttaccgagccgtattcacgtggcctcgaacgttcnggtcctccgttcggccctacccggtgaccctatcgtagggtcggtccgtaccggtcgtacgggtactacgggacgggtcctacggaagttacttacgtggttacncgttaagtttcgggacttcgactacggtcgtgtacggtcggttacagggttcggtcgacgggtacgtacacgtagttcccgacgttaccgaccgggtctaaccggtccggaacgttcccggtaccgcccccggttaagccgttacccgtcgttaccccgtccccggtccc

SEQ ID NO: 83346 - DNA, 645 bp, Homo sapiens
  misc_feature: GYAE6OF02GKJZK.25.23.C01.1.454.CMB.1.raw
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccgggcagagggtctccatctcttgttctgggagcagctccgacgtcggaaatagtttgtctactggtaccagcagctccagaaaccgccccaagctcctcactctataggaatgactcagccggcctgacggactacctcgaccgtattctcgtcggctcgaacgtctgctcctcgtcctcccgtgccatcgagtcgggtctccggtcgacggagtcgacggtctaggtaattacttacgtagtgtacgttaggtttgggattcgccgtagtcgtggtagtcgggtccggacggttcggttcgggccgggacggtacccggtaaaggccgttacgggacccgttaccggtacgggtaccgtaaccggtaccccgtaacgggtccgttacccgggtcccccgttacccggttcccgttaacccgtttcccgtttaccccggtttacccccgtcccccccg

SEQ ID NO: 83347 - DNA, 609 bp, Homo sapiens
  misc_feature: GYAE6OF02HHDDY.25.23.C01.1.454.CMB.1.raw
  modified_base (208)..(208): a, c, t, g, unknown or other
  misc_feature (208)..(208): n is a, c, g, or t
  modified_base (239)..(239): a, c, t, g, unknown or other
  misc_feature (239)..(239): n is a, c, g, or t
  modified_base (303)..(303): a, c, t, g, unknown or other
  misc_feature (303)..(303): n is a, c, g, or t
  modified_base (352)..(352): a, c, t, g, unknown or other
  misc_feature (352)..(352): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtcgcagggtccgtggcccgagtcgtggtcgctgactcacgccaccctcagtcgtcgtcgggacccccggnaggacgggtctccatcctcttgttctgggancagcctccgagtcggaaattagttgtctactggtacagcagctccagaaacgccccaagctccncatctataggaatgatcacgcggccctagaggtactaacctgaaccgtnttcgtcgtggacttcggaacgtttcgtcggtcctccgtccggtccctcccgtggaccacgttcgacggtcgggccgttcccgggtccggaaggagtggacggtcgtagaaattacttacgtgtagtcgtaggttcggagtcgcgtagtcgtgtaggtccgtcggtacgggttcggtcggacgggtacgggacctaggcgtacggaccgttcggaggtaccaggaccgacggccgtccgacccccgtcggtacctccg

SEQ ID NO: 83348 - DNA, 627 bp, Homo sapiens
  misc_feature: GYAE6OF02GNGPK.25.23.C01.1.454.CMB.1.raw
  modified_base (200)..(200): a, c, t, g, unknown or other
  misc_feature (200)..(200): n is a, c, g, or t
  modified_base (228)..(228): a, c, t, g, unknown or other
  misc_feature (228)..(228): n is a, c, g, or t
  modified_base (446)..(446): a, c, t, g, unknown or other
  misc_feature (446)..(446): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctcgggacccccggnagagggtctccatctcttgttctgggancagctccgacgtacggaaatagttgtctactggtaccagcacgcctaccaacgaaacccggccccaagcctacctcatctaagtacggaatgactcgaggcccgcctacgacggtactacctcgaccgtattctcgtggtctacgtaagtcgtggcctccgtccgccctacccgtgacctactcgaggtcgggcctccgggtacgaggactgggacgntagaattacgttacgtgtacgtgttaggttaggctcgctaggtcgtacggtaggtccgggtccgtagggttcggtacgggacggtaaccgggacctaggtccgtaacggtcccggttacgtacggtcctaccggaacccggtagggtccctacccggtaccccgttcggtaccttacccgg

SEQ ID NO: 83349 - DNA, 836 bp, Homo sapiens
  misc_feature: GYAE6OF02FQVDP.25.23.C01.1.454.CMB.1.raw
  modified_base (192)..(192): a, c, t, g, unknown or other
  misc_feature (192)..(192): n is a, c, g, or t
  modified_base (213)..(213): a, c, t, g, unknown or other
  misc_feature (213)..(213): n is a, c, g, or t
tcagactgtacagtcacgaccggtgctcgatttagtacacgtgattagggattggggagcttcagctgtggtacgagaagacaggattcaggacaatctccagcatggccggcctccctctcctcctcaccctcctcactcactgtgcgagggtcctgggcccagtctgtcgctgactcacgcccacccgtnagtgtcctccgggaccccggnaggacgggtctccagtctcgttgttcgtgggacgcacgtccgtaccggacgttacggaaaatttaaggtttcgtaccgttacgtcgtaccgagtcgaacgcccttaccacggtaaccccgccccgtaagcctaccgtacgtacttaccgtaagtacggtaaacgtgaactccgaacggtccccggtaccgtacggaacgggtaccttaccggtacgtaacccggttactttccgtaccggtcgggtaccgttaccggtaaaacgttccggttaacgtcccgttccccggtaccggttaccccccgtttacccggtcccgggtccctaacgttcccggttaaggggtcccggggtttacccgttcccggggttaccgacgggttaacgtcggacggttccgttaaggaacttttacgttaccgtacggtcgttcgttacgggtttcggaagtcccgggtacgttacgtcgttaggttacgggtccggttacgggttaccggttgggttaccggggacgggtaacccggggaactaacggtcccggttacgggttacccgttaccgggttcggtacccggtaaccgtcccgtaacccgggtttccgacccccgggttacccccgg

SEQ ID NO: 83350 - DNA, 844 bp, Homo sapiens
  misc_feature: GYAE6OF02FIQYI.25.23.C01.1.454.CMB.1.raw
  modified_base (131)..(131): a, c, t, g, unknown or other
  misc_feature (131)..(131): n is a, c, g, or t
  modified_base (190)..(190): a, c, t, g, unknown or other
  misc_feature (190)..(190): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtncaggtcctgggcccagtctgtgctgactcagccaccctcagtgtctgggacccccgggnagagggtctccatctcttgttctgggagcagctccgacgtcgaatagttgtctactggtaccagcagctccagaaccggccccaagctcctcactctataggaattgactcgagtccggccctagacgggtactaaccctacggaacccgtagtttccgtactcgggtacctacggtaacgttccgtgggtcctcccggtcccggtaccctcccggtcgggaccctacgttccggaacggttcggggacccttcccggggtaccggtacggacggttacgggacggtactacggaaatttaactttacgtgggtacgaccgttagggtttacggggtactcggtaccgttaacggttccgttagggtaacgggtttcggggtaccccgggtttacggggtttacggggtttaaccgggggtacccgggggtaacggggtaaaccccgttaacgggtacccggttaacccgggttaccccgggttaacccggtaaccggggtttaacccgaacccgggttaaccccccggggtaaacggggttacccccgtttaaccccggggttcccccccccgggtttaaccggggtttaccccctaacggtttttccccccgggtttacccccgggtttaccccccccggtttcccccccgg

SEQ ID NO: 83351 - DNA, 551 bp, Homo sapiens
  misc_feature: GYAE6OF02FL83U.25.23.C01.1.454.CMB.1.raw
  modified_base (372)..(372): a, c, t, g, unknown or other
  misc_feature (372)..(372): n is a, c, g, or t
  modified_base (435)..(435): a, c, t, g, unknown or other
  misc_feature (435)..(435): n is a, c, g, or t
tcagactgtacagtcacgaccggtgctcgatttagtacacgtgattagggattgggggagcttcagctgtggtagagaagacaggattcaggacaatctccagcatggccggcctccctctcctcctcaccctcctcactcaggacacagggtcctgggcccagtctgccgtgactcagcctgcctccgtgtctgggtctcctggacagtcgatccaccatttcctgcactggactcagcactgatgttgctaggttattactttgtctcctggtaccaacacaccaggacaaacgaccccaaacttatctattatgacggccaactaacgcgccctcaggtagtttctaatcgcttctctggctcaagtcngcagcacgcctcctgacatctcgtggtctacaggctggacggacgaggctggtaattattacncgtctactactatacgtagacacactacaactaaccttccgtcttaccggacgtcgggaaccgtacgggtacctacccggtcgtcgggtccacggtcccaacggacccctaacccg

SEQ ID NO: 83352 - DNA, 720 bp, Homo sapiens
  misc_feature: GYAE6OF02GX4MM.25.23.C01.1.454.CMB.1.raw
  modified_base (195)..(195): a, c, t, g, unknown or other
  misc_feature (195)..(195): n is a, c, g, or t
  modified_base (216)..(216): a, c, t, g, unknown or other
  misc_feature (216)..(216): n is a, c, g, or t
  modified_base (243)..(243): a, c, t, g, unknown or other
  misc_feature (243)..(243): n is a, c, g, or t
  modified_base (267)..(267): a, c, t, g, unknown or other
  misc_feature (267)..(267): n is a, c, g, or t
  modified_base (306)..(306): a, c, t, g, unknown or other
  misc_feature (306)..(306): n is a, c, g, or t
  modified_base (335)..(335): a, c, t, g, unknown or other
  misc_feature (335)..(335): n is a, c, g, or t
tcagactgtacagtcacgaccggtgctcgatttagtacacgtgattaagggattggggagcttcagcctgtggtagagaagacaggattcaggacaagtctccagcattggccggccctacccctactcctcctacaccctcctcactcactagtgcagggtcctgggcccagtctgtgctgactcagccacctnagtgtcctggggacccccggnagagggtctccatctcttgtctgggancagctccgagtcggaaatagtttnctacgtggtaccagcagctccagaaccgccccaagctcncatcataggatgatcacggccgcctacgngggactccgtgaccgtattcgtacgtcgactacggaacgtccgtggtccttccggtaccgggtccctttcccggttggaccctacgtccgaacggttcggggtcccgttcccgggtacccggaagggtacgttacgggacgggtacgttaacggtaactttaacgtttacggttagtcgtacggttagggtttcgggagtccgtccgtaaggttcgttaggtagggttccgggtacccggggtacggttcgggttaccgggggaccgggtaaccggggtaaaccgtaccgggttacccgtacgggttaccccggttaccgttaaccggggtcgaaccccggtaccccgggtaaacggttccccggacccccggttaccccccggg

SEQ ID NO: 83353 - DNA, 761 bp, Homo sapiens
  misc_feature: GYAE6OF02JXQYZ.25.23.C01.1.454.CMB.1.raw
  modified_base (204)..(204): a, c, t, g, unknown or other
  misc_feature (204)..(204): n is a, c, g, or t
  modified_base (247)..(247): a, c, t, g, unknown or other
  misc_feature (247)..(247): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcaggtcctgggcccagtctgtgactgactcacgcccaccctcagtcgtcgtcgggacccccggnaggacgggttcctacctattccttcttcgttccgtaggggacncgacgtcctcccggacggtacggtaaattagtttcgtacctacgtcggtaccagcgacgtcctaccaacggtaacccggccccctaagccctcctacgacttacgtacgtaggtactagtactacgacgaccggtccctacgacggtactaccgtacgaccgtacttccgtcgttacgcgttacgagtcgttacggccttccgtaccgtccttccccgtcggtacctaacgttccggacggttccgggtccggtttcccgggtacccggaacggttgtacggtacgggtccgtaagtaactttacgtaaccgttggtaccggacgttagggtttaggtaccgtacggtccgttaacgtcggtacggtggttacccgggttcggtacgggtttaccggtcggggaccgggtaaccgggaccgtaacggttccggtaccggttaaccggtcggttaccgtacggaacgtacccggtaacggtccggtccccggtccccgttacgtcgttaccccgg

SEQ ID NO: 83354 - DNA, 681 bp, Homo sapiens
  misc_feature: GYAE6OF02F2VSY.25.23.C01.1.454.CMB.1.raw
  modified_base (233)..(233): a, c, t, g, unknown or other
  misc_feature (233)..(233): n is a, c, g, or t
  modified_base (238)..(238): a, c, t, g, unknown or other
  misc_feature (238)..(238): n is a, c, g, or t
  modified_base (334)..(334): a, c, t, g, unknown or other
  misc_feature (334)..(334): n is a, c, g, or t
tcagactgtacagtcacgaccggtgctcgatttagtacacgtgattagggattggggagcttcagctgtggtagagaagacaggattcaggacaatctccagcatggccgcctccctctcctcctcaccctcctcactcactgtgcagggtcctggcccagtctgtgctgactcagcccaccctcagtcgtacctcgggaccccggcagacggtctccagtcctcttgttcgngggancacgcctccgacggtacgaaattagttgtcctactcggtaccagcgacgcctaccgagaacccgccccaagcctcctcactctagtaggactgacncgtacgccggtccctaggacggtactaaccggtcgtaccgactttcctcgtacggctacggacgtcgtcggcctccgaccggtcctccgtgcctatcgacggtcggcctccggtacggacgatcggagtacgagttaacttacgtacgtggtaccgttacggtaggtttcggaacttcggtaacccgtaggttccgagggttacggtcccggttaccgggtgggtttaccgggttcggggaacgggtaaccgggtctaacggtcccggtaaccggttaccccggtttagtaacccgggttaccgaacccggtaccggttaccgggtacccgttccccgtaccccggg

SEQ ID NO: 83355 - DNA, 805 bp, Homo sapiens
  misc_feature: GYAE6OF02I2EUR.25.23.C01.1.454.CMB.1.raw
  modified_base (123)..(123): a, c, t, g, unknown or other
  misc_feature (123)..(123): n is a, c, g, or t
  modified_base (211)..(211): a, c, t, g, unknown or other
  misc_feature (211)..(211): n is a, c, g, or t
  modified_base (250)..(250): a, c, t, g, unknown or other
  misc_feature (250)..(250): n is a, c, g, or t
tcagactgtacagtcacgaccggtgctcgatttagtacacgtgattagggattgggggagcttcagctgtggtagagaagacaggattcaggacaatctccagcatggccgcctccctctccncctcaccctcctcactcactgtgcaggtcctgggcccagtctgtgctgactcagcccaccctcagtgtccgtcggggacccccgggtnaggtacggggtcctccgattcctcgttgttcgtggggancacgcgtccgacgtacggaaataagttcgtatactcggtaccagcacgtcctacccgaaggaacccggccccaaggtcctaccgtcctattccgtaagtaggaagttacgactacgacgtccgaccctcgacgggtactaccgtacggaccttatctacgtcggtacctacggtaatccgtcggtacccgtccgtcccggtccctccgtcgggtaccctaggtcccgtaggggttccgggtcccggtcccgggtacggaacggtactacgggcgggttacctaggttaaacttacgttaaccggttcggttacggtaaccggtttgggtttaccggggaacgtttccgacggggttaccgttcgggttacgggtaacgggttaccggggtacccggggtccgggtttaccgggggtacccggggtacgggtaccgggggtaaacccctaacgggttccgggtaaccgggttcccccggtaacgggttaacccgggtacccgggaaccgtacccccggggtacggtaccccgggttccccggttaaccccccgggg

SEQ ID NO: 83356 - DNA, 696 bp, Homo sapiens
  misc_feature: GYAE6OF02IVOQK.25.23.C01.1.454.CMB.1.raw
  modified_base (233)..(233): a, c, t, g, unknown or other
  misc_feature (233)..(233): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctcgggacccccgggcaggacgggtctccatcgtcttgttcgtgggancagcctccgacggtacggaaattagtttgctacgtcgtacagcagctacccaacgaaacccggccccaagtcctacctcactactagtaaggaataggactcgacggcccgcccgtacgacgggtactaccgtagaaccgtattcgttccgtcgggtactacggtaacgttcgtcggtccttcccgtccgtccccgttacccgtcggtacccacgttaccggtacgggtccgggttcccggttacccgggtacccggtagggtaccggtagggtacggtcgtaggtaaactttacgttacgtcggttagtccggttaagggtttcgggtatacggtcctaggtcgtacggttagggtccggtaccgggtacgggttcgggtacggacgggtacggtacacggtcgtacgtacccgtagtacggaccgacgaccgacggtccgtccgccccggttcgcctcccg

SEQ ID NO: 83357 - DNA, 939 bp, Homo sapiens
  misc_feature: GYAE6OF02HILUE.25.23.C01.1.454.CMB.1.raw
tcagactgtacagtcacgaccggtgctcgatttagtacacgtgattagggattggggagcttccagcctggtggttagagagtacaggtattcaggacaagtctccagcagtggaccggcctaccctctccgtccttcgacccttctcactcacttgtgcgaggtccttagggcccagtctgtgcgtgcctacacgcccgaccctgtagttcgggtaccgtccgggggtacccccgggagaacgggtaccggggttccggtaccctaacgttccgtttaccctttggtttaccgtcgggggacgtccgaaaggtccccgttaccggagggttaaccggttaaaaacgtttaaacggttttccggttacttaaaccgttacggttaacccgaacgccgtaacggtaccctacccccgtaacgggaaaccccccggacccccgaaacggtccccgttaccccgtacggtaacgttaccgttaagtacggtaacgtacgtacctaccggacgtaccgggttacccggtacggtaacgggtacgtaccgtacggtaaccgtactttaccgtcgtacgggtaacctacggtaacggttcgtacggtacccgtacccgggtccggtaccccttcccggtacgtccctacgtaccggtacgggttccgggacccgtttacccggggtaaccgtaacgggtacggttacggaacggttcgtaaaggttaacgttaaactccggttaaggtaccggttagttaacggtgggtaacctcggtaaccggtagttaccggttaggttacggtccgggttaccggtacggggtccgggtacggggacgggttaaccgggacgtaaccggtcgggtaacccgtacggtttaccggacgggtttaccgaccggtaacccgggttaaccgttcccggtaccccggttaccccggg

SEQ ID NO: 83358 - DNA, 714 bp, Homo sapiens
  misc_feature: GYAE6OF02HAN7X.25.23.C01.1.454.CMB.1.raw
  modified_base (234)..(234): a, c, t, g, unknown or other
  misc_feature (234)..(234): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtcgtcgggacccccgggcaggagggtcctccatcttcttgttcgtgggancagcctccggacgtcggaaattaagtttgctacgtggtaccagcagctccaagaaccgcccccaagcctcctcatctagtaggaatgatcacgccggccctcgaggactaccgtgaccgtattcctcgtcggctacggtaacgttcgtcggacctcccgtcccggtcccgtccccgtcggaccctagtccgtacgggtccgggtaccgtccccgggttccggaagggtacttgggaacggtacgtagtaacgttacgttacgtggttcgacggttagggttggtaacgttcgaccgttagtcgtagggtacggttaccgggttcccgggtaagggtttcggtcccgggggtaacggggaccggggtacccggtaacgggtccgtacccgggtacccggttacggttaacgggtacccgtacgggaacccccggtaggttaccccgtcccgggtacccccgttccgggtacccttacccgg

SEQ ID NO: 83359 - DNA, 754 bp, Homo sapiens
  misc_feature: GYAE6OF02IZ90Y.25.23.C01.1.454.CMB.1.raw
  modified_base (283)..(283): a, c, t, g, unknown or other
  misc_feature (283)..(283): n is a, c, g, or t
tcagactgtacagtcacgaccggtgctcgatttagtacacgtgatttagggattggggagctgtggtagagaagacaggattcaggacaatctccagcatggccggcctccctctcctcctcaccctcctcactcactgtgcagggtcctgggcccagtctgtgctgactcagcccacctcagtgtcgtcgggacccccggaggagggtcctccagttcttctttgttcgtgggagcagcctccgacggtacggtaaattaggtttgtactacgtggtaaccngcagcctacccaaggaaaccggcccccaaagcctcctacgactcctatagggaatgaactcacggccgcctacgagggtactaccgtgacctattcgtcgtgctacgagtcgtggcctccgtcgtcctacccgtggcctagtccgtacggtcgggtacccgtccgggtacgacgggtacgtacgggacggtacgttaacggaacgtttaacgtttacgtaggtttacgggacctttaacggggttttagggaccttcgggacccttaaggttcgttacggggtaacggttccggggttaccggttacggggttacggtttaccggggacggggtaaaccgggtaccgtaaacgggtcccggttaaccgggttaaacccccgtttacggtacccgggttaccgaacccgggttaaccccggacggttacccgtccccggtaaccccccggtttggtacccctttaccccggg

SEQ ID NO: 83360 - DNA, 663 bp, Homo sapiens
  misc_feature: GYAE6OF02JNEUK.25.23.C01.1.454.CMB.1.raw
  modified_base (201)..(201): a, c, t, g, unknown or other
  misc_feature (201)..(201): n is a, c, g, or t
  modified_base (407)..(407): a, c, t, g, unknown or other
  misc_feature (407)..(407): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtcctcgggacccccggnaggacggtctccatctcttgttctgggagcagctccgacgtacggaaatagtttgtctactggtaccagcagctacccgaggaaacccggcccccaagcctcctcactactagtaggaatgatacagccggccctgagggactaccgtacgacctattctacgtcggctacgtaacgtcgtacggcctcccgtcggcccttcccgnggtaccagtccgaggtccgggtcctcccgggtacgacggtagtcggacggtcgtagtaacttagttacgtggtcgtacgtaggtttacgggattcggccgtagtccgtgggtacggttcggtaccggtacgggttggttaccggggacgggtacgggaccgtggtaccgtacgggtaccgttaccggtacggtacccgtacggtacccggtaacgggtccgaccccgggtcccccgtacgggtacccttaacccgg

SEQ ID NO: 83361 - DNA, 958 bp, Homo sapiens
  misc_feature: GYAE6OF02G1INA.25.23.C01.1.454.CMB.1.raw
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagcccaccctcagtgtccgtcggggaccccccgggcaaggagggtcctccatccttctttggttcgtagggacgtcgacgtcctaccggaccggtacggggtaaaattaacggtttacgtaccttaacgtcgggttaccagtcgacgtccgtaccccgaacgggaaaacccggaccccccaaagcccttacccgtactaacttccgtaaagttaacgggtaacgttcggaacttaccggaaccggtccccgggtaccccgtacgggtaacgggttaacttacccgttacggaaccgtttacgtttacccgttcggttgggtacccgtacggttaacggttccgttacgggtacccgttcccggtcccggtcccccgttccggtacccgggtaccctacgtaccggttaggggtaccgggtcccggttacccggggtaccggaaggttcggtaacggacgggttacttaaagttaaacgttttaccgttacggttacggttacggtaccgtttaacggggtttacggggttacctacggttaccccgtaagggtttcggtacggttacgggttacccggggttaacggggtaccggggtttaccgggttccgggggacgggggtaaaccgggtaaccgtaaaccgggtccgttacccggttacccggttaccggtttaccgggtaacccgaccgggtaaaccccggtccgggtacccgttacccccggttacccccgggttacgtaccccgttcccggtttaccggttacccccccgggtttaccccttaccccccgg

SEQ ID NO: 83362 - DNA, 702 bp, Homo sapiens
  misc_feature: GYAE6OF02I73J1.25.23.C01.1.454.CMB.1.raw
tcagactgtacagtcacgaccggtgctcgatttagtacacgtgattagggattgggggagctgtggtagagaagacaggattcaggacaatctccagcatggccggcctccctctcctcctcaccctcctcactcactgtgcagggtcctgggcccagtctgtgctgactcagccaccctcagtgtcgtcgggaccccgggcaggagggtctccatctcttgttctgggagcagctccgacgtacggaaattagttcgtctactggtacagcagctaccgaacgaaacccggcccccaagtcctaccctctactactaacgtaggaactcgactacgacggccggccctacggacggtacctaccgtaggaaccgtacttccgtacgtcgggtacctcggtaagttcgtgggtccgttccgtcccggttccctcccggtcggaccctacgttccggacgggttcgggtcccggtccgggtaccgggagggacgtagggacggtacgtagtaacttacgttactggtcgtacgttagggtttagggattcggaccgtaggttcgtaggtacgggttcggtacccgggttcgggttcgggttaccgggagggtacgggaccgacggtccgtacggttacccgtacggtacggtaccgaccggcccgaacgggtcccgtaccggtccccgttacggtccttcccg

SEQ ID NO: 83363 - DNA, 779 bp, Homo sapiens
  misc_feature: GYAE6OF02FHQDI.25.23.C01.1.454.CMB.1.raw
  modified_base (181)..(181): a, c, t, g, unknown or other
  misc_feature (181)..(181): n is a, c, g, or t
  modified_base (203)..(203): a, c, t, g, unknown or other
  misc_feature (203)..(203): n is a, c, g, or t
  modified_base (235)..(235): a, c, t, g, unknown or other
  misc_feature (235)..(235): n is a, c, g, or t
tcagactgtacagtcacgaccggtgctcgatttagtacacgtgattagggattgggggagctgtggtagagaagacaggattcaggacaatctccagcatggccggcctccctctcctcctcaccctcctcactcactgtgcagggtcctgggcccagtctgtgctgactcagccaccctnagtgtctcggggacccccgggnaggagggtcctccatctctttgttcgtgggancagctccgacgtcggaaatagtttgcttacgtggtaccagctagcctaccgaacgtaaaccgggacccccaagtcctaccctactatactaagtaggaatcgatcgaaggcccggacccttacgaagggtactacccgtcggaaccttactttcctacgttcggactaccggtaaggtccgtacggccttcccggtccggtcccttacccggtcggaccctagtccgaacgggttcgggacccgttcccgggtaccggaagggtacgtcgggaccggtacgttaaggaaactttcggttaacgttgacggtacgttaggggtttacggtagtaccggtccggtaggtttcgacgggttacgggttcgggttacccggttacggggttcgggttaccggggaccgggggtaaacgggtacccgtaacgggcccggttaacgggtaaccccggttacgggttaaccgggtaccggttaacccgtaccccgggaacggttccccggtaccccgggtcccccggtttacgggtacccttaaccccggg

SEQ ID NO: 83364 - DNA, 747 bp, Homo sapiens
  misc_feature: GYAE6OF02GKZQC.25.23.C01.1.454.CMB.1.raw
  modified_base (207)..(207): a, c, t, g, unknown or other
  misc_feature (207)..(207): n is a, c, g, or t
  modified_base (236)..(236): a, c, t, g, unknown or other
  misc_feature (236)..(236): n is a, c, g, or t
  modified_base (556)..(556): a, c, t, g, unknown or other
  misc_feature (556)..(556): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggnaggagggtctccatctcttgttctgggancagctccgacgtacggaaattaagtttgtactacgtggtaaccagcagcctacccgaaggaaacccggacccccaagcctcctacgattacctaagtaaggaattgactacgaacgccggtccctacggaagggtactaccgtcggaaccgtatttccgctaggtctacggtaacgttcgtcgtaccttcccggtccggtcccctccgtcggaccctacgtcgtacgggtcgggtcccgtaccgggtccggtaaggtcgtacggtaccggtagttacgtaaacttacgtttacgtcggtacgtcggttagggttacgggnttacccggtagttacgttcggttagtacgggttaccgggtaccgggtaacggggtttcgggttaccgggggacgggtaaccggggtaacccgtaaggtccccggttaacgggttaaccccggttaccggttaacgggtccgtaaacccgggtacccggtaaccggttccggtacccccggttacccccggg

SEQ ID NO: 83365 - DNA, 674 bp, Homo sapiens
  misc_feature: GYAE6OF02J0YUT.25.23.C01.1.454.CMB.1.raw
  modified_base (204)..(204): a, c, t, g, unknown or other
  misc_feature (204)..(204): n is a, c, g, or t
  modified_base (235)..(235): a, c, t, g, unknown or other
  misc_feature (235)..(235): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagcccaccctcagtcgtcgtcggggacccccggnaggacgggtcctccatctcttgttctgggancagcctccggacggtacggaaattagttcgtctactggtaaccagcacgcctaccgaagaaaccggcccccaagtcctcctcatctaaagtacgaatggtatccgacggcccggtcctacgaagggtactacccgtagaccgtattcctcggtagcctacggaacgttcgcggtccttcccggtcccggcccttcccggtcgccgtactcggtacggtccgggtaccgttccgggtccggaggtacgttcgggacggtctaagtaacttagtttacggtggttgtacggttaggttagggtacttcgcgttagtcgtagggtcggttcgggtaccgggtacggttcggttacgggacgggtacgaccgacggtcgtcggtaccgttcggacggtaccgacggaccgtacggccgtcccggtcccgtacgtcctacccgg

SEQ ID NO: 83366 - DNA, 866 bp, Homo sapiens
  misc_feature: GYAE6OF02JX8VC.25.23.C01.1.454.CMB.1.raw
  modified_base (822)..(822): a, c, t, g, unknown or other
  misc_feature (822)..(822): n is a, c, g, or t
tcagactgtacagtcacgaccggtgctcgatttagtacacgtgattagggattggggagctttagctgtggtagagaagacaggattcaggacaatctccagcatggccggcctccctctcctcctcaccctcctaactcactgtgcagggtcctgggcccagtctgtgctgactcgacgcccaccctcaggtgtccgtccgggacccccgggctagggacgggttcctaccgacttcttccgtttggttcgtaggggcaccgtacggtcccgtacccggaacggttacggggtaaaaatttacggttttcgtaccttaaggtccgggtaaccacgccgtaacgtcctaaccccggaacggaaacccccggccccctaaaggccccttcccgtaacgtaacctttaccgtaaagttaacggtaactacgtaaccttacggacccggtaccggttacccccgaaggggtaaccgggttaaccttaccccggtacggtaaccggtacctttacccggtacggtttacggggtaccttaaacccgggtacggtttccggacgtttccccgttcccgggtcccggtaaccgtttccccgtacgggaccttacggtccgtacgggtaccgggtcccgttaaccgggccggtaacgtcggtaaggccgtaaggtacgtaaattccggtttagacgtcttacggtaggtttacggggaccttacggtccgttaggtacgtcgggttaggttaccggtaaccggggtcggttaggtcccggggaagtacgggaccgtagtcccggtcggttaccgcggttaacgggaacncccgtaccgaaccgggttcccacccgggtttccccaggttaccg

SEQ ID NO: 83367 - DNA, 772 bp, Homo sapiens
  misc_feature: GYAE6OF02GTO93.25.23.C01.1.454.CMB.1.raw
  modified_base (207)..(207): a, c, t, g, unknown or other
  misc_feature (207)..(207): n is a, c, g, or t
  modified_base (237)..(237): a, c, t, g, unknown or other
  misc_feature (237)..(237): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactggtgcgacgggtccgtgggcccagtctgtgctgactcagccaccctcagtgtcgtacgggacccccgggnagacgggtctccatctcttgttcgtgggancagcctccggacgtacggaaaattaagtttcgtctacgtggtaaccaggctacgctcccagaaaccggccccaagcctcacatccgtataggaatgatacgagccgcctacgagggaactaccgtcgaaccgtacttcgtacgtcggacctacggaacgtcgtacgtccgtcccgtccggaccctcccgtcgggtccccaaaggttcctaaggggtcccgggtacccgtttaccccggggacccggtaagggtaagtcggggtaacggtacccgttacgggtaaaactttacgtttacggtcggttacgtagttacgggtttttaagggcttacgggtacctacggtttacgaacgggttcgggttacgggtttaaccggtccgggggtttacgttaaccggggaccgggggaaacggttaccgtaacggtcccggtaacgggttaaccccgggttacctaacggggtacccgtaaccggttaccccggaagggttccgtaccccggtcccccggttagtaccccgtttaacccg

SEQ ID NO: 83368 - DNA, 757 bp, Homo sapiens
  misc_feature: GYAE6OF02HOIZK.25.23.C01.1.454.CMB.1.raw
  modified_base (196)..(196): a, c, t, g, unknown or other
  misc_feature (196)..(196): n is a, c, g, or t
tcagactgtacagtcacgaccggtgctcgatttagtacacgtgattagggattgggggagagaagacaggattcaggacaaatctccagcatggccggcctccctctcctcctcaccctcctcactcactgtgcagggtccgtgggcccagtctggtgctgactcagccaccctcagtgtcgtcggggaccccggnaggaggtctcatctcttgttcgtgggagacagcgtccgacgtacggtaaacttaagtttcgtctacgtcggtaacagtcagtcctaccgaacggaaaccggaccccaagccttcctacactctaagtaaggaatagactcgaacggccggcctacggacggaactaccgacggtaccgtacttcctacgcggtctaaccgtaaggtcgtcggtacctccggtcgtccctacccgtcggacctacgtacgtacggtcgggtcccgttacccggggagtacgggagttagggacggtacgttaagtaaacttacgtttacggtaggtcgtaggttaagggtttaccgggtacttacgggcgttaacggtttcggtaacgggtacgggttccgggtaccgggtaacgggtttcggggttaccgggggacgggaaacccgggtacgaaccggttaccgtacggtaccccggttggttacgggaccaaccggtacccggtaacgtcccgtaccccgcccggttaccggtactaaccggtttacccggttccttaccccccaacccg

SEQ ID NO: 83369 - DNA, 543 bp, Homo sapiens
  misc_feature: GYAE6OF02FG7Z9.25.23.C01.1.454.CMB.1.raw
  modified_base (228)..(228): a, c, t, g, unknown or other
  misc_feature (228)..(228): n is a, c, g, or t
  modified_base (323)..(323): a, c, t, g, unknown or other
  misc_feature (323)..(323): n is a, c, g, or t
  modified_base (406)..(406): a, c, t, g, unknown or other
  misc_feature (406)..(406): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccgggcagagggtctccatctcttgttctgggancagctccgacgtcggaaatagtttgtctactggtaccagcagctccagaaacggcccccaagcctcctcatctataggaatgatcagcggccctnagggatacctgaccgattctctggctcgaagtctggcctccgtcggccctcccgtcggccatcagtgggcctccggtcgaggntggacggctagaattattactgtgcgtaggtttgggatgccagttctgagttcggtccgacggttggttcgggaggacgggacagcgtcggaccgtcgtaggtccagcccgaggcctcggcccccgtggtcctaccg

SEQ ID NO: 83370 - DNA, 745 bp, Homo sapiens
  misc_feature: GYAE6OF02GBZAB.25.23.C01.1.454.CMB.1.raw
  modified_base (200)..(200): a, c, t, g, unknown or other
  misc_feature (200)..(200): n is a, c, g, or t
  modified_base (229)..(229): a, c, t, g, unknown or other
  misc_feature (229)..(229): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccgggnaggagggtctccatctcttgttctgggancagctccgacgtcgaaatagtttgtctatggtaccagcagctccagaaaccgcccccaagcctcctcatctataggaatgatcagccgccctcgagggtactacctcgaacccgtatttacctcgtcgggtaccttcggaaaggtttcctcgggccttacccgtccgggtaccccttccccgtcggggtaccctaagttccgtaagggttcggggtcccgttaccccggggttcccggtaaacgggtaacgttcggggaacgggtccgttaaggtaaaacgttacgtttcgttaggttcggtacgttacgggtttttagggacttcgggtacccttagggttccgtttacgggaggtttcggggttacccggtaaccggggtttcgggttccgggggaccggggtaacgggaccgaacggtccgtacggggtaaccccgttcggttaccgggtaccgaaccgggaccccgtaaggggcccttacccgggtccccccgttacgggtcccttacccgg

SEQ ID NO: 83371 - DNA, 727 bp, Homo sapiens
  misc_feature: GYAE6OF02J1RXT.25.23.C01.1.454.CMB.1.raw
  modified_base (158)..(158): a, c, t, g, unknown or other
  misc_feature (158)..(158): n is a, c, g, or t
  modified_base (201)..(201): a, c, t, g, unknown or other
  misc_feature (201)..(201): n is a, c, g, or t
tcagactgtacagtcacgaccggtgctcgatttagtacacgtgattagggattggggagctgtggtagagaagacaggattcaggacaatctccagcatgccggcctccctctcctcctcaccctctcactcactgtgcagggtcctgggcccagtcngtgctgactcagcctacccttcagtgtcctgggaccccccggnagtacgggtctccatctcttgttcgagggcgcagccgtccgacgtcgggaaaattagttcgtactacgtggtaccagcagcctccaagaaccgccccaagctcctacactctagtaacggaatgaactcgagcccggtacctggtacggacttaccgaggaccttagtccttacgtcggcctacggtaagtccgtgggcccttccgtaccggtccctcccgttcggacctagtcgtcggtcggtcctaccgggttacccgaagggttacgtacgggtcgtcgtacgtaacgttacgttacgttggtaccttacggtagggtttaggtaacggtcgtaccggttaataccggtttaggtacggttacggttacccgggttaaccgggtttcgggtaccgggtaccgggtaccgggtaccgtaacgggtcccggtaaaccgttcccggttaccggtacggttaccggaccggtaacccggtaacggttcccgtaacccgggtcccccgttacggtacccgttacccgg

SEQ ID NO: 83372 - DNA, 774 bp, Homo sapiens
  misc_feature: GYAE6OF02JY7ZH.25.23.C01.1.454.CMB.1.raw
  modified_base (133)..(133): a, c, t, g, unknown or other
  misc_feature (133)..(133): n is a, c, g, or t
  modified_base (195)..(195): a, c, t, g, unknown or other
  misc_feature (195)..(195): n is a, c, g, or t
  modified_base (227)..(227): a, c, t, g, unknown or other
  misc_feature (227)..(227): n is a, c, g, or t
tcagactgtacagtcacgaccggtgctcgatttagtacacgtgattagggagttggggagagaagacaggattcaggacaatctccagcatggccggcctccctctcctcctcaccctcctcactcgactgtncaggtcctggccagtctggtgactgactcacgccaccctcgagtgtcgtcgggacccccggnaacggagggtcctcgattcgtacgttcgtcgngggactctacggccgtaccggtaacggtaacggtaaagttaacgttccggtacctaaccggttcggtaaccgtaacgccgtacgtacccgtacccgaaaccggtaaacccgcccccgaaagtccccgttccctacgacttacgtaacgtaacggtaacgtgaccgtaccgaacggcccgttacccgcgtacgggtaactaccggtacgacccgttattaccgtcgtacggtccgtaacgtaacgttcgccgggtcctccggtacccgcctccgtcggtacctacgtcggaccggtcgggtcccgtacggtcgaaggtactcgggtagaccgtagtaacctagttaccgtgtacggtcgttaggtggtacctcgacctacgggtatcggtacggtcggtacccgttgggttaacgggtccgggtaacgggaacgtaacggacggttaacgtcccgaccggttctaacgggtccgaccggtaaccctcgggaccgttcccggtccccgttagtacccgttccggtttaacgtccccgttcccctacccg

SEQ ID NO: 83373 - DNA, 742 bp, Homo sapiens
  misc_feature: GYAE6OF02HEXW1.25.23.C01.1.454.CMB.1.raw
  modified_base (193)..(193): a, c, t, g, unknown or other
  misc_feature (193)..(193): n is a, c, g, or t
  modified_base (223)..(223): a, c, t, g, unknown or other
  misc_feature (223)..(223): n is a, c, g, or t
  modified_base (265)..(265): a, c, t, g, unknown or other
  misc_feature (265)..(265): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctcggggacccccgggnagacgggtctccatctcttgttcgtgggancagctccgacgtacggaaattaagtttgtctacgtggtaccngcagctccagaaaccggccccaagcctcctcatctaagtagaatgatcacggccgccctagacgggacttaccgtaggacccgtatttcctacgtcggtcctacggaacgttcgtcggtccttcccgtccgggtcccttcccggtcgggaccctacgtccgtagggtccgggtaccgttccccggggtaccggtacgggtacgttcgggacggtaccgttaacggtaaacttacgttaacgtaggtcgtacggttacggtttaggggacttcggccgtacggtacgttacggtaggttaccgggttacccgggtacgggttcggttaccggggacggggtaacgggtaccgtaagggtccgttaccggtacccggttacgttaccgggtaccgtaccggaacccgtacgggacccgttcccgtaccccccggttggtacccgtaccgtttcccggttcccgttaccccccgtacccg

SEQ ID NO: 83374 - DNA, 738 bp, Homo sapiens
  misc_feature: GYAE6OF02HD218.25.23.C01.1.454.CMB.1.raw
  modified_base (202)..(202): a, c, t, g, unknown or other
  misc_feature (202)..(202): n is a, c, g, or t
  modified_base (236)..(236): a, c, t, g, unknown or other
  misc_feature (236)..(236): n is a, c, g, or t
tcagactgtacagtcacgaccggtgctcgatttagtacacgtgattagggattgggggagctgtggtagagaagacaggattcaggacaatctccagcatggccggcctccctctcctcctcaccctcctcactcactgtgcagggtcctgggcccagtctgtgctgactcagccacctcagtgtcgtcggggacccccggnaggacgggtctccatcctctttgttcgtggggancgagtccgtaccggacggtacggaaaattaggtttgtactacgtcggtaccagcacgcctaccaggaaacccgcccccaagtcctcctctactactaagtaaggatcgactaccgacggcccgtacccgtagaacgggtaccttaccgtcggtaccgttacttccgtcggtcggtacctacggtaacgtttccgcggtcccgtccggtacccgtcccgtcgcgacgtagtcgtacgggtccggtccgtaccgggtacgtaggtggtggagtctaagttacttagttacgttgtacggtacgtttaggggttcgtacgtaccggtcggtacgttaggtacgggtaacgggttccgggtacgggttcggggttacgggttacggggaacgggtaaccggtacggaccggttacgtcccggttaaccgggacgggttaccgacccggtaccgaccggtaccgggttcccgtaccccgggtccccgggttacttcccgttacccgg

SEQ ID NO: 83375 - DNA, 708 bp, Homo sapiens
  misc_feature: GYAE6OF02GM1QT.25.23.C01.1.454.CMB.1.raw
  modified_base (199)..(199): a, c, t, g, unknown or other
  misc_feature (199)..(199): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcaggtcctgggcccagtctgtgctgactcagccaccctcagtgtctcgggacccccggnagagggtctccatctcttgttcgtggatcagctccgacgtacggaaattaagtttgtctactgtaccagcagcctcccaagaaaccggcccccaagcctcctcatctaatagaatgatcaggccggcctacgaggactacctcgaaccgtattctcgtggacgtcgaagttctcggccttccgtcggtccctcccgtcggcctagtcgtacggtcgggtaccgtccccgggttacggacgggtacgtacgggacggtacgtaggtaaactttacgtttaccgtagggtttcgtaccggtttaagggttttcgggtacttcggtacccgttaaggttccgttagggtacgggtttacggggttacccgggttaacgggtttcgggttaccggggtacgggtaacgggaccgtaacggtccgtacggtacccggttaccgtacggtacccgtaccgggacccgtaacggtcccgttacccggtcccccgttaccggtacccttaaccccgg

SEQ ID NO: 83376 - DNA, 726 bp, Homo sapiens
  misc_feature: GYAE6OF02HWT9B.25.23.C01.1.454.CMB.1.raw
  modified_base (172)..(172): a, c, t, g, unknown or other
  misc_feature (172)..(172): n is a, c, g, or t
  modified_base (223)..(223): a, c, t, g, unknown or other
  misc_feature (223)..(223): n is a, c, g, or t
  modified_base (271)..(271): a, c, t, g, unknown or other
  misc_feature (271)..(271): n is a, c, g, or t
tcagactgtacagtcacgaccggtgctcgatttagtacacgtgattagggattgggggagagaagacaggattcaggacaatctccagcatggccggcctccctctcctcctcaccctcctcactcactgtgcagggtcctgggcccagtctgtgctgactcagccaccctnagtgtctcgggtaccccggaggacggtcctccatctcttcgttcgtggacncacgtccgtccggtacgtacggtaaaattagttcgtactagtcgtacngcacgcctaccaacggaacccgacccagtcctctacattactagtaacgatcgtactcgacggccgtaccctaggaacggtactaccgtacgaccttacttcgtacgtcggtacctaacggtacgtcggtcgtccttcccgtccggtccgtaccgtcggactacgtaccggtcgggtaccggtcccggttaccgggtacgtagggtacgtcgggtaacgtcgttaagttaaacgtttacgtacggttcggtattaaccggtttaaggggtttcggactaccggtaccgtagtacggttgggaccggttacgggttccgggtggtttacgggccggggacgggtaccgaaagttccgtccgttacgacccggttgtaacggccgtaccgaaccggtacgtccccgtaccggtccccgttacggtccttcccgtacgttccccgtacccctacccgg

SEQ ID NO: 83377 - DNA, 716 bp, Homo sapiens
  misc_feature: GYAE6OF02IY5YP.25.23.C01.1.454.CMB.1.raw
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctcgggacccccgggcaggacgggtctccatctcttgttcgtgggagcagcctaccgacggttacggaaattagtttgctaaccgtggtaccagcacgctacccgaagaaaacccggccccctaagcctaccctcgactactagtaggaatgactcgaggcccggtacctcggaagggactacccgagaccgtattccgtcgtaggcctacggaagtctggtcccttccgtcggtaccccttccggtagtcccgtaactggaacggtcgggtccgttcccgggtacgaacggtattgggaacgtcgttacgtaatttacgttacgtggtcgtacgttaggttacgggtactacgccttacggtcagggtggtaccggttcccggtacgggttcgttaccggggacgaaacggggtaccgtacggtagttacccgggtaccgttaaccggaccggtcgtaacccgacccggaaccgggtcgttaccccggtcccccgttaggtaccctaccggttcccgttcccgtaccccccgtaccccg

SEQ ID NO: 83378 - DNA, 681 bp, Homo sapiens
  misc_feature: GYAE6OF02FPATV.25.23.C01.1.454.CMB.1.raw
  modified_base (190)..(190): a, c, t, g, unknown or other
  misc_feature (190)..(190): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggagcagcctccgacgtcggaaatagtttgtctactggtaccagcagcctccgagaaccggcccccaagcctcctcatctatagatgatcagccgcctcgagggactacctgaccgtattctcgtggtctcgaacgtctcggcctccgtccggtcctccgtcggtacctactccgtaggttcgggccgtccgggtacgagggtacgtgggacggtacgttagaacgtttacgttacgtggtacgtaccgttagggttttggggacttcgggtaccgtacggttcgtggtacggttcgggttcccggtacgggttcgggttcgggaccgggtaacgggaaacccgtaacggtccgttacgtacccggttaccgttacgggtaccaccggtaccccggtaaggtcccgtacccggtccccgttacgggttaccctacccgttccgttaccccgttaccccttacccccg

SEQ ID NO: 83379 - DNA, 730 bp, Homo sapiens
  misc_feature: GYAE6OF02FSVRG.25.23.C01.1.454.CMB.1.raw
  modified_base (212)..(212): a, c, t, g, unknown or other
  misc_feature (212)..(212): n is a, c, g, or t
  modified_base (253)..(253): a, c, t, g, unknown or other
  misc_feature (253)..(253): n is a, c, g, or t
  modified_base (578)..(578): a, c, t, g, unknown or other
  misc_feature (578)..(578): n is a, c, g, or t
tcagactgtacagtcacgaccggtgctcgatttagtacacgtgattagggattgggggagcttcagctgtggtagagaagacaggattcaggacaatctccagcatggccgcctccctctcctcctcaccctcctcactcactgtgcagggtcctgggcccagtctgtgctgactcacgccaccctcgagtgtccgtcgggaccccccgggnaggacgggttcctaccgattcctcgtttgttccgtggggancgacgcctccgagtacggtaaattaagttgtctacgtgtaccagcacgcctccgaagaacccggcccccaagtccctacctctacttccgtaagtaacggaattcgacgttacgacggtcccggtccctagacggtatacccgtagtacccgtatttcgtccgtacggtacgtacggtaacttcgtcggtcctacccgtccggtccctccgtcgtactacgtcgtacggtcgggtcccgtccggtacgtaggtacgtaggtaccgtagttacgaacctttagtttaacgcgtttcgtcggttacggttttacgggcgttaccgtntaacggttccgtaggtaccggttcgggttaacccgtacgggtttcggttaccgggacggggttacggaacctacgtaccggttaccgtacccgttaggttcccgggaaccgttaccggacccgtaacgggtccctacccggttaccccccgg

SEQ ID NO: 83380 - DNA, 840 bp, Homo sapiens
  misc_feature: GYAE6OF02GG1RN.25.23.C01.1.454.CMB.1.raw
  modified_base (174)..(174): a, c, t, g, unknown or other
  misc_feature (174)..(174): n is a, c, g, or t
  modified_base (198)..(198): a, c, t, g, unknown or other
  misc_feature (198)..(198): n is a, c, g, or t
  modified_base (228)..(228): a, c, t, g, unknown or other
  misc_feature (228)..(228): n is a, c, g, or t
  modified_base (230)..(230): a, c, t, g, unknown or other
  misc_feature (230)..(230): n is a, c, g, or t
tcagactgtacagtcacgaccggtgctcgatttagtacacgtgattagggattgggggagagaagacaggattcaggacaatctccagcatggccggcctccctctcctcctcaccctcctcactcactgtgcagggtcctgggcccagtctgtcgctgactcagcccaccctnagtcgtcgtcggggacccccgggnaggagggtctccatctcttgttcgtgggancncgcctccgacgtacggtaaattagtttgtactacgtggtaccagcacgtcctacccgaaggaacccggacccccaagtccctccgtacacttacgtaaagttaacggtaacgtcgtaactccggaaccgggtccccggtacccgtacggtaaacggggtacctttaacccggaccggttaacccgttactttaccggttcccggtagggtacccgttaacgggttaaacggttccgggtttacgggtaccccctttacccgggttccccgggttacccccgtttcccggaccggggtaaccctaacggttccgggtacgggggttcccgggtcccgggttacccgggggtaccgggtaacgggtacggtaaccggggtaacggtacgttaacgttaaacgtttaacgttacgttacggttcggtacggtttagggtttagggtacgttccggtacgtacggtcgtagggtcggttacgggtacggttacgggttcgggtacggggacggtacggactacggcgtaccggtccgttacgtacggtacggccgaccggtacggtcccgtcccggtacccgtcgtacctaccgtccgttacccaccccgtacc

SEQ ID NO: 83381 - DNA, 845 bp, Homo sapiens
  misc_feature: GYAE6OF02JPV8N.25.23.C01.1.454.CMB.1.raw
  modified_base (193)..(193): a, c, t, g, unknown or other
  misc_feature (193)..(193): n is a, c, g, or t
  modified_base (233)..(233): a, c, t, g, unknown or other
  misc_feature (233)..(233): n is a, c, g, or t
  modified_base (830)..(830): a, c, t, g, unknown or other
  misc_feature (830)..(830): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcacgccacctcagtgtcgtcggggacccccggnaggacgggtcctccgatccgttcttggttccgtggggacncaggcctccggaacggtacgggaaaacttaggttttcgtactacgttcgggtaacctagctacgcctacccgaaggaaacccggtcccccaaggtcctacccgtctactacgtaataacgggaattgaacttcgaacgccggtaccctacggaaggggtaccttaacccggtacggtaacccggttaactttccccgtaacgttcgggaaccgttacggttaacgtccggttagggtccccttccgtccggtccccgtccgttcgggacccttaccgttcccgggtcgggtccctttcccggggacggtaacgggtcgttagggaccgggtacttacggtaaacgttgttaccgttggtacgtccggttaagggtttcgggtaacgtcggtaccgtcgtttaccggtagggtacggtttaaccgggttccggttacggggttcggtttcccggggaaccgggttacgggtaacccgtacgggttccgtaacgggtccggttacggtaccggtacggtacccgggtaccgtaacggggtcccttacccgggccccggttaccggttccgtaaccggtttccccgtccggtttaccccnccccggtttacccgg

SEQ ID NO: 83382 - DNA, 758 bp, Homo sapiens
  misc_feature: GYAE6OF02GK1C1.25.23.C01.1.454.CMB.1.raw
  modified_base (199)..(199): a, c, t, g, unknown or other
  misc_feature (199)..(199): n is a, c, g, or t
  modified_base (230)..(230): a, c, t, g, unknown or other
  misc_feature (230)..(230): n is a, c, g, or t
  modified_base (328)..(328): a, c, t, g, unknown or other
  misc_feature (328)..(328): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcaggtcctgggcccagtctgtgctgactcagccaccctcagtcgtctgggacccccggnagagggtctccatcctcttagttctagggancagctccggacgtcggaaatagtttgctactgtaccagcagcctccagaaacggccccaagctcctcatcgtatagaatcgatcaagccggcccgtanacggggtactaccgtacgaccgtaattcctacgtcggtcttacgaaacgtttccgaggtccctcgttacccggccttccccgtcgggaccctattcgaagggtcggggtaccctccgggttacccgggacgggtaacgttcggaacggtccgttacggtaaagtttaacgttttacgtaggtttcgtaaccgttagggttttacggggaacttacggccccgttaagggttccgtacgggtaacgggttccggggtttacccgtacggggttaaccgggtttccgggaccggggtaaccgggtaacccgggtaaacggtcccgttaacgggttaaccccggttaccggttaacgggttaaccctaccgggtaaccccgacgggttccccgaacccgggttccccccttaccggggtaccttaaccccggg

SEQ ID NO: 83383 - DNA, 847 bp, Homo sapiens
  misc_feature: GYAE6OF02JIJWX.25.23.C01.1.454.CMB.1.raw
  modified_base (196)..(196): a, c, t, g, unknown or other
  misc_feature (196)..(196): n is a, c, g, or t
  modified_base (656)..(656): a, c, t, g, unknown or other
  misc_feature (656)..(656): n is a, c, g, or t
tcagactgtacagtcacgaccggtgctcgatttagtacacgtgattagggattgggggagagaagacaggattcaggacaatctccagcatggccggcctccctctcctcctcaccctcctcactcactgtgcagggtcctgggcccagtctggtgctgactcagccctaccctcagtgtctcggggacccccggnaggtacgggtctccatctcttgttcgtgggagcgacgtccgtaccggacggtacggtaaattaaggtttcgtcgtacgttcggtaaccagcaacggtcctacccgaacggaaaaccccggccccctaaagtccttacccctacgtaacttacgttaacgtaacgggtaaagttacgtactacgaccggtccggaccccgttacggaacgggttaacctaacccgtccggtaaaccgtactttcggtaccgtcggaccgttaacggtacgtccggtacgtccctccccgggtcgtaccccgttccggacgtccccgttaattcccggcgggtttaccggggtcccttcccgggggtaccggtaacggttaccggtgggaccgtacgtaacggttactttaacgttacgttcggtacgtcggttggtttacggggttacgttccggacgttacgtttccggngggttaccgggttccgggttaccggtccggggtaggtttccggggaacgggtaaccgggactaagggtcccgttacccggtccggtaaccgggttacgtccgtaaccgggtaccgtaacccggccgggtaccccgtcccggttaaccggttcccgttaccgttcccggtttcccgtacccccttaccccgg

SEQ ID NO: 83384 - DNA, 821 bp, Homo sapiens
  misc_feature: GYAE6OF02HAOHW.25.23.C01.1.454.CMB.1.raw
  modified_base (171)..(171): a, c, t, g, unknown or other
  misc_feature (171)..(171): n is a, c, g, or t
  modified_base (190)..(190): a, c, t, g, unknown or other
  misc_feature (190)..(190): n is a, c, g, or t
tcagactgtacagtcacgaccggtgctcgatttagtacacgtgattagggagttggggagagaagacaggattcaggacaatctccagcatggccggcctccctctcctctcaccctcctcactcactgtgcagggtcctgggcccagtctgtgctgactcagccaccctnagtgtctcgggaccccggnagaggtctccatctcgttgttctggagtcaggccttccggacgtacggaaaattaggtttgtctacgtggtaaccagtcagcctcccgaacggaaaacccggcccccaaagtcccttccctacgtacttcttaagtacggtaaatcggaacttcgaaccggccggacccgtacggtaaggggtacttaaccccgtggaaacccggttctttaccgttaccgttcgggccttaacggtaacggttccgtcgggtcccctttcccggtaccggtccccgttacccgttcgggaccctaagtttccgaacggggttccggggcccgtttacccggggtacccggtaagggtacggttaccgggaagggtaccgttaaagtaaaacgtttacgtttaccgtaggtacgtcgggtttaagggtttacgggtacttcgggacccgtagttcggttaggtacgggttccggtaccgggttcgggttcgggttaccgggacgggtaaccgggacgaaacgggttcgtaaccggttcccggttacgtacccgggttccaacgggtacccgtaacggtcccgtttacccgcccgtttaccggtcctacccgtttaccttacccccggttccctaaccccgg

SEQ ID NO: 83385 - DNA, 971 bp, Homo sapiens
  misc_feature: GYAE6OF02JH5RM.25.23.C01.1.454.CMB.1.raw
  modified_base (183)..(183): a, c, t, g, unknown or other
  misc_feature (183)..(183): n is a, c, g, or t
tcagactgtacagtcacgaccggtgctcgatttagtacacgtgattagggagttggggagcttcagctgtggtagagaagacaggattcaggacaatctccagcatggccgcctccctctcctcctcacccgtcctcactcacctgtcgcagggtcctcgggcccagtctgtgctcgtactcncgccacctcgagtcgtcgtcgggaccccggcaggacggtcctccagttcctcttcgttacgtgggacgctacggtccgttacccgacgggtaccgtaaaacttaaggttttacgtaccgttacgttacgggttaaccgtacgtccgaaccggtcccttaccccgaacgggaaaccccggccccccgtaaacggtccccttacccgttaccgtaacgttccgttaacgtaacgggtaacttacgggtactttaccgaacggtcccgggtaccccgttacgggtaaccgggtaaccgttaacccggtaccggttaaaccgtaacggtttttcccgtaccggtttaacggggttaccccgtaccggggttaaacggtttcccgggtttaccgggtaccgttaccccgttacccgggtccccgggtttaccccgttcgggcccgtttaacgtaccgggtccgggttacggggttaccccgtacccggggttaaccggtaaccgggttacggttaccgggtcgggtaaccgttacggggttaaaaccttacggtttaacccggttaggttaccggtaacgggtttacgggttacggggttaaaccgtaccgggtacccttaagggttcccgtaagggggtttaccgttcggggtaacccggttacggggtttaccggttcccggggtaccgggtaaccggggtaccgtaccgggttactaccgggttacccggtacgttacccggggtacctacccggtaaccggtcccgtaaccgggtccccgtaccccggg

SEQ ID NO: 83386 - DNA, 791 bp, Homo sapiens
  misc_feature: GYAE6OF02JGB8H.25.23.C01.1.454.CMB.1.raw
  modified_base (200)..(200): a, c, t, g, unknown or other
  misc_feature (200)..(200): n is a, c, g, or t
  modified_base (204)..(204): a, c, t, g, unknown or other
  misc_feature (204)..(204): n is a, c, g, or t
  modified_base (223)..(223): a, c, t, g, unknown or other
  misc_feature (223)..(223): n is a, c, g, or t
tcagactgtacagtcacgaccggtgctcgatttagtacacgtgattagggattgggggagctgtggtagagaagacaggattcaggacaatctccagcatggccggcctcctctcctcctcaccctcctcactcactgtgcagggtcctgggcccagtctgtgctgactcagcccacctcagtgtcgtcgggaccccggnaggnggtcctcatctcttgtcgnggagctagccgtccgacggtacggtaaatagtttcgtctacgtggtaccagcaggtccctaccgaaggaacccggcccccaagcctacctacacttacctagtacggaattcgaactcgacggtccgccctagtacgggtactaccgtgaccttacttccgtacgtcggtacgtacggtaacgttcgtacggtcctacccggtcccgtacccgttccgtccggacctacggttccgtaagggtccgggtacccttacggggtacccggaaggtccgttagggaggttaccgttaacgttaaactttaccggtttacgttggggttacttaccggggtttaggtttaccgggacgtaccgtaccggggttaacgtttccgggttaacgggttaaccgggtttacccgggccgggtttacccggggttacgggtttaccggggaacgggtaaccgggcccttaagggtcccggtaccggtttacccgggttaccaacggggtaccgtacccgtacccggggtaccgttcccgtcccccgggtaacccggttcggttaacccctccccggg

SEQ ID NO: 83387 - DNA, 800 bp, Homo sapiens
  misc_feature: GYAE6OF02GXPAQ.25.23.C01.1.454.CMB.1.raw
  modified_base (187)..(187): a, c, t, g, unknown or other
  misc_feature (187)..(187): n is a, c, g, or t
  modified_base (211)..(211): a, c, t, g, unknown or other
  misc_feature (211)..(211): n is a, c, g, or t
tcagactgtacagtcacgaccggtgctcgatttagtacacgtgattagggattggggatcttcagctgtggtagagaagacaggattcaggacaatctccagcatggccggcctccctctcctcctcacctcctcactcactgtgcagggtcctcgggcccagtctgtgctgactcacgccaccctnagtcgtcgtacggggacccccggnaggacgggtcctccagttcttcgttcgttacgtggggactcacgtcgtaccggtaacgtacgggtaaaattaaggttttcgtctaccgttacggtaacctagccgacggtccctaccccgaaggaaaccccggtacccccaacgtcccttacccgtactacttacctaagttaacggaattagacgttacgaccggtaccggtcccgtacggagggtaaccttaccggtacgtaacccgttatttccgtacggttacggtcccgttacggtaaacggttccgtacgggtcccgtcccgttacccggtcccctacccggtccggtacctaacgtcccggtaagggtcccgggtcgtaccccggggtaccggtaagggtacgtcgggaacggttccgtaacggttaactttacgtttaccggtcgttaggtccgttagggtttacgggattccggaccttaggtccgttggaccggttcggtccggtagggttccgggtacgggacgggtacggaacgtggtacccgtcggttaccgggttaccgcgggtaccgccggaacccggttaggtccccggtacccgtaccccgg

SEQ ID NO: 83388 - DNA, 760 bp, Homo sapiens
  misc_feature: GYAE6OF02IOAGR.25.23.C01.1.454.CMB.1.raw
  modified_base (560)..(560): a, c, t, g, unknown or other
  misc_feature (560)..(560): n is a, c, g, or t
tcagactgtacagtcacgaccggtgctcgatttagtacacgtgattagggattggggagctgtggtagagaagacaggattcaggacaatctccagcatggccggcctccctctcctcctcacccctcctcactcacgtgtgaccgagggtcccgtcgggcccagtctgtgctgactcacgcccaccctcagtcgccgtccgggaccccggcgaaggcggtctaccatcctcgttgttcgagggagcgcgcctaccggacgtaacgtaaagttacgtttgccttacgtcgggtaccacgcacggccacccgaacggaaacccggacccccaagtcctccctacctattacaaacgttagaagtactaacgcgtacggacccggacaccggaacgggtacctaccggtaacgaacccggttatcccgttaggtaacggccgtttacgggaactttccggacgcccgttaccggcccgttcccgttcccgtccggacctacgtaccgggttggtacccggtcccgggttcccgggaaccggaggtacggtaccggaccggtntaaaggttactaacttcgggttgacgtacggtttagggtcggtgtacgtccgggacttggtacggacggttccggaacggttccggtcgggtaacgggcccgggtaagacgacggttaccgccggtacccgttacggaacggacccgttccggaacggtaccctccggtccccggtaccccgttaggcccttaaccccgg

SEQ ID NO: 83389 - DNA, 689 bp, Homo sapiens
  misc_feature: GYAE6OF02F5YDZ.25.23.C01.1.454.CMB.1.raw
  modified_base (217)..(217): a, c, t, g, unknown or other
  misc_feature (217)..(217): n is a, c, g, or t
  modified_base (220)..(220): a, c, t, g, unknown or other
  misc_feature (220)..(220): n is a, c, g, or t
  modified_base (229)..(229): a, c, t, g, unknown or other
  misc_feature (229)..(229): n is a, c, g, or t
  modified_base (233)..(234): a, c, t, g, unknown or other
  misc_feature (233)..(234): n is a, c, g, or t
  modified_base (257)..(257): a, c, t, g, unknown or other
  misc_feature (257)..(257): n is a, c, g, or t
  modified_base (264)..(264): a, c, t, g, unknown or other
  misc_feature (264)..(264): n is a, c, g, or t
  modified_base (279)..(279): a, c, t, g, unknown or other
  misc_feature (279)..(279): n is a, c, g, or t
  modified_base (285)..(285): a, c, t, g, unknown or other
  misc_feature (285)..(285): n is a, c, g, or t
tcagactgtacagtcacgaccggtgctcgatttagtacacgtgattagggattgggagggctttgttggagaccctgtccctcacctgcagtgtctctggtggctccgtcagtgctttattactggagctggactccgccagtccggaccgggaggggactgggagtggagttgggctatatatacgaatggaacttaaccactacaaccctcctanagntcgatcacntacnngcgcacgcaggatcagtcgttcngcatctncttctgcgctgccgnggaccncgacctatacctcgtgacgaccgagacgtcgtacgcgtacgcgtacttaggttttcggaagttaattacttagtttcgtttgtgttaccttttaggaactagttgggtaaccggggacgtaaaggggtaccgtaccggttacctacccggttcctaccgtttacgacggtcccttacccggaaccgtaccgggaccctaccgggttacccttcccgtttacccccgccggttaccccggtaccccttaccgtaacccgtacgggacccgtaccgtacccgttcgggttaccgggacaccgggtccggaccgttcgggcgtaccggtcgtccgtacggtaccaacggtactccgttaccgtcgtacgtacgtaccgtgacgggcgcgggtcgtggaccggtacgg

SEQ ID NO: 83390 - DNA, 724 bp, Homo sapiens
  misc_feature: GYAE6OF02GOONP.25.23.C01.1.454.CMB.1.raw
  modified_base (259)..(259): a, c, t, g, unknown or other
  misc_feature (259)..(259): n is a, c, g, or t
tcagactgtacagtcacgaccggtgctcgatttagtacacgtgattagggattgggggagagaagacaggattcaggacaatctccagcatggccggcctccctctcctcctcaccctcctcactcactgtgcagggtcctcgggcccagtctgtgctgactcacgccaccctcagtgtcgtcggggacccccggcaggtacgggtcctccatcttcttgttcgtgggagcagcctccgacgtacggaaattacgtttntctacgtcggtaccagcacgcctacccgaacggaaacccggacccccaagtcctccctacattaccttaagtaaggtaatggactacgacggccggaccctacggaacgggactaccgtacgaccgtatttcctcgtcggccttacggtaacgtcgtcggtccttcccggtccggtccctcccgtcgtacctactcgacgggttccgggtccgtacccggggtaccggaggtacgtacgggacggtactagtaaactttaagttaccgtaggttcggtacgtttagggtttacggggtactcggtccttaggttcgtagggtacggttccggtaccgggtcgggttccgggtcggggtacggaacggggactaacggtccggtaaccgtccggtacggtcgacgacgtacccggacggtcccacccgtcccggtcggtcctacccgttctacccgtccctacccg

SEQ ID NO: 83391 - DNA, 773 bp, Homo sapiens
  misc_feature: GYAE6OF02HBVNW.25.23.C01.1.454.CMB.1.raw
  modified_base (215)..(215): a, c, t, g, unknown or other
  misc_feature (215)..(215): n is a, c, g, or t
  modified_base (330)..(330): a, c, t, g, unknown or other
  misc_feature (330)..(330): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcgaggtcctgggcccagtctgtgctgacctcacgccaccctcagtcgtccgttcggggaccccccgggnacggacgggtctccattcctcttgttacgtgggagccagctaccgacgtacgaaatagtttgtactacgtggtaccagcagcctaccgagaaccggccccagctcctcatcgtanacggaatggactcgacgccgtcccgtagacgggactccgtacggaacccgtatttccgtacgtcgggtactaccggtaagttccgtgtacccgtcccgtccggtccctccccggtagaccctaacgtcgtaacgggttccgggacccgtttcccggggaccggtagggtaacgttcgggtacggtacgtttacggtaaactttccgtttaacggtcgttacggtaaccgttaggggttttaacgggacgtcccggttaccgtacggtttaaccgttggggttacccgggttaccgggttacccgggtaacgggttttccggggtacccgggacgggggtaacccgggtacctaaaccgggttccgtaaccgggtaccccggttttacgaccgggtacccgacccggtacccgggaccggttacccgtcccggttaccccccgg

SEQ ID NO: 83392 - DNA, 829 bp, Homo sapiens
  misc_feature: GYAE6OF02JV0R7.25.23.C01.1.454.CMB.1.raw
  modified_base (161)..(161): a, c, t, g, unknown or other
  misc_feature (161)..(161): n is a, c, g, or t
  modified_base (170)..(170): a, c, t, g, unknown or other
  misc_feature (170)..(170): n is a, c, g, or t
  modified_base (174)..(174): a, c, t, g, unknown or other
  misc_feature (174)..(174): n is a, c, g, or t
  modified_base (199)..(199): a, c, t, g, unknown or other
  misc_feature (199)..(199): n is a, c, g, or t
  modified_base (224)..(224): a, c, t, g, unknown or other
  misc_feature (224)..(224): n is a, c, g, or t
  modified_base (231)..(231): a, c, t, g, unknown or other
  misc_feature (231)..(231): n is a, c, g, or t
  modified_base (277)..(277): a, c, t, g, unknown or other
  misc_feature (277)..(277): n is a, c, g, or t
  modified_base (534)..(534): a, c, t, g, unknown or other
  misc_feature (534)..(534): n is a, c, g, or t
tcagactgtacagtcacgaccggtgctcgatttagtacacgtgattagggattggggagctgtggtagagaagacaggattcaggacaatctccagcatggccggcctccctctcctcctcaccctctcactcactgtgcagggtcctgggcccagtctgngctgactcngccnccctcagtgtccgtacgggccccgnagcggtctcatctcttgtctgggancgacgcnccggtacgtcgtaaaattcgttactctaacgttcggtaccacgacncggtaccctaccgaaaccgggaaacccgacccccgtaagtccctttacccgacttacttaaccgtaaggtttaaccgggaaacttcgtaaccgttccggaacccgggtacccggttccccggttaaacgggtaccggtaccgttaacccgtcggtaaaccgttcgttcccgtttacgggtaccggtcgttaaaccggtacggttcccggtcggtccttcccgtacccgggttacccttcccggtcgttaaacccgtnttaccggtaccgggtaccggttacccgggttccgggtaaccggtaacgggtacggttacgggtacggttaccggttaacgttaacgtttaccgttaacggttcgttacggtacggtttacgggttacggttaccgtacgttccgtaacggtttccggtagggtaaccggttcgggttaccgggttcgggtacgggttaccggacgggtaccggtacggtcgtacggtccgtacgtaccggtacgtaccgaccggtaccgtacggtcccttaccggtcccgtggtacccttcccgg

SEQ ID NO: 83393 - DNA, 810 bp, Homo sapiens
  misc_feature: GYAE6OF02JVP7M.25.23.C01.1.454.CMB.1.raw
  modified_base (128)..(128): a, c, t, g, unknown or other
  misc_feature (128)..(128): n is a, c, g, or t
  modified_base (206)..(206): a, c, t, g, unknown or other
  misc_feature (206)..(206): n is a, c, g, or t
  modified_base (388)..(388): a, c, t, g, unknown or other
  misc_feature (388)..(388): n is a, c, g, or t
  modified_base (490)..(490): a, c, t, g, unknown or other
  misc_feature (490)..(490): n is a, c, g, or t
  modified_base (501)..(501): a, c, t, g, unknown or other
  misc_feature (501)..(501): n is a, c, g, or t
tcagactgtacagtcacgaccggtgctcgatttagtacacgtgattagggattggggagagaagacaggattcaggacaatctccagcatggccgcctcctctcctcctcaccctctcactcactgtncgagggtcctcgggcccagtcgtgcgtctcggactcgacgcccacctctacggttgtcgtaccggggacccccgggtnaggacggggtcctccacgttcttccgttggttccgtgggacgtccatccgttaccgacgtacggtaaactaagttcgtaccgtactcgggtaccagcctaagtcctaccggaaccggtaaccggtacccccagttccggtacctactaccgtagtaaccttaggaacttacgacttcggacnccgggtccgtaaacggtcgaccgttaacgaccggtaacgttaccttctaccgttcggtaccgtacgtaacggtcctacggggtaccctcggtcccgaccgtntccggtaccgntaacccgtcggtacggtcccgttacggaccgtaggtaccgtcggtaacgtcgtacgtaacttaccgacgttggtacggtacggttacgggttaccggtaaggtccgtacggtgttccgggagggtaccgttccggggttaacggtccgggttcgggggacggaaccggggttacggggaacccggtacggtacttacccggacgttcggtaccgggtaaccttacggggaaccctattacccgggtacccgtacccggtaaccccgggtctttaacccggttccccggttaccgttaccccgtccccgg

SEQ ID NO: 83394 - DNA, 768 bp, Homo sapiens
  misc_feature: GYAE6OF02HKG5X.25.23.C01.1.454.CMB.1.raw
  modified_base (210)..(210): a, c, t, g, unknown or other
  misc_feature (210)..(210): n is a, c, g, or t
  modified_base (579)..(579): a, c, t, g, unknown or other
  misc_feature (579)..(579): n is a, c, g, or t
  modified_base (722)..(722): a, c, t, g, unknown or other
  misc_feature (722)..(722): n is a, c, g, or t
tcagactgtacagtcacgaccggtgctcgatttagtacacgtgattagggattgggggagcttcagctgtggtagagaagacaggattcaggacaatctccagcatggccggcctccctctcctcctcaccctcctcactcactgtgcagggtcctgggcccagtctgtgctgactcagcccacctcagtgtccgtcgggacccccgggnaggacgggtcctaccgattccttcgttcgttaccgtaggggacgccgacgtccgtaccggacggtaacggtaaaatttaacggtttcgttacgtaaccgttcgggtaacccaggaccgacggtaccctaccccgaaacggtaaaacccccgggacccccaaggtcccttccctactacttaccgtaaggtaacggaattcggaacgttaccgaacgggccggtaccctcggaagggtactaccggtacgaacttcgtttctacggtcggtacgtaccggtaagttcgtcggtaccctcccggttccgggccctttaccggtacggtaccacgttccgtaacggggtcgggtacccgttcgggtaccggnggacgttcgggacgtacgttaaggttaacttacgtttacgtagggttgtaccggttgggttacgggtactccgggtacttcggttacgtaggttaccgggtcggtaccggtcgggttcggtcggggacggacggtacgacggngtaacccggtcgcgttagccgaacgccggacggtccgccctcccgg

SEQ ID NO: 83395 - DNA, 655 bp, Homo sapiens
  misc_feature: GYAE6OF02HRMMH.25.23.C01.1.454.CMB.1.raw
  modified_base (200)..(200): a, c, t, g, unknown or other
  misc_feature (200)..(200): n is a, c, g, or t
  modified_base (229)..(229): a, c, t, g, unknown or other
  misc_feature (229)..(229): n is a, c, g, or t
  modified_base (298)..(298): a, c, t, g, unknown or other
  misc_feature (298)..(298): n is a, c, g, or t
  modified_base (445)..(445): a, c, t, g, unknown or other
  misc_feature (445)..(445): n is a, c, g, or t
tcagactgtacagtcacgaccggtgctcgatttagtacacgtgattagggattggggagctgtggtagagaagacaggattcaggacaatctccagcatggccggcctccctctcctcctcaccctctcactcactgtgcagggtcctggcccagtactgtgcttgactcagccacctcagtcgtctcgggacccccggnaggaggtctccagtctcttgttctgggancagcctccgacgtcggaaattagttgtctactggtaccagcagctccaggaaccgcccccaagctcctnactctaataggaatgatcgacgccgccctgacggactacgtagacctagttctacgtcggacctcgaagttcgtcggtaccttccgtccggtccctcccgtggaccctagtcgaggtcggtccttccgggacgaggtacgtgacggntaggaaatgttacgtgtgtcgtaggtttacggacttcggaccgtacggttacgtcggtaaggtccgggtaccggtacggggttggtccgggtacgggtacgggacccgtaacggtccgtacggtacccggttcgtaaacgggttcccgaaacggtccccgtaaagggcccgttaacccgggtccccccggttacggtcccgttaacccgg

SEQ ID NO: 83396 - DNA, 755 bp, Homo sapiens
  misc_feature: GYAE6OF02JTVIQ.25.23.C01.1.454.CMB.1.raw
  modified_base (176)..(176): a, c, t, g, unknown or other
  misc_feature (176)..(176): n is a, c, g, or t
  modified_base (210)..(210): a, c, t, g, unknown or other
  misc_feature (210)..(210): n is a, c, g, or t
  modified_base (392)..(392): a, c, t, g, unknown or other
  misc_feature (392)..(392): n is a, c, g, or t
  modified_base (420)..(420): a, c, t, g, unknown or other
  misc_feature (420)..(420): n is a, c, g, or t
  modified_base (426)..(426): a, c, t, g, unknown or other
  misc_feature (426)..(426): n is a, c, g, or t
  modified_base (434)..(434): a, c, t, g, unknown or other
  misc_feature (434)..(434): n is a, c, g, or t
tcagactgtacagtcacgaccggtgctcgatttagtacacgtgattagggattggggagctgtggtagagaagacaggattcaggacaatctccagcatgccggcctccctctcctcctcaccctcctcactcgactgtgccagggtccctgggccctagtcctggtgctgactcngcccacctcagtcgtccgtccgggacccccgganaggacggtcctccgatcctcgttagttcgtcggggaccgtacgtccctacggaccgtaacggtaaagttacgtttggtcctacgttacggaccagtcctaagccctaacccgaaggaacccgtcccccaaggtccctacctacgaactccgtaattagaacgtgaactcgacgtccgtaccngtacggacttccacggtacgtacttcgngccgtntaaccggngtcgtcggccctcgtacggtccctacccgtgaccctacgtagtcggtccgtaccggtaccggtcgaaccgtgtacggtactacgtacgtattaacgttcgtcggtgtacggttacggttggaacgtcggtaccgttacgtccggttaggtccgggtacggttacccggttacggggtacggttacggggtaccgggtacgggtaacccgtggttacccggttaacccgggtaccgttaacccggtcggtaacccgaacggtaccccggttcggtaaaccccgtcccccggttaaccccggtaccggttccgttaaccccgg

SEQ ID NO: 83397 - DNA, 753 bp, Homo sapiens
  misc_feature: GYAE6OF02GWFP3.25.23.C01.1.454.CMB.1.raw
  modified_base (230)..(230): a, c, t, g, unknown or other
  misc_feature (230)..(230): n is a, c, g, or t
tcagactgtacagtcacgaccggtgctcgatttagtacacgtgattagggattggggagcttcagctgtggtagagaagacaggattcaggacaatctctagcatggccggcctccctctcctcctcaccctcctcactcactgtgcagggtcctgggccaggtctgtgctgactcgagcccaccctcagtgtctcgggacccccgggcgagacgggtctccgatccgtnttgttcgtgggagcagcctccgagtacggtaaattaagtttgtactacgtaggtaaccagactagcctaccaagaaaccccggaccccaacgccgtacctacactacctaataaggaatgactacgacgccgtaccgagacggtatacctacgaccgtatttctagcgtctacggtaagtcgtacgcctaccgtccggtcccttcccgtacgtacctacgtaccggtacgggtacggggtacccgttaccccgggtacggaacgggtacgttaacgggtacggtaaccggttaagtaaacgtttacgtttaacggttacggttacggtaaccggtttacgggtttacgggacgttccggtaaccgtacggttacgtacgggttaggttccgggttaaccgggtcggggttaccggttccggggaacgggtaccgggaaccggtacggtaacggtccgttaacccggttacggtacgtacccgtaacggtacccgtaacggttcccggtacccgttacccccgg

SEQ ID NO: 83398 - DNA, 730 bp, Homo sapiens
  misc_feature: GYAE6OF02IHH73.25.23.C01.1.454.CMB.1.raw
  modified_base (171)..(171): a, c, t, g, unknown or other
  misc_feature (171)..(171): n is a, c, g, or t
  modified_base (191)..(191): a, c, t, g, unknown or other
  misc_feature (191)..(191): n is a, c, g, or t
  modified_base (194)..(194): a, c, t, g, unknown or other
  misc_feature (194)..(194): n is a, c, g, or t
  modified_base (218)..(218): a, c, t, g, unknown or other
  misc_feature (218)..(218): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcaggtcctgggcccagtctgtgctgactcacgccaccctnagtgtcgtcgggaccccggnagnggtctccatctcttgttcgtggancgagcctccgacgtacggtaaattaagttgtctacgtcggtaccagcagcctcccgaagaaacccgccccaagcctcctacatactagtagattgactgtacgccggcccttagacgggtactaacccgtcgaaccggttacttccgtcgttacgccgtaccgtaagtcgtacggccttcccggtaccgtcccgtcccgtcgggtaccctacgtccggtaacggtcggggtccctacccggggcgtaagggtaactcggggtaacggacttaggtaaactttagttaccttgggaccggttcgttagggtttacggtaacgtcgtaccgttaggtcggttacgggtcggttaccgggtccggtagggtaccggttcggggaccgggtagggaaccaacggttaccgtcggtacccggttccggtaggaaccgacccggtaaccgacccgggtcctacccgggtcccccttggttaccctaaccggtttccctcccgtttaccccctaccccg

SEQ ID NO: 83399 - DNA, 662 bp, Homo sapiens
  misc_feature: GYAE6OF02HXFPG.25.23.C01.1.454.CMB.1.raw
  modified_base (205)..(205): a, c, t, g, unknown or other
  misc_feature (205)..(205): n is a, c, g, or t
  modified_base (209)..(209): a, c, t, g, unknown or other
  misc_feature (209)..(209): n is a, c, g, or t
  modified_base (216)..(216): a, c, t, g, unknown or other
  misc_feature (216)..(216): n is a, c, g, or t
  modified_base (232)..(232): a, c, t, g, unknown or other
  misc_feature (232)..(232): n is a, c, g, or t
  modified_base (257)..(257): a, c, t, g, unknown or other
  misc_feature (257)..(257): n is a, c, g, or t
  modified_base (264)..(264): a, c, t, g, unknown or other
  misc_feature (264)..(264): n is a, c, g, or t
  modified_base (538)..(538): a, c, t, g, unknown or other
  misc_feature (538)..(538): n is a, c, g, or t
  modified_base (630)..(630): a, c, t, g, unknown or other
  misc_feature (630)..(630): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcgaggtcctcgggcccagtcgtgtgctgactcacgcctccctcagtgttccgcgggacccccggnaggnggtctcntctgttgttcgtggancagctacgacgtacgaaattagttnacgtacncggtacagcacgcctaccgaacggaacccggccccctaagctcctacactactagtaggaactgactccgagccgccctagacggtacttaccgcggaaccttactccgttcgtcggtacctaggtaacgttgtccggtaccttcccgtcccgggtaccccttcggttcccggaacctttgtccggtcgggccggtacctcccggggtacgaagttcgaaggtccgtagttacgtaattcgttatcggtagtacggtggttagacgtcgtacgngtcgtgtaccggttcggaaccgggtggtcggtaccgggaccgggtacggacgttcgcggtacccgggtacgtcggtagtcccgacggaccgnggtcccgttccccgaccgttcggtaccttccg

SEQ ID NO: 83400 - DNA, 706 bp, Homo sapiens
  misc_feature: GYAE6OF02JXZUP.25.23.C01.1.454.CMB.1.raw
  modified_base (237)..(237): a, c, t, g, unknown or other
  misc_feature (237)..(237): n is a, c, g, or t
  modified_base (296)..(296): a, c, t, g, unknown or other
  misc_feature (296)..(296): n is a, c, g, or t
  modified_base (523)..(523): a, c, t, g, unknown or other
  misc_feature (523)..(523): n is a, c, g, or t
  modified_base (542)..(542): a, c, t, g, unknown or other
  misc_feature (542)..(542): n is a, c, g, or t
  modified_base (563)..(563): a, c, t, g, unknown or other
  misc_feature (563)..(563): n is a, c, g, or t
  modified_base (567)..(567): a, c, t, g, unknown or other
  misc_feature (567)..(567): n is a, c, g, or t
tcagactgtacagtcacgaccggtgctcgatttagtacacgtgattagggattggggagagaagacaggattcaggacaatctccagcatggccggcctccctctcctcctcaccctcctccactcactcgtgcagggtcctgggccctagtctgtgctgactcagcccaccctcagtgtccgtaccgggacccccgggcaggacgggtctccacttcttcttcggttcgagggacncacggtccgtccggtaacggtaacggtaaagttaacgttcgttactacgtcgtaaccgngcacgtccaccgaaaccggaaaccccgcccgaacgtcctacctacctacgttacgtaagtaaggtaatcgataccggacgtacccggtcctacggaaccggtacgtaccgacgtaactcctttccgcgtaccggtctaacggtaccgtcgtccgcccggtccgtccccgtcccttaacggtccaccttcgtaggaccggtccgggtccgtccggtacggacgtaggngtacgtgtagtatacttgngtcgtagtggttggatacggntcgngtcggtcggtccgggacggttacggtcgggtacgggcggacgacgtacgacggtaccctcgtaccgtcggacgtaaccgaccggcgtacccgcccggttacccgtaccggtctaccggttcccgaccgttcccgacccg

SEQ ID NO: 83401 - DNA, 995 bp, Homo sapiens
  misc_feature: GYAE6OF02H158P.25.23.C01.1.454.CMB.1.raw
  modified_base (227)..(227): a, c, t, g, unknown or other
  misc_feature (227)..(227): n is a, c, g, or t
tcagactgtacagtcacgaccggtgctcgatttagtacacgtgattagggattggggagctgtggtagagaagacaggattcaggacaatctccagcatggccggcctcctctcctcctcaccctctccactcactgtcgcacgggtcctcgggcccagtcctggtcgcgtcgaccttcgacgcccacccctcgacggttcgtccgtacgggggaccccccccgggnaacggggtacggggtaccctcccggtaacttccgttctttccgggtttcggtaacgggggagtccgaaggtccgtaaccccggtaggtaccgggtaaaaattttagggttttcgtaaccgtttacctacggggttaaccaaacggtccgaacggtcccgtaaccccaacgggtaaaaccccgggaccccccgtaaaacggtccccttaccgtaccgtactacgttaaacgtaaacgggtaactacggtaactaaccggacggtcccgggtacccgtaacgggtacggtaaaccgttaacccgtacccgggtaaacgttaccgtttaccctccggggttacggtacccggttaaacgtaacccgggtttcgttaacggggtcccggtttacccgtcccggtttaaacccccgtccgtttacggaaccccgttttcgaccgtacggggttacccgggtcccggttaccccggggttaccggtaaccgggtaacggttcggaacggggtacgttacggtaaagttaaaccgttaccgttagggtaccggtcggttaaggtttcgggtaaacgggttccgaaccggttacggttacgttacgtccggggttaccgggttaaccgggttcggggttggttacccgggtacggggtaaccgggtaacgaccgggtttaacggaccgggttaacccggttacggtaccggtaaccggtccggtaaccccggacgggtcccggtaacccggtccccggttacccggctaccccggg

SEQ ID NO: 83402 - DNA, 699 bp, Homo sapiens
  misc_feature: GYAE6OF02HR37W.25.23.C01.1.454.CMB.1.raw
  modified_base (239)..(239): a, c, t, g, unknown or other
  misc_feature (239)..(239): n is a, c, g, or t
  modified_base (370)..(370): a, c, t, g, unknown or other
  misc_feature (370)..(370): n is a, c, g, or t
  modified_base (380)..(380): a, c, t, g, unknown or other
  misc_feature (380)..(380): n is a, c, g, or t
tcagactgtacagtcacgaccggtgctcgatttagtacacgtgattagggattgggggagctgtggtagagaagacaggattcaggacaatctccagcatggccggcctccctctccctcctcaccctcctcactcactgtgcagggtcctgggcccagtctgtgctgactcgagccaccctcagtcgtcgtcggggacccccgggcaggagggtcctccatcttcttgttcgtgggancagcctccggacgtacggaaattaagtttgtcttaacgtggtaaccagacagcctacccgaacgaaaaccccggtacccccaagcctcctacactctagtaaggatgatcgagcgcctcgaaggactaccngacgtattcncgtgactcgagtcgtcgtctccgtcgtcccttccgcgtccagtcgtacggtcgggtccgtcccgggtacggacgggtagcgggtacgggtcgtaagttaaacgttaagtttacgttaggtcgttcggttaagggtttacgggtaacggtcgtaccgttaggttcggtagggttcgggttcggttaccggggttacgggttcgggttacggggaccggggacgggaccggtaaggtccgtaacggtcccggtaacggtccggtaacggaccgacccgaccggtcccgtacccggtccccggttacggtacccttacccgg

SEQ ID NO: 83403 - DNA, 649 bp, Homo sapiens
  misc_feature: GYAE6OF02F5AI1.25.23.C01.1.454.CMB.1.raw
  modified_base (206)..(206): a, c, t, g, unknown or other
  misc_feature (206)..(206): n is a, c, g, or t
  modified_base (234)..(234): a, c, t, g, unknown or other
  misc_feature (234)..(234): n is a, c, g, or t
  modified_base (307)..(307): a, c, t, g, unknown or other
  misc_feature (307)..(307): n is a, c, g, or t
  modified_base (347)..(347): a, c, t, g, unknown or other
  misc_feature (347)..(347): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccggnaggagggtctccatctcttgtctgggancagctccgacgtcggaaattagttgactacgtggtaccagcagcctccgaagaaccggccccaagcctccgtnatcctatacggatgatcagccggccctgaggtactaccgnggaaccgtatttctcggtcggcctacggaacgttcgtcgggcccttacccggccggtccccttaacccgtcgggaccctaagttccggacgggttcgggtcccgttcccgggtaccggaaggtacgtcggacggtcgttagtaattacgtttactggtcgtacgtaggtttcgggatttcggacgtagttcgtaggacgttcggtccgtcgggttgtccgggacggaacgggtaccaaggtccgtacggacccgttacgtacggtccaaccggtccaacgggtcccgtacccgtacccccgg

SEQ ID NO: 83404 - DNA, 691 bp, Homo sapiens
  misc_feature: GYAE6OF02IGXRY.25.23.C01.1.454.CMB.1.raw
  modified_base (199)..(199): a, c, t, g, unknown or other
  misc_feature (199)..(199): n is a, c, g, or t
  modified_base (230)..(230): a, c, t, g, unknown or other
  misc_feature (230)..(230): n is a, c, g, or t
  modified_base (334)..(334): a, c, t, g, unknown or other
  misc_feature (334)..(334): n is a, c, g, or t
  modified_base (340)..(340): a, c, t, g, unknown or other
  misc_feature (340)..(340): n is a, c, g, or t
  modified_base (344)..(344): a, c, t, g, unknown or other
  misc_feature (344)..(344): n is a, c, g, or t
tcagactgtacagtcacgaccggtgctcgatttagtacacgtgattagggattggggagagaagacaggattcaggacaatctccagccaatggccggcctccctctcctcctcaccctcctcactcactgtgacagggtcctagggccctagtctgtgctgactcagccacctcagtgtcgtcggggaccccccgggnacggacggtcctccattctcttgtctagggncagcctccgacgtacggaaattagttgctacgtggtaccagcagctaccgagaaccggccccagcctctcatctatggatgatcgagccgcctagaggactacngacctnttcngtcggctacgagttccgtggtcctaccgtccggaccctcccgtcggacctagtccgaggttcgggcccgtccggtacgaggtcgtggacgtcgtaggtaaccttagttaacccgttgtacggttccgttagggttttacggataccggttacgagtccggtagggtaaccggttaccgggtaccggtaacggggtttcggtaaccggggtccgggtaacggggtaacgaaccgggccttaccgggtacccgtccggttacggtaccgacccggtaccgtaacggtcccgttacccggttcccccgtccggttcctacccggttcgtttcccgtccccccggtacccg

SEQ ID NO: 83405 - DNA, 835 bp, Homo sapiens
  misc_feature: GYAE6OF02HR8ND.25.23.C01.1.454.CMB.1.raw
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtcctgtgcgtgactcagccaccctcagtgtcgtcgggaccccgggcaggacgggtcctccgacttccttcgttacggttcgtacggggtacacgtaacggccgttaccggtaacggttaaccgggttaaaagttttaacggtttttacggttccgttaaccggttaccgggttaacccgaaacggtccgtaaccggtaccccgtaaccccgtaaaaccgggtaaaacccccgggcccccccgtaaaaggttacccccttcccgtacccgtaaccgtttaaccgtaaacggtttaacgggaaacgttacgtacgttaccggacgggtccccggtacccgttaacggacgggtaccttaccgtacggtaaccgtactttccgtcggtaccggtcgtaacgtcgttccgtacggtccgttcccgtcgccccgtttacgccggacctacgttccggtaacggttccgggtcccgtttcccggggtacgacggttacggtcggaacgtcgtaggtaaactttacggttcgtacgtgttaaccgttggttggtactcggttaccgcggttctagggtacgtcggtaccgtacgggtgttccgggaacggtacgtacgacggttcgacgtaccggttcgtacgcgaccgtacgcgtaccggttcccggccgttagtcccgtaccg

SEQ ID NO: 83406 - DNA, 912 bp, Homo sapiens
  misc_feature: GYAE6OF02HQVNW.25.23.C01.1.454.CMB.1.raw
  modified_base (218)..(218): a, c, t, g, unknown or other
  misc_feature (218)..(218): n is a, c, g, or t
tcagactgtacagtcacgaccggtgctcgatttagtacacgtgattagggattgggggagctgtggtagagaagacaggattcaggacaatctccagcatggccgcctccctctcctcctcaccctctcactcactgtgcacgggtcctcgggcccctaggtctgtgaccttggacctcacgcccaccctcaggtcgtccgtccggggacccccgggnacgggtagggttcctccgacttccttacgtttaccggttcgtaggggacctacgaccggtccttaccggtaaccggtaacgggtaaactttaaggtttcgtacctaccgttacggtaccacgacgtacgtaccctacccggaaccgaaaccccggtaccccctaagtcccttaaccctcctaacgttaaccgtaacggttaacgggtaaactacggtaaccgttacggaccggtccccgggttaacccctaacggaacgggttaaccgtaccccgttaacggggtacccctttaacgttccgttccggtaccggtaccgttaacggggttaaaccgttcccgttacggggtaccccttccggttaccccgggtcccccttaccgtccggggtaacctacggtacggtaacgggtcccgggtaacccgttcccgggtacggaaggttcggaacggtactccggtaagttaagttaccgttacggtcgttacgggttacgtagggtttacggtcggttacgtacccgtaggttcgtaggtaccggtacgggtaccgtacgggttccggtacgggacgggtaaccggacctacggtcccggaaccggtttcccggtaacggtccgggtaaccgtacccggaacccggttaggacccccggtccccccgtttaaccgtccgggttaacccgtccccgg

SEQ ID NO: 83407 - DNA, 846 bp, Homo sapiens
  misc_feature: GYAE6OF02GP4JX.25.23.C01.1.454.CMB.1.raw
  modified_base (225)..(225): a, c, t, g, unknown or other
  misc_feature (225)..(225): n is a, c, g, or t
tcagactgtacagtcacgaccggtgctcgatttagtacacgtgattagggattgggggagagaagacaggattcaggacaatctccagcatggccggcctccctctcctcctcaccctcctcactcactgtgcagggtcctgggcccagtctgtgctgactcacgccaccctcagtgtcgtccggggacccccggcgaggacgggtctccatccttcttgttcgngggacgtcacgtccgtaccgacggtacggtaaaacttaagtttcgtactacgtcggtaccagcacgcctacccgaacggaaaacccggcccccaagtcctaccctcgtacttcgtaagtaacggtaatggtaactacgacggccggtcccgtacgaagggtacctaccgaccggtaacccgttactttccgtaccgttcggaccggtttacggaaacggttccggtcgggtccttcccggtcccgggtccccttcccggtcgggacccttacggtccgtacggggttccgggcccggttacccggggtaccggtagggtaacgttcgggaacgggtaccgtaaggttaaagtttaacgtacggtttacggtcgttacggttagggtttcgggagttaccggtccgtaaggttttccgggaaggttaccggggttccgggtaccgggttacggggtttccgggttacggggaaccgggtaacggggtaccaacggggttccgttaaccgggtacccgttccggttacgggtcccgaaccggttacccggaacggttcccggtcccgttacccccggttggttacccgcccgtttacccgttccccggttcccgtaacccccg

SEQ ID NO: 83408 - DNA, 548 bp, Homo sapiens
  misc_feature: GYAE6OF02F6RLW.25.23.C01.1.454.CMB.1.raw
  modified_base (181)..(181): a, c, t, g, unknown or other
  misc_feature (181)..(181): n is a, c, g, or t
  modified_base (201)..(201): a, c, t, g, unknown or other
  misc_feature (201)..(201): n is a, c, g, or t
  modified_base (229)..(229): a, c, t, g, unknown or other
  misc_feature (229)..(229): n is a, c, g, or t
  modified_base (353)..(353): a, c, t, g, unknown or other
  misc_feature (353)..(353): n is a, c, g, or t
tcagactgtacagtcacgaccggtgctcgatttagtacacgtgattagggagttggggagctgtggtagagaagacaggattcaggacaatctccagcatggccggcctccctctcctcctcaccctcctcactcactgtgcagggtcctgggcccagtctgtgctgactcagccaccctnagtgtctgggacccccgggnagagggtctccatctcttgttctgggancagctccgacgtcggaaaataagtttgctactggtaccagcagctccagaaacgccccaagctctcatctataggaatgatcagcggcctcagggatacctgaccgattctctgctcgaagtcnggctccgtcggcctcctggccatcagtggctccggtccgaggactggaggctagaaattattactgtgctagtttgggatggacctagtctagagtcggtaccgacggtggttcggacgggtacgggaccaagcgtcggacccgttacgtacggtccaggcccgaaggcctacggcccccgttaggtcctaaccg

SEQ ID NO: 83409 - DNA, 947 bp, Homo sapiens
  misc_feature: GYAE6OF02GOHNF.25.23.C01.1.454.CMB.1.raw
  modified_base (192)..(192): a, c, t, g, unknown or other
  misc_feature (192)..(192): n is a, c, g, or t
tcagactgtacagtcacgaccggtgctcgatttagtacacgtgattagggattgggggagcttcagctgtggtagagaagacaggattcaggacaatctccagcatggccgcctccctctcctcctccaccctcctcactcactgtacgcgtacggtccgtacgggccctagtcgtgtcgcttgactacgcncccaaccctgagttcgtaccggtacccgggggacccccgggagaacgggtacgggtccctacctaacgttccgttccgtttagttcggacggggacacgtacgtccggtacccgtaacggttaacggtaaacgtttacgttttccgacgttaacggttaccggaaccgtacgtaccgtaaccgtcccgtaaacccggaaacggtaaaacccccgggacccctaagtcccgtacctactaaccgtttaaccgttaaagggtaaacgtaacgttaccgaaccgttaccggacccggggaccccggtttaccaacgggttaaaccggtaccgttaaccggtacccggtaacgttactttcggcccggttacgtacgttaacgttacggtcgtaccggttcccgtaacccgtcccggttccctacggtaccgtacgtaccgtacgggtcccgggtttccgggtaccggtaccccgggtagtaccgggttagtacccgggtaacgtaccgttaaagtttaacttacggttccgttacgggtactttaaacggggttgggttaccgggaccttaacccgggtacgtttacggtccggttaaccggggttaaaccggtcggtaaccgggggttacgttttaaccgggggacccggggaacggttaacccggaaacggttccgggaccggttaaccgtaaacccgggtttcggaacgttcccggaaccgtttaccgggacccggttcggaacccccttccggg

SEQ ID NO: 83410 - DNA, 728 bp, Homo sapiens
  misc_feature: GYAE6OF02JTZYY.25.23.C01.1.454.CMB.1.raw
  modified_base (222)..(222): a, c, t, g, unknown or other
  misc_feature (222)..(222): n is a, c, g, or t
  modified_base (241)..(241): a, c, t, g, unknown or other
  misc_feature (241)..(241): n is a, c, g, or t
  modified_base (341)..(341): a, c, t, g, unknown or other
  misc_feature (341)..(341): n is a, c, g, or t
  modified_base (388)..(388): a, c, t, g, unknown or other
  misc_feature (388)..(388): n is a, c, g, or t
  modified_base (498)..(498): a, c, t, g, unknown or other
  misc_feature (498)..(498): n is a, c, g, or t
tcagactgtacagtcacgaccggtgctcgatttagtacacgtgattagggattgggggagcttcagctgtggtagagaagacaggattcaggacaatctccagcatggccgcctccctctcctcctccaccctcctcactcactgtgcgacgggttccgtgggacccagttcctgtgctgacctcacgccaccctcaggttcgtcgtccgggacccccgggnacggtacgggtcctaccgntttccttcgttttcggttcggtacggggacgtccgtacgtcccgtaccggtaacggtacggttaaaactttacggtttcggttacctacggtcggtaacncgactacggtccctacccgaacggaacccgtccccaagtccctaccnctactcgtaagtagaactgacgtcgacgcccgtcgacgacgtactacgtactacgtcttcgtcgtcgtacgtagtctacgtccgtcctccgtcccgtcctccgtacgtcncgtacgtcggcggtcccgtcggacgtacggtaggtacgcgtaacgtcgttaatcgtacctggtacgtaccggttgttacgacgtttcgacgttaccggttcgtaacgggtcgtccgggttcgggttacgggtccggtacgggtaccggtacgggtaccgacgtcgggtaacccgttcggtaccggtcgaccgttacccgggaccgtacgggccccttaccccggtcccgg

SEQ ID NO: 83411 - DNA, 731 bp, Homo sapiens
  misc_feature: GYAE6OF02GVQDN.25.23.C01.1.454.CMB.1.raw
tcagactgtacagtcacgaccggtgctcgatttagtacacgtgattagggattggggcagcttcagctgtggtagagaagacaggattcaggacaatctccagcatggccggcctccctctcctcctcaccctcctcactcactgtgcagggtcctgggcccagtctgtgctgactcagccaccctcagtgtcgtcggggacccccgggcaggacgggtcctccgattcctcgtttcgttcgtgggagcacgcctccggacggtacgtaaaagttaagtttcgtcttacgtcggtaaccagcagcctaccgaacgaaacccggcccccaagcctcctcactactaagtaaggtaactagactacgacggtcccggtaccctcgaacgggtactaccgacggtaaccgtacttccgtcgtcggtcgtacgtacgtcgtcgtccgtaccgtccgtacccgtccgacgtacctcgtacgtacggtccgggtcccgtaccgggtccggtaacggtaacgtcgggtacggtagtacggttaagttacgtttaacgtcggtacgttacggttcgggttacggtcgtaccgtactacggttcggtaggtacggttccgggttccgggtacgggttcgggttaccgggacggggtaaccggtaccggtaacggtaccgtaccggttacccggttaccggtacggttaccgaccggtacccggaccggtaccgtccccgg

SEQ ID NO: 83412 - DNA, 896 bp, Homo sapiens
  misc_feature: GYAE6OF02IJND0.25.23.C01.1.454.CMB.1.raw
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcacgcccaccctcagttcgtccgtccggggacccccgggctagggacgggtcctccgagtccttcgtttggtttaccgtggggacgtcgacggtccgttacccggacggttacgggtaaaaacttaaggttttcgtaccttaacgtcgggttaaccaggcctacgccctacccgaaacggaaacccgggccccctaaaggcccttcccgtacctaacttaccgtaacgtaagggtaacttagacgtaccgacggacccgggtccccttacggacgggtaacttacccgtagaacccggttattccgtcgtacggtaccgttacggaacgttccgtacgggtcccttaccggtcccggtccctacccggtcgacccgtacgttccgacggggttcccggggtcccgttacccgggggtaccggtaacgggtaacgttcggggaacggttaccgtacggtttaaacgttaccgtttacggtaggtaccggttaggtttaccggggtttggacgttccggaccgttacggtccggttgggaacccgggttacgggtacccggttaacgggttccgggttacgggaaccgggggtaccgggaaacgtaaccggttcggttaacccggccggtttaaccggtcggtaccgacccgggtacccgaaccggttcccgtaacccccggttcccggttaccggtacccgtaccgtttccggttccccggtacccccggtaccccg

SEQ ID NO: 83413 - DNA, 855 bp, Homo sapiens
  misc_feature: GYAE6OF02JEWLX.25.23.C01.1.454.CMB.1.raw
  modified_base (222)..(222): a, c, t, g, unknown or other
  misc_feature (222)..(222): n is a, c, g, or t
tcagactgtacagtcacgaccggtgctcgatttagtacacgtgattagggattggggcagcttcagctgtggtagagaagacaggattcaggacaatctccagcatcggccggcctccctctcctcctcaccctcctcactctactgtgcacgggtccgtcgggcccagtctgtgctagactcacgaccaccctcagtcggtccgtccgggacccccggganacggacggttcctccgacttcttcgtttcgttaccggtaggacggcctaacggtcctaacccgggaacgtaacggtaaaattaacgtttcgttacgtaccgttacgggtaccaagtaccaacggtacccgtaacccggaaacggaaaaaccccgggtacccccgaaacggtaccctccttaccgaaacttcccgtaaaggttaaacggagtaaccgttagaacggaaccggtccgtacccccgtaggtaacgggttaacctaaccgtacgaacccgtttaattccttacggtcggtaaccgtacggttaaaggtccgttacgggtacccctttccggttaaccccgggtaccccttttcccggacccggttaccgtaaccggttaccggtaacggggttaccgggttaccgttaccccggggtacggtaacgggtaggtacggtacgtaccgtttaaaggtaagttaaactcggtacgttacgggttacgtggtttaaggacgttaccgtacgtacgttcgggtacgtacggtccggtacgggtacgggttgtaccggggtacgggaaccgtaaacgccggtaacggttcgtaaccgttcggagaacccgtacgtacgtacggtccgtacccg

SEQ ID NO: 83414 - DNA, 742 bp, Homo sapiens
  misc_feature: GYAE6OF02F0EGN.25.23.C01.1.454.CMB.1.raw
  modified_base (201)..(201): a, c, t, g, unknown or other
  misc_feature (201)..(201): n is a, c, g, or t
  modified_base (293)..(293): a, c, t, g, unknown or other
  misc_feature (293)..(293): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtcgtcgggacccccggnagacgggtctccattctctttgttctgggagcagctccgacgtggaaattagtttgctatgtaccagcagctccagaaccgccccaagctcncatctataggatgatcagccgcctgacgggatacgtcgaccgtattctcgtcggctacggtaacgttcgtcggtccctccggtaccgtccccgttcccgtcgggtaccctacgtccggtacgggtcgggtcccgttccccggggttacccgggtaagggtaacgtcgggtaacgggtaccttaaggttaaacttaaccgtttaagtcggttcggttacggttagggttttaggggtaacttcgggacccgttaggttccgtgggttaaggttcggggtacccggttagggttcgggtttacgggggaccggggtaacgggtacccggaacgtccggttaaccggggtacccgttaccggtaaggggtttacccgacccgggtaccccggtaaaccgggtccccgggttccccgggtacccccggtttccggggtaacccttaccccggg

SEQ ID NO: 83415 - DNA, 778 bp, Homo sapiens
  misc_feature: GYAE6OF02JOFZN.25.23.C01.1.454.CMB.1.raw
  modified_base (106)..(106): a, c, t, g, unknown or other
  misc_feature (106)..(106): n is a, c, g, or t
  modified_base (178)..(178): a, c, t, g, unknown or other
  misc_feature (178)..(178): n is a, c, g, or t
  modified_base (189)..(189): a, c, t, g, unknown or other
  misc_feature (189)..(189): n is a, c, g, or t
  modified_base (201)..(201): a, c, t, g, unknown or other
  misc_feature (201)..(201): n is a, c, g, or t
  modified_base (206)..(206): a, c, t, g, unknown or other
  misc_feature (206)..(206): n is a, c, g, or t
  modified_base (227)..(227): a, c, t, g, unknown or other
  misc_feature (227)..(227): n is a, c, g, or t
  modified_base (381)..(381): a, c, t, g, unknown or other
  misc_feature (381)..(381): n is a, c, g, or t
  modified_base (407)..(407): a, c, t, g, unknown or other
  misc_feature (407)..(407): n is a, c, g, or t
tcagactgtacagtcacgaccggtgctcgatttagtacacgtgattagggagttgggggagcttcagctgtggtagagaagacaggattcaggacaatctccagcntcggccgcctccctctccctcctccaccctcctcactcactcgtgcagggtcctcgggccctaggtctgtcncctgaacctcncgtcccaccctntcgtntccgtaccggggacccccggngacggtacgggtcctcctagttctttccttaggttaccgtagggaagcctacggtccgtacccggtaacggtacggtaaaacttaaggtttggtccttaaacgtcggtacccagccgaagtccctccgaaacgaccggtacccaacgtccttcncgtactactagtacggtaacacgtcncgaacgccgtccgcgaggacctaacgtgaaccgttacgtttccacgttcgtacccgtaacggcgtttcccgtacgttccccgtaccggttcccccggtcccgtttcccgtaacgggtccccttaggaaccgtttacggggtcccggttacccgtacccgggttcgggaacgtcggttacggacgttacgtacgtttaagttactccggttacgtgtaccgggttagttcgggtacctacccgggtcgtaccggttcgcggttaacgggtccggttaccggtcgggttaacggccgggtaacggcggaaaccgtcggtactcccggtaccgtccgtacgggactaccggactccggtccggtacctcccggg

SEQ ID NO: 83416 - DNA, 734 bp, Homo sapiens
  misc_feature: GYAE6OF02G4RU9.25.23.C01.1.454.CMB.1.raw
  modified_base (304)..(304): a, c, t, g, unknown or other
  misc_feature (304)..(304): n is a, c, g, or t
  modified_base (618)..(618): a, c, t, g, unknown or other
  misc_feature (618)..(618): n is a, c, g, or t
tcagactgtacagtcacgaccggtgctcgatttagtacacgtgattagggattggggagagaagacaggattcaggacaatctccagcatggccggcctccctctcctcctcacccctcctcactcactgtgcagggtcctgggcccagtctgtgctgactcacgccaccctcagtgtctcgggacccccgggcaggacgggtctccatctcttgttcgtgggagcagcgtccgacgtacggtaaatagtttgtctacgtggtaccagcacgcctaccgaacgaacccggaccccaagcctccnctatactagtaaggatgactcgacggcccggccgtacgacggtactaccgtacgacctattccgtcgtcgtctacggaacgttcgtcggtcctttccgttccggtacccttccggtcgtaccacgtccgtagggtccgggtccggttcccgggtacggtaagggcttcgggacggtacgttaagtaaactttgttaaccgttggtcggtacggttgggtttacgggacttccgggaccgttaggtcggttaacgggtcggttcggggttaccggtacgggtttcgggtaccgggggacggtaaccggggtaacncggtttaccgtaccggtaccgttaccggtaccggtaaccggtaccggacccggtacggtccctaccccggtcccgttacggtacctcccggttccgttacccgttccccctaccgg

SEQ ID NO: 83417 - DNA, 740 bp, Homo sapiens
  misc_feature: GYAE6OF02GLD8X.25.23.C01.1.454.CMB.1.raw
  modified_base (215)..(215): a, c, t, g, unknown or other
  misc_feature (215)..(215): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtcgcagggtcctgggcccagttctgtgctgacctcagcccaccctcagtcgtcgtcggggaccccccgggnaggacgggtcctccgattcctcttgttccgtgggactcagtcctccggacgtacggaaattagttcgtccttacgtggtaccagtcacgtccctaccgaaacggaaccccggacccccaagtccctccctactacttacgtaagtaacggaatcggactaccggacggcccggtacccctaggacgggtaactacccgtacgaccgtactttcctcgtcggctacgtaacgtcgtcgtaccttcccgtccggtccctccgtcggacctagtaccgtagggtccggtacccgtacccgggtccgacggtacggtacgggtacgtacgtaacggtaattacgttacgttcgtacgtacggttagggtttacggtacgttccgtcgtaagttacggtaggttcggtaccgggttacggtaccgggttcggtacggggtacgggaaccgggtacgacggtacccggtccggtacccgttcgttaacggccggttaacccgcgggtaaccgtcgtcccccggtaccccgg

SEQ ID NO: 83418 - DNA, 891 bp, Homo sapiens
  misc_feature: GYAE6OF02HTY6I.25.23.C01.1.454.CMB.1.raw
  modified_base (219)..(219): a, c, t, g, unknown or other
  misc_feature (219)..(219): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcaggtcctgggcccagtctgtcgtctgactcacgccctaccctcaggttgtccgtccgggggaccccccgggnaacggtagggtccctaccaacgttcctttccgtttggttaccgtgggggaactcgacgtccggttcccgaacggttacggtaaaaatttaggttttccgtaccgtacgttacggtaaccgaggaccaggtacccctacccggaaacggaaaccccgggtcccccaacggtccctaccgtctaactacgttaagaagtaatcggtaactccgacgggcccgtcctaggaaccggtactacccgtggacccgttatttcctcggtccggtacttaccgggaagttccggtaccgtcccttacccggtccgggttcccctacccggttacgaccgtacgttaccggtaaccggggttcccgggacccggttacccggggtaccggtaagggaccggtttacgggaaccgggtcgttaaagtttaaaccgttaccttttaacgggtcgtttacggtaccggtttagggggtttacgaaggttccggtaccttagggttaccgtttacgggtacgggtaccggttaaccggttacggggttcgggtaccggggtaacgggtacccggtaaacggtaacccggggcctttaacccggggaaccccgttcgggttaacgggtccccggaaccggttaaccccggaaacgggttcccctacccggggtttacccccccgg

SEQ ID NO: 83419 - DNA, 775 bp, Homo sapiens
  misc_feature: GYAE6OF02I4QGV.25.23.C01.1.454.CMB.1.raw
  modified_base (120)..(120): a, c, t, g, unknown or other
  misc_feature (120)..(120): n is a, c, g, or t
tcagactgtacagtcacgaccggtgctcgatttagtacacgtgattagggattggggagcttcagctgtggtagagaagacaggattcaggacaatctccagcatggccggcctccctcncctcctcaccctcctcactcactgtcgcgacgggttccgcgggccccagtcctggtcgctgacctcgacgcccctaccctgacgttcgtccgtccggggacccccgggacgacggacgggttcctccgtacttccgttcgtttaggttccgtggggacgtacgacggccgttaccggtaaccggttaaccggttaaaagtttaacggtttttcgtaaccgttaaccggttcgggttaaaccgaggtccaaaccggtccccgttaaccccgaaacggtaaacccccggcccccgtaaacgtcccttacccgtacctaacgtacgttaaagtaagggaacttcggaaacctccgtaacggccgtaccctggaacggtactccggactacgtactttccgcgtagaccgtagactcgttcgccctaccggtccgtacccgtcgcgcacgtagcggtccggacctacggtggtacgagtcgaggttacgtaattacttggacttacggtgtcggttacgttaggcgtacgtccgagtttacgcggtcggtacggtcggttacgggtccggtagggtacgggaaccggtaccgagttcccggacgtacggttacccggtagtccggaaccggtaccgtaacgggtccttcccgtacccgg

SEQ ID NO: 83420 - DNA, 948 bp, Homo sapiens
  misc_feature: GYAE6OF02FL2MC.25.23.C01.1.454.CMB.1.raw
  modified_base (191)..(191): a, c, t, g, unknown or other
  misc_feature (191)..(191): n is a, c, g, or t
  modified_base (215)..(215): a, c, t, g, unknown or other
  misc_feature (215)..(215): n is a, c, g, or t
  modified_base (256)..(256): a, c, t, g, unknown or other
  misc_feature (256)..(256): n is a, c, g, or t
tcagactgtacagtcacgaccggtgctcgatttagtacacgtgattagggattggggagcttcagctgtggtagagaagacaggattcaggacaatctccagcatggccggcctccctctcctcctcaccctcctcactcactgtgcagggtcctgggcccagtctgtcgctgacctcacgccctaccctnagtcgtccgacggggacccccggnacggtacgggtcctcctattcttcgtttcgttcgagggacncgtacggtactacccgggaacgtacgggtaaaatttaacggtttcgtaccgtacgttacgggtaaccaggccgtacgtaccctacccgaaacggtaaccccggtaccccaaggtccctaccgtactacgtttacctaaggtaaggaactagtaacctaccgacgggtacccggtaccccgttacggaacggttaccgtaacccgtaccggtaaccggttaactttcccgtagggtccggtacccttaaacgggtaacgttccgtccgggtaccctttcccgggttaccccggttaccctccccgggtacgggtaccctacgttacccggggtacggggttcccggggtcccgggtaccccgggtaccgggtaacgggtacggttaacggaccgggttacgtaacgttaaagtttaacgtaccggttggttaccggttaccgggttagggtttaccggggtaacggttcccggtaaccggtacgggtttacgtacggggttaccggggttaccgggtttacccgggggttaccgggtttcgggggttacccgggggtaccgggtaaaccgggggttaaccggtaaaccgtcgggtttaacccgggtacccggggttaaccgggttaccccggaccggttaaccccgggacccgggtaaacccgggttccgggttaaccccccggttccccggg

SEQ ID NO: 83421 - DNA, 787 bp, Homo sapiens
  misc_feature: GYAE6OF02F4PVE.25.23.C01.1.454.CMB.1.raw
  modified_base (187)..(187): a, c, t, g, unknown or other
  misc_feature (187)..(187): n is a, c, g, or t
  modified_base (191)..(191): a, c, t, g, unknown or other
  misc_feature (191)..(191): n is a, c, g, or t
  modified_base (213)..(213): a, c, t, g, unknown or other
  misc_feature (213)..(213): n is a, c, g, or t
tcagactgtacagtcacgaccggtgctcgatttagtacacgtgattagggattggggagcttcagctgtggtagagaagacaggattcaggacaatctccagcatggccgcctccctctcctcctcaccctcctcactcactgtgcagggtcctgggcccagtctgtgctgactcagccaccccgtnagtntccgtcggggaccccccgggtnaggacgggtcctccctagttccttcgtttggttccgtggggagcacggccgtacccggacggttacggaaaattaacgttttcgaccgttacgtcggttaccacgtcacggtcctacccaaacggtaaaccccggaccccccaacgccctccctactacttacgtaacgtaggtaacgtagtactacgacggccggccccgtaggaacgggtacgttacccgacgtaaccgtactttcctccgtacggtccctaacgtaagttccgtccgtcccttcccgcccggttacccgtcccgttaccggcctacgtacgtacgggtcgggtacccggttcccgggtacccggacggtacgtacgggacggtacttaaggtaacttttaacgttaccgttggttacggacggtttagggtttacggagtttccggaaccgtcgtgttacgggtacggttccggtaccggtcggttacggtccggggtacggaaccggggtacgaacggtccgttacggtacccggtacggttaacgtacccgggaccgaccggtaccggtccgtaccccggttaccccgg

SEQ ID NO: 83422 - DNA, 826 bp, Homo sapiens
  misc_feature: GYAE6OF02F2N8J.25.23.C01.1.454.CMB.1.raw
  modified_base (243)..(243): a, c, t, g, unknown or other
  misc_feature (243)..(243): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagcccaccctctagtagtccgtccggggaccccccggcaggagggtcctacctatcttctttgttcgtgggancacgcctccgacgtacggaaaattaagtttcgtactacgtaggtacccaggcctaatccgtaccccgaaggaaaccccggcccccaaagtcccgttcctacacttctaagtaacgatgaactcgaggcccggtcccaggacggtactaccgtcgaaccgtctttacgtcgtcgtcgtacggtaaccgtcgttacggtcctacccgttacccggacccccgtttccccggtacggacccttacgttaaccgggtacgggttcccggggcccgtttacccgggttacccgggaaggggttcggtaacggaaccggttcgtaacggtaaaacgtttacgtttaaccgttacggtcggttaccgggtacggggttttaggaaccgtccgggtaacttagggttccgtaaaggtcgggtaccggggttacccggttacggggtttacggttacccggggacgggtaacggtacccgagttcccggtaaccggtacccggtttaccggtaaccgggtccgtaaccccggaacccgggtacggtacccgttaacccccgggtccccccgtttaggttccccgtaacccgg

SEQ ID NO: 83423 - DNA, 748 bp, Homo sapiens
  misc_feature: GYAE6OF02HSCR9.25.23.C01.1.454.CMB.1.raw
  modified_base (174)..(174): a, c, t, g, unknown or other
  misc_feature (174)..(174): n is a, c, g, or t
  modified_base (231)..(231): a, c, t, g, unknown or other
  misc_feature (231)..(231): n is a, c, g, or t
  modified_base (322)..(322): a, c, t, g, unknown or other
  misc_feature (322)..(322): n is a, c, g, or t
  modified_base (368)..(368): a, c, t, g, unknown or other
  misc_feature (368)..(368): n is a, c, g, or t
tcagactgtacagtcacgaccggtgctcgatttagtacacgtgattagggattggggagctgtggtagagaagacaggattcaggacaaatctccagcatggccggcctccctctcctcctcaccctcctcactcactgtgcagggtcctgggcccagtctgtgctgactcacnccaccctcagtgtcgtcgggaccccgggcaggagggtctccatctcttgtcgtggancagtcctccgacgtacggaaattaagtttgtacctacgtaggtaccagtcgacgtcctaccgaacgaaaccggcccccaagcctccgtacnctactagtacggtaatgatcgagcccgtcctagacggtactaccgngtaaccgtattctcgttcgcgtacgacgttctcggtcctcctacggccctaccgtcggtcctacgttcgacgtcgggtacccgtccgggtaccgtacggagttaggacggtacttaggtaacttaacgttaacgttcggtacgtaccggtttaagggtttcggtaagttacggacccttaacggttaccggtacgttacgggttacgggttacccgggtaacgggttttaccgggtaccggggtaccggggaaccgggttaaccgtaaacgggtccccggtttaaccgggaaacccggtttccggttaaccgggttaccggaacccggcccggtaacggtccccggttacccggtcccccgttacgggtacctaccccgg

SEQ ID NO: 83424 - DNA, 680 bp, Homo sapiens
  misc_feature: GYAE6OF02JCC4P.25.23.C01.1.454.CMB.1.raw
  modified_base (193)..(193): a, c, t, g, unknown or other
  misc_feature (193)..(193): n is a, c, g, or t
  modified_base (225)..(225): a, c, t, g, unknown or other
  misc_feature (225)..(225): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctcggggacccccgggnaggagggtctccattcttcttgttcgtgggancagccgtccgacggtacggaaattagtttcgtacttacgttcggtaaccaggacctacgcctacccgaacgtaaacccgggacccccaagtccctcctacacttacctagtaaggaattacggactacgaccggcccgggccctaggaacggggtactacccgtcgaccgttatttcctacggtggacttacggtaagtccgtacggtccctccgtccggtccctccgtcgacctactcggacggttcgggccgttcccgggagtaggacgtagggcgtacgtagttaagttacttggtgtcgtacgttagggtttgactcggtcttagtgttcggaggttccggtaccgggtagtcgggttcgggacgggtaacgacgtagtccgtcggtaccgtgtacggtcacgacgacgtccgtccgtcccgtgacctaccgttccgtacgtcccctaccg

SEQ ID NO: 83425 - DNA, 811 bp, Homo sapiens
  misc_feature: GYAE6OF02JVQKW.25.23.C01.1.454.CMB.1.raw
  modified_base (416)..(416): a, c, t, g, unknown or other
  misc_feature (416)..(416): n is a, c, g, or t
tcagactgtacagtcacgaccggtgctcgatttagtacacgtgattagggattggggagctgtggtagagaagacaggattcaggacaatctccagcataggccggcctccctctcctcctccaccctcctcactccactgtcgcgacgggtccgtcgggcccagtcgtgtactgactccagtccaccctcacgtggtcgtacccgggtcccgggaccgaggtacggtccgtaccgtacgtcctttcggaaacgttttggaggaccgtacgtccgtccgtaccggtacggtaacggtaaacgttaggttacgttaccgttcgttaccggtacggtacgtacgtacgtcccgtaccggtaaccggacccgaacccgtacctaccgtctacgtactactacggaatctttaacggtcncgggggtaccgtacccgtacggacggtactacctacggtacgtactccgttaacgttcgcgtacgcccgttcgccgtacccttcgtccgtccgtacgtcgacggtcgtaccggtccgggtacggccggtacgaccgggtttaacgacgtcggtagcgtacgttacggtaggttcaccgttaggttcgtagtacggtacggtccgtacggtagtttacgggtcggtacggggtaccgtaggtccgggtaccggaaccggtaccgttaaggggtccgtacgggtccccgaaacggtttcccgggttaaccccgtacgggggttcccgttaagggtcccctttgggtaccccccgtaccggtccccgttaccggtacccgttcgtttacccgtacccg

SEQ ID NO: 83426 - DNA, 715 bp, Homo sapiens
  misc_feature: GYAE6OF02F9V50.25.23.C01.1.454.CMB.1.raw
  modified_base (233)..(233): a, c, t, g, unknown or other
  misc_feature (233)..(233): n is a, c, g, or t
tcagactgtacagtcacgaccggtgctcgatttagtacacgtgattagggattgggggagctgtggtagagaagacaggattcaggacaatctccagcatggccggcctccctctcctcctcaccctcctcactcactgtgcagggtcctgggcccagtctgtgctgactcagccaccctcagtgtcgtcgggacccccgggcaggagggtcctccatctcttgttctgggancagctccgacgtcggaaataagttgtctacgtggtaccagcagctccaagaaccggcccccaagcctcctcactctataggatgatcagcggccctgagggactaccgtgaccattcgtctgggtctacgtaagtctggcctaccgtccgccctcccgtgccactcgtaggtcgggtacccgtccgggtaccggacgggtagtcggaacgggtacgtacgtaaaacgtttacgttaccggttaggtacggtaccggttaagggttttcggggtaacgttccggccgtaaaggttccgtaagggttacgggttcgggttaccgggtaacgggttttcgggttacggggaccgggtaacggggacccgtaacgggtccgtttaaccgggacccggtttaccggttaacgggtacccgtaaccgggtacccgaaccggggttcccgttcccggcccccccggttaggggtaccccttaccccggg

SEQ ID NO: 83427 - DNA, 758 bp, Homo sapiens
  misc_feature: GYAE6OF02ITN17.25.23.C01.1.454.CMB.1.raw
  modified_base (195)..(195): a, c, t, g, unknown or other
  misc_feature (195)..(195): n is a, c, g, or t
  modified_base (375)..(375): a, c, t, g, unknown or other
  misc_feature (375)..(375): n is a, c, g, or t
tcagactgtacagtcacgaccggtgctcgatttagtacacgtgattagggattgggggagagaagacaggattcaggacaatctccagcatggccggcctccctctcctcctcaccctcctcactcactgtgcagggtcctgggcccagtctgtgctgactcagccaccctcagtgtcgtcggggacccccgggnaggagggtcctaccatccttcgtttgttcgtagggagcagtcctccggacgtacggtaaattaggtttgtcttactcggtaccagcacgcctcccgaagaacccggaccccaagtcctacctcattcctaagtaggatagtactcgacggccgccctacgacggacgtaccgtgaccgtnttcgtcgtcggcgtacgtaacgtcgtcggtccgtccgtccgtccctccgtaggcccgtactcggtacggtcgggtccgtcccgggtacggagtaggtcggacggtacgttagtaaacttacgttcgtaggtcgttacgttaggtttacgggacgttacgtaccgttagtacggttacggtacgggttacgggttacccggtacggggttcgggttaccggggacggggttaaaccggaaccgtaacgggtcgtttaacccggacccggttacggtaccgggtaaccggtaccgggtaccctaacgggtccccgtaccccgggttccccggttaccgttacccggttacccgttacccgtttcccggttaccccccttccccgg

SEQ ID NO: 83428 - DNA, 725 bp, Homo sapiens
  misc_feature: GYAE6OF02FPOZY.25.23.C01.1.454.CMB.1.raw
  modified_base (173)..(173): a, c, t, g, unknown or other
  misc_feature (173)..(173): n is a, c, g, or t
  modified_base (194)..(194): a, c, t, g, unknown or other
  misc_feature (194)..(194): n is a, c, g, or t
  modified_base (225)..(225): a, c, t, g, unknown or other
  misc_feature (225)..(225): n is a, c, g, or t
  modified_base (257)..(257): a, c, t, g, unknown or other
  misc_feature (257)..(257): n is a, c, g, or t
  modified_base (426)..(426): a, c, t, g, unknown or other
  misc_feature (426)..(426): n is a, c, g, or t
tcagactgtacagtcacgaccggtgctcgatttagtacacgtgatttagggattgggggagagaagacaggattcaggacaatctccagcatggccggcctccctctcctcctcaccctcctcactcactgtgcagggtcctgggcccagtctgtgctgactcagccaccctnagtgtctcggggacccccggnaggagggtcctccatctcttgttctgggacncagccttccggacgtacggaaattacggtttntcgtactcgggtaccagctagcctaccacgaaaccggcccccaagccctcctcaactccttaagaggtaatgactacgtacggcccgacctgaacgggtactacctagacccgtattcgtcgtcggctcgtaagtcgcgtcctactccggtaccctccgtaggccctancgacggttccgggtccgtacccgggttcggaacgtcgtagacggcgttagtaacgttacgtttacgttggtccgtacggttagggtttcgggtacgtacgtacgtaccgtttggaacggttaacgggttcgggtacccgggtacgggttcgggtttaccgggccgggttaacggaaaccgtccggtaacgtccggtaccgttacggtacgggtaacgtccggaaccggtaccggtaccgttcccgggaccccgttcggtttccgaaccccgtttcggttccccgtcccgtttaaccccg

SEQ ID NO: 83429 - DNA, 754 bp, Homo sapiens
  misc_feature: GYAE6OF02HVLAX.25.23.C01.1.454.CMB.1.raw
  modified_base (194)..(194): a, c, t, g, unknown or other
  misc_feature (194)..(194): n is a, c, g, or t
  modified_base (262)..(262): a, c, t, g, unknown or other
  misc_feature (262)..(262): n is a, c, g, or t
  modified_base (334)..(334): a, c, t, g, unknown or other
  misc_feature (334)..(334): n is a, c, g, or t
  modified_base (464)..(464): a, c, t, g, unknown or other
  misc_feature (464)..(464): n is a, c, g, or t
tcagactgtacagtcacgaccggtgctcgatttagtacacgtgattagggattggggagctgtggtagagaagacaggattcaggacaatctccagcatggccggcctcctctcctcctcaccctcctcacctcacgtgtgcgacgggtccgtcgggcccagttcctgtgctagcctcgacgaccctaccctgngttcggtccggtaccggggacccccggagtaggtacgggttccaccgtagttccttcgttcggttcgngggactcgagccgtaccgtacggtaacgtaaaagttgtttacgtctaccggtcggtaaccagactcgtaccncccgaaacgggtaaccccgacccgtacgtcctcctaccgtaacttactaacggtaaagagtctacgtacgccgtacccggtacctaacgggtaacgtccgtaaccgtaggaccctggtttcctaccgggngtaacctggtcgtaccgtcgtcctccggtccgtaccctccgtcggacctaggtccgtcggtccggtccggtccgggtcgagtgtacggtcgtactagtaattcgtacgtcggtagttcggttcgggttagcgttacggccgtagtcggtcggtacggttcgggtaccggttcgggtcgggtaccgggtacgggaccgtacgccggtacggtccggtaccggtcgtaccggtaccgacccggttacgaaccggtccccggttcccggtcccggttaccgtacccgttcccg

SEQ ID NO: 83430 - DNA, 748 bp, Homo sapiens
  misc_feature: GYAE6OF02IW9NY.25.23.C01.1.454.CMB.1.raw
  modified_base (171)..(171): a, c, t, g, unknown or other
  misc_feature (171)..(171): n is a, c, g, or t
  modified_base (193)..(193): a, c, t, g, unknown or other
  misc_feature (193)..(193): n is a, c, g, or t
  modified_base (223)..(223): a, c, t, g, unknown or other
  misc_feature (223)..(223): n is a, c, g, or t
  modified_base (303)..(303): a, c, t, g, unknown or other
  misc_feature (303)..(303): n is a, c, g, or t
tcagactgtacagtcacgaccggtgctcgatttagtacacgtgattagggattggggagagaaggacaggattcaggacaatctccagcatggccggctccctctcctcctcaccctcctcactcactgtgcagggtcctggcccagtctgtgctgactcagcccaccctnagtgtcgtcgggacccccgggnaggacggtctccatctcttgttcgtgggancacgtctccgacggtacggaaaattagttcgtctacgtcggactaggactagcctaccgaacggaaaccgtcccccgaancctactacaactcgtaacgtaacggaatgactcgacggtccgtcccgtagagggtaccttaccgacgtaccgtacttccgtcgtcggtacctacggtacgtctcggtcctccgtaccggtcccttccgacggtcctaacgtcggtacggtcccgggtccgttacccggtaccggaggtacgtacgggacggttaccgttaaagtaaacgttagttaccgttaggtccggttaaacggtttcgggtttacggacttccgggtaaccctagtttaccgggtaggttaccgggttcgggtacccgggttaggttccgggttaccgggcggggtaaccggtacaacggtccgttacggtacccgtcgttaccggtaccaaccggtccgtaagcccgttccccggtccgttaccggccgttacccgtccgttcccgttaccccgtccccg

SEQ ID NO: 83431 - DNA, 797 bp, Homo sapiens
  misc_feature: GYAE6OF02JNSI6.25.23.C01.1.454.CMB.1.raw
  modified_base (163)..(163): a, c, t, g, unknown or other
  misc_feature (163)..(163): n is a, c, g, or t
  modified_base (206)..(206): a, c, t, g, unknown or other
  misc_feature (206)..(206): n is a, c, g, or t
  modified_base (245)..(245): a, c, t, g, unknown or other
  misc_feature (245)..(245): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtncctgactcagccctacctcgagttgtccgtcggggcccccggnaggtacgggtcctccagtcttacgtttgttcgtgggganctaggcctaccggacggttacggtaaaattcgtttgtacctaacgtcggtaccacgtacgacgtcctaccccgaacggaaaaccccggccccctaaaggcccttccccgttacaacgttccctaacgtacggtaaagttcggactaccgacggcccggtcccctaacggtaaccgggtactacccgtaccgggtaccgttaacttccgttacgcgggtactacgtaacggttcgtacggtcctaccgtccgtcccttcccggtacggcctaattccggtagggtcccgggtcccgttacccgggtaccggtacgggtacttacgggagttcgccgttaggtaaacgtttaccgtttacgttacgttacggcgtttaagggtttcgggtaacgtccggttacgttacggttgttcgggtacgggttccgggttcccggggttaaggttcccgggttagggtaccgggacgggtaccgtacggtcggtacggttccgtaacggttacgaccgtccgaccggtccgcgttaccccgggtcccgtaccggtcccgg

SEQ ID NO: 83432 - DNA, 788 bp, Homo sapiens
  misc_feature: GYAE6OF02FXAZU.25.23.C01.1.454.CMB.1.raw
  modified_base (205)..(205): a, c, t, g, unknown or other
  misc_feature (205)..(205): n is a, c, g, or t
  modified_base (230)..(230): a, c, t, g, unknown or other
  misc_feature (230)..(230): n is a, c, g, or t
  modified_base (236)..(236): a, c, t, g, unknown or other
  misc_feature (236)..(236): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagcccaccctctagtgtccgtcgggacccccgggnacggagggtctccatctcttgtcgngggacncacgtcctccggacgtacggaaattagtttcgaccttacgttcggtaacccaggtaccagtccgtacccgaagtaaacccccggcccctaagcccttccactaactctaacgtaggactgtactcgacggccgaccgtacggacggtactaccgtacgaccgttactttcctacgtcgggtacctacggtaacgtttccggtacggtcccacccgttcccgggtcccttacccggtcggtaccctacgttacggtaccggtacggggcccgtacccggggtacgaaggggtaccttaggggaaccgtacgtaaccgtaactttagttaccgtgggtacgttaaaccgggttgggtttaacgggtactttaccgggaccgttagggtcccgtttaaggggacggtttcccggggttaaaccgggtcggttcggggggtttaccgggaccgggggtaacgggtaccctacggttccggtaccggttaacccgtggttaccggtaccgtacgtaccccggagttccccgaccccgtccgtaccggtaccttcccg

SEQ ID NO: 83433 - DNA, 838 bp, Homo sapiens
  misc_feature: GYAE6OF02IXO48.25.23.C01.1.454.CMB.1.raw
  modified_base (151)..(151): a, c, t, g, unknown or other
  misc_feature (151)..(151): n is a, c, g, or t
  modified_base (200)..(200): a, c, t, g, unknown or other
  misc_feature (200)..(200): n is a, c, g, or t
  modified_base (319)..(319): a, c, t, g, unknown or other
  misc_feature (319)..(319): n is a, c, g, or t
tcagactgtacagtcacgaccggtgctcgatttagtacacgtgattagggattggggagcttcagctgtggtagagaagacaggattcaggacaatctccagcatggccggcctcctctcctcctccaccctcctcaccgtccactggtcnccagggttcctgggcccctagtcctgtgcctgacctcagccctaccctngtcgtcgtccggggacccccggtgaggtacgggtcctcctagttcctcgttgttacgaggggctacgacgtctaccggtacgtacgaaacttagttcgtctacgtacgtaccgtacgtnaccgtctacccgaacggaaacccggccccaagtcccgtacctctacgtacgtacgtaacgtagtacgaccgttccgacgggacccgtccccgtacggggtaacggtaacccgtaccgtaccggtaaccgttaccgtttccttaacccgggtggtacccttacgggtaaacgttccggtccggttaaccccgtccggtaccccggtttccccggtacccgggttaccgacccgttaacgttccggtaaccgggtcccgggtcccgttacccgggtacccgggtaggtacggtacggtacggtactaggttaactttacgttacgtgtccgttaagggtggttacggtacttaccgggcccgttagttaacgggtccgtaacgggttaccgtaacccggggttgtttaccggggtccgggaacggggttaccggaacgaccggttcccgggtacggttaccccgttacggtaccgaccgaccccggttaacggccggtaccccgttccccggtaaccccgg

SEQ ID NO: 83434 - DNA, 367 bp, Homo sapiens
  misc_feature: GYAE6OF01CTA5L.2.12.B01.1.454.CMB.1.raw
  modified_base (363)..(367): a, c, t, g, unknown or other
  misc_feature (363)..(367): n is a, c, g, or t
tcagacgctcgacacacgaccggtgctcgatttagtagtgtagattccgcgggcgaatccacgagcacagcctacatggagctgagcagcctgagatctgaggacacggccgtgtattactgtgcaagaggcggacgaggttgtagtgatggcagctgctatcgattggactactactattactacatggacgtctggggcaaaagggaccacggtcaccgtctcctcagcctccaccaagggcccatcggtcttcccctggcaccctcctccaagagcacctctgggggcacagcggccctgggctgcctggtcaaggctacttcctgtcgagcgtctgagcgggctggcaaggcgcatagnnnnn

SEQ ID NO: 83435 - DNA, 368 bp, Homo sapiens
  misc_feature: GYAE6OF01EGNGN.2.12.B01.1.454.CMB.1.raw
  modified_base (364)..(368): a, c, t, g, unknown or other
  misc_feature (364)..(368): n is a, c, g, or t
tcagacgctcgacacacgaccggtgctcgatttagtagtgtagattccgcgggcgaatccacgagcacagcctacatggagctgagcagcctgagatctgaggacacggccgtgtattactgtgcaagaggcggacgaggttgtagtgatggcagctgctatcgattggactactactattactacatggacgtctggggcaaagggaccacggtcaccgtctcctcagcctccaccaagggcccatcggtcttccccctggcaccctcctccaagagcacctctgggggcacagcggccctgggctgcctggtcaaggactacttcctgtcgagcgtctgagcgggctggcaaggcgcatagnnnnn

SEQ ID NO: 83436 - DNA, 204 bp, Homo sapiens
  misc_feature: GYAE6OF01DXZ8D.2.12.B01.1.454.CMB.1.raw
  modified_base (203)..(204): a, c, t, g, unknown or other
  misc_feature (203)..(204): n is a, c, g, or t
tcagacgctcgacacacgaccggtgctcgatttagtagtgtagattccgcgggcacgaccggtgctcgatttagtagtgtagattccgcgggcacgaccggtgctcgatttagtcacgcgagaaagggaaggggctggccctagcgtgttcctgttcccaccctcctctgtcgaggtctgagcgggctggcaaggcgcatagnn

SEQ ID NO: 83437 - DNA, 368 bp, Homo sapiens
  misc_feature: GYAE6OF01DUPKO.2.12.B01.1.454.CMB.1.raw
  modified_base (364)..(368): a, c, t, g, unknown or other
  misc_feature (364)..(368): n is a, c, g, or t
tcagacgctcgacacacgaccggtgctcgatttagtagtgtagattccgcgggcgaatccacgagcacagcctacatggagctgagcagcctgagatctgaggacacggccgtgtattactgtgcaagaggcggacgaggttgtagtgatggcagctgctatcgattggactactactattactacatggacgtctggggcaaagggaccacggtcaccgtctcctcagcctccaccaagggcccatcggtcttcccccaggcaccctcctccaagagcacctctgggggcacagcggccctgggctgcctggtcaaggactacttcctgtcgagcgtctgagcgggctggcaaggcgcatagnnnnn

SEQ ID NO: 83438 - DNA, 366 bp, Homo sapiens
  misc_feature: GYAE6OF01ACVWF.2.12.B01.1.454.CMB.1.raw
  modified_base (363)..(366): a, c, t, g, unknown or other
  misc_feature (363)..(366): n is a, c, g, or t
tcagacgctcgacacacgaccggtgctcgatttagtagtgtagattccgcgggcgaatccacgagcacagcctacatggagctgagcagcctgagatctgaggacacggccgtgtattactgtgcaagaggcggacgaggttgtagtgatggcagctgctatcgattggactactactattactacatggacgtctggggcaaagggaccacggtcaccgtctcctcagcctccaccaagggcccatcggtcttccccctggcaccctcctccaagagcacctctgggggcacagcggccctggctgcctggtcaaggactacttcctgtcgagcgtctgagcgggctggcaaggcgcatagnnnn

SEQ ID NO: 83439 - DNA, 684 bp, Homo sapiens
  misc_feature: GYAE6OF01CAUYP.2.12.B01.1.454.CMB.1.raw
  modified_base (563)..(563): a, c, t, g, unknown or other
  misc_feature (563)..(563): n is a, c, g, or t
  modified_base (566)..(566): a, c, t, g, unknown or other
  misc_feature (566)..(566): n is a, c, g, or t
  modified_base (570)..(570): a, c, t, g, unknown or other
  misc_feature (570)..(570): n is a, c, g, or t
  modified_base (577)..(577): a, c, t, g, unknown or other
  misc_feature (577)..(577): n is a, c, g, or t
  modified_base (579)..(579): a, c, t, g, unknown or other
  misc_feature (579)..(579): n is a, c, g, or t
  modified_base (582)..(583): a, c, t, g, unknown or other
  misc_feature (582)..(583): n is a, c, g, or t
  modified_base (597)..(597): a, c, t, g, unknown or other
  misc_feature (597)..(597): n is a, c, g, or t
  modified_base (599)..(599): a, c, t, g, unknown or other
  misc_feature (599)..(599): n is a, c, g, or t
  modified_base (653)..(653): a, c, t, g, unknown or other
  misc_feature (653)..(653): n is a, c, g, or t
  modified_base (682)..(682): a, c, t, g, unknown or other
  misc_feature (682)..(682): n is a, c, g, or t
tcagacgctcgacacacgaccggtgctcgatttagtagtgtagattccgcgggcgaatccacgagcacagcctacactggacgctgagccagcctgagatctggaggacacggccgttgtattactgtgcaagaggcggacgaggttgtagtgactggcagctgctatcgattggactactactagttactacgagtggacgtcgtagggtacaaagggtccacggtcaccggtctcctacgacgtccctaccgaaccgaacggggtcccctagttccggttacccttcccccgttcggtaccctaaccccgttacccgtaacccgaaacggaaccgtaccgtaacccgttcggtacggggggacctaaccggacgggtcccggtcccggttcgggtccgttcggtacccgtttacgggtaaccgaaacgggttaccgttaaaccgtttaccgtacggttaccgtaacggtaccgttacgttacggacgggtacggggtacgttacgggacgtaacgggtccgtaacggtacgttaacggctagtcgtatactagtagtacgngcncgtngcgtcgngngannacacactacgtatntntagtatatacgtactactacgtgtacgtacgtacgatacgtagtacgtacgtanacgtgacgagacgtacgactagtctcgtntc

SEQ ID NO: 83440 - DNA, 369 bp, Homo sapiens
  misc_feature: GYAE6OF01DE3AH.2.12.B01.1.454.CMB.1.raw
  modified_base (364)..(369): a, c, t, g, unknown or other
  misc_feature (364)..(369): n is a, c, g, or t
tcagacgctcgacacacgaccggtgctcgatttagtagtgtagattccgcgggcgaatccacgagcacagcctacatggagctgagcagcctgagatctgaggacacggccgtgtattactgtgcaagaggcggacgaggttgtagtgatggcagctgctatcgattggactactactattactacatggacgtctggggcaaagggaccacggtcaccgtctcctcagcctccaccaagggcccatcggtctccccctggccaccctcctccaagagccacctcgtggggcacagcggccctgggctgcctggtcaaggctacttcctgtcgagcgtctgagcgggctggcaaggcgcatagnnnnnn

SEQ ID NO: 83441 - DNA, 392 bp, Homo sapiens
  misc_feature: GYAE6OF01CCMLK.2.12.B01.1.454.CMB.1.raw
  modified_base (382)..(392): a, c, t, g, unknown or other
  misc_feature (382)..(392): n is a, c, g, or t
tcagacgctcgacacacgaccggtgctcgatttagtagtgtagattccgcgggcgaatccacgagcacagcctacatggagctgagcagcctgagatctgaggacacggccgtgtattactgtgcaagaggcggacgaggttgtagtgatggcagctgctatcgattggactactactattactacatggacgtctggggcaaaggggaccacggtcaccgtctccctcagcctccaaccaggggcccatcggtccttccccctggccacccctcctccaagacgcacctcgtgggggcacagccggccctgggctgcctggtcaaggactacttcctgtcgagcgtcgtcgaggcgggctgggacgaaggcgacgataggnnnnnnnnnnn

SEQ ID NO: 83442 - DNA, 371 bp, Homo sapiens
  misc_feature: GYAE6OF01BVDR9.2.12.B01.1.454.CMB.1.raw
  modified_base (365)..(371): a, c, t, g, unknown or other
  misc_feature (365)..(371): n is a, c, g, or t
tcagacgctcgacacacgaccggtgctcgatttagtagtgtagattccgcgggcgaatccacgagcacagcctacatggagctgagcagcctgagatctgaggacacggccgtgtattactgtgcaagaggcggacgaggttgtagtgatggcagctgctatcgattggactactactattactacatggacgtctggggcaaagggaccacggtcaccgtctcctcagcctccaccaagggcccatcggtcttccccctggccaccctcctccaagagcacctctgggggcacagcggccctgggctgcctggtcaaggactacttcctgtcgagcgtctgagcgggctggcaaggcgcatagnnnnnnn

SEQ ID NO: 83443 - DNA, 445 bp, Homo sapiens
  misc_feature: GYAE6OF01BLNSK.2.12.B01.1.454.CMB.1.raw
  modified_base (413)..(445): a, c, t, g, unknown or other
  misc_feature (413)..(445): n is a, c, g, or t
tcagacgctcgacacacgaccggtgctcgatttagtagtgtagattccgcgggcgaatccacgagcacagcctacatggagctgagcagcctgagatctgaggacacggccgtgtattactgtgcaagaggcggacgaggttgtagtgatggcagctgctatcgattggactactactattactacatggacgtcgtggggacaaaggggaccacggtcaccgtctcctcacgccctccaccgaacggggccccatccggtccttcccccgtggcccacccctcctccaacgacgcacctcgtgggggcacgacggccggcccgtgggctcgccgtggtacaaggtaccttacttccgtggtcgagtcgtctggacggcggggctcgggacgaacgggcgacgtacgtagcgnnnnnnnnnnnnnnnnnnnnnnnnnnnnnnnnn

SEQ ID NO: 83444 - DNA, 394 bp, Homo sapiens
  misc_feature: GYAE6OF01CPSU0.2.12.B01.1.454.CMB.1.raw
  modified_base (382)..(394): a, c, t, g, unknown or other
  misc_feature (382)..(394): n is a, c, g, or t
tcagacgctcgacacacgaccggtgctcgatttagtagtgtagattccgcgggcgaatccacgagcacagcctacatggagctgagcagcctgagatctgaggacacggccgtgtattactgtgcaagaggcggacgaggttgtagtgatggcagctgctatcgattggactactactattactacatggacgtctggggcaaagggaccacggtcaccgtctcctcagcctccaccaagggcccatcggtccttccccctggccacccctcctccaacgacgccaccgtcgtgggggcacgacggccggccctgggcctgccgtggtcaaggcctacttcctgtcgagtccgtctgacgcgggcgtggcaaggcgcatagnnnnnnnnnnnnn

SEQ ID NO: 83445 - DNA, 449 bp, Homo sapiens
  misc_feature: GYAE6OF01A6SRQ.2.12.B01.1.454.CMB.1.raw
  modified_base (414)..(449): a, c, t, g, unknown or other
  misc_feature (414)..(449): n is a, c, g, or t
tcagacgctcgacacacgaccggtgctcgatttagtagtgtagattccgcgggcgaatccacgagcacagcctacatggagctgagcagcctgagatctgaggacacggccgtgtattactgtgcaagaggcggacgaggttgtagtgatggcagctgctatcgattggactactactattactacatggacgtctggggcaaaggggaccacggtcaccgtctcctcagccctccaccaagggccccatccggtccttcccccgtggccacccctcctccaagacgccaccctcgtcgggggccacggacgcccgggtaccctcggggctcgcccgtgggtaccaaacggtaccttaccttccgtcgtcgacgtcgtctggacgcggggctgggacgaacggcgacagtacgnnnnnnnnnnnnnnnnnnnnnnnnnnnnnnnnnnnn

SEQ ID NO: 83446 - DNA, 492 bp, Homo sapiens
  misc_feature: GYAE6OF01ARDMU.2.12.B01.1.454.CMB.1.raw
  modified_base (453)..(453): a, c, t, g, unknown or other
  misc_feature (453)..(453): n is a, c, g, or t
  modified_base (457)..(492): a, c, t, g, unknown or other
  misc_feature (457)..(492): n is a, c, g, or t
tcagacgctcgacacacgaccggtgctcgatttagtagtgtagattccgcgggcgaatccacgagcacagcctacatggagctgagcagcctgagatctgaggacacggccgtgtattactgtgcaagaggcggacgaggttgtagtgatggcagctgctatcgattggactactactattactacatggacgtctggggacaaagggccacggtcaccgtctcctcagcctccaccaagggcccatcggtccttcccccgtggccaccctccctaccaagcgccacccgtcgtcgggggccacgacggccggtccccgtggggcctcggacccgttgggtaccaaacgggtacccttaaccgtttccccgtggttccggaacggtccggttccgtgggacgggtccgggggccgttcgggaccggaaacgggccggacctaaggttacggcngacnnnnnnnnnnnnnnnnnnnnnnnnnnnnnnnnnnnn

SEQ ID NO: 83447 - DNA, 514 bp, Homo sapiens
  misc_feature: GYAE6OF01A77CF.2.12.B01.1.454.CMB.1.raw
  modified_base (198)..(198): a, c, t, g, unknown or other
  misc_feature (198)..(198): n is a, c, g, or t
  modified_base (460)..(460): a, c, t, g, unknown or other
  misc_feature (460)..(460): n is a, c, g, or t
  modified_base (463)..(467): a, c, t, g, unknown or other
  misc_feature (463)..(467): n is a, c, g, or t
  modified_base (469)..(472): a, c, t, g, unknown or other
  misc_feature (469)..(472): n is a, c, g, or t
  modified_base (474)..(514): a, c, t, g, unknown or other
  misc_feature (474)..(514): n is a, c, g, or t
tcagacgctcgacacacgaccggtgctcgatttagtagtgtagattccgcgggcgaatccacgagcacagcctacatggagctgagcagcctgagatctggaggacacggccgtgtattactgtgcaagaggcggacgtaggttgtagtgatggcagctgctatcgattggactactactattactacatggacgtcnggggacaaagggaccacggtcaccgtctccgtcacgccctccgacccaaggggcccagttccggttaccctttcccccctggcccaccccgttcctccgaagcgaccacctcggcgggggaccacgaggtcccggcccgtgggcctcggacccctgggtaccaacgggaccttaaccgttccgtcgtacggacgtccgtacgttcggacgggtccgggggaccgttaggggaccaaaccggggtccaccgtaaagtacgcgnagnnnnncnnnnannnnnnnnnnnnnnnnnnnnnnnnnnnnnnnnnnnnnnnnn

SEQ ID NO: 83448 - DNA, 403 bp, Homo sapiens
  misc_feature: GYAE6OF01AZ2YQ.2.12.B01.1.454.CMB.1.raw
  modified_base (285)..(285): a, c, t, g, unknown or other
  misc_feature (285)..(285): n is a, c, g, or t
  modified_base (382)..(385): a, c, t, g, unknown or other
  misc_feature (382)..(385): n is a, c, g, or t
  modified_base (387)..(403): a, c, t, g, unknown or other
  misc_feature (387)..(403): n is a, c, g, or t
tcagacgctcgacacacgaccggtgctcgatttagtagtgtagattccgcgggcgaatccacgagcacagcctacatggagctgagcagcctgagatctgaggacacggccgtgtattactgtgcaagaggcggacgaggttgtagtgatggcagctgctatcgattggactactactattactacatggacgtcgtggggcaaagggaccacggtcaccgtctcctcacgcctccaccaacgggcccatcggtccttccccctcggccaccctcctccaagacnccacctcgtgggggcacgacgccggtccctgggctgcctggtcaaggtacctactctgtcgagtcgtctgacgcgggctggcgaaggcgactatagnnnncnnnnnnnnnnnnnnnnn

SEQ ID NO: 83449 - DNA, 621 bp, Homo sapiens
  misc_feature: GYAE6OF01CAMGS.2.12.B01.1.454.CMB.1.raw
  modified_base (510)..(510): a, c, t, g, unknown or other
  misc_feature (510)..(510): n is a, c, g, or t
  modified_base (515)..(515): a, c, t, g, unknown or other
  misc_feature (515)..(515): n is a, c, g, or t
  modified_base (518)..(518): a, c, t, g, unknown or other
  misc_feature (518)..(518): n is a, c, g, or t
  modified_base (523)..(525): a, c, t, g, unknown or other
  misc_feature (523)..(525): n is a, c, g, or t
  modified_base (529)..(530): a, c, t, g, unknown or other
  misc_feature (529)..(530): n is a, c, g, or t
  modified_base (534)..(535): a, c, t, g, unknown or other
  misc_feature (534)..(535): n is a, c, g, or t
  modified_base (542)..(542): a, c, t, g, unknown or other
  misc_feature (542)..(542): n is a, c, g, or t
  modified_base (547)..(547): a, c, t, g, unknown or other
  misc_feature (547)..(547): n is a, c, g, or t
  modified_base (549)..(549): a, c, t, g, unknown or other
  misc_feature (549)..(549): n is a, c, g, or t
  modified_base (557)..(557): a, c, t, g, unknown or other
  misc_feature (557)..(557): n is a, c, g, or t
  modified_base (559)..(559): a, c, t, g, unknown or other
  misc_feature (559)..(559): n is a, c, g, or t
  modified_base (565)..(566): a, c, t, g, unknown or other
  misc_feature (565)..(566): n is a, c, g, or t
  modified_base (576)..(576): a, c, t, g, unknown or other
  misc_feature (576)..(576): n is a, c, g, or t
tcagacgctcgacacacgaccggtgctcgatttagtagtgtagattccgcgggcgaatccacgagcacagcctacatggagctgagcagcctgagatctgaggaccacggccgtgtattactgtgcaagaggcggacggaggttgtagtgatggcagtctgctatcgattcggactactaactattactaacagtagggacgtcgtcggggacaaacggggaccacggtccaccgtcctcctcaacgccctccgaaccgacggcccacgtccggttaccctttccccccgtggacccacccccgttacctacccgaaacgacggacgtacccgtcgtcggggggacacgacggccggtacccgtcggggtctcggtacccgttggtaccgtaaacgggtaaccctacctttacccgttggtaccggtaccggttcggttacgttacgggaaccgggtcgggggtcgtacgggaaccgtaaaccgggccggacgtaaacggttagcgatcngagtncgngtagnnncgtnncganncgagtcncgacngngatcacgngntgtcgnntctacgcacncgctagtctagtacgcgtgtacgacgtactacgtagcgtcgtctc

SEQ ID NO: 83450 - DNA, 369 bp, Homo sapiens
  misc_feature: GYAE6OF02IZGRN.2.12.B01.1.454.CMB.1.raw
  modified_base (364)..(369): a, c, t, g, unknown or other
  misc_feature (364)..(369): n is a, c, g, or t
tcagacgctcgacacacgaccggtgctcgatttagtagtgtagattccgcgggcgaatccacgagcacagcctacatggagctgagcagcctgagatctgaggacacggccgtgtattactgtgcaagaggcggacgaggttgtagtgatggcagctgctatcgattggactactactattactacatggacgtctggggcaaagggaccacggtcaccgtctcctcagcctccaccaagggcccatcggtcttccccctggcaccctcctccaagagcacctctgggggcacagcggccctgggctgcctggtcaaggactacttcctgtcgagcgtctgagcgggctggcaaggcgcatagnnnnnn

SEQ ID NO: 83451 - DNA, 370 bp, Homo sapiens
  misc_feature: GYAE6OF02GLOJO.2.12.B01.1.454.CMB.1.raw
  modified_base (364)..(370): a, c, t, g, unknown or other
  misc_feature (364)..(370): n is a, c, g, or t
tcagacgctcgacacacgaccggtgctcgatttagtagtgtagattccgcgggcgaatccacgagcacagcctacatggagctgagcagcctgagatctgaggacacggccgtgtattactgtgcaagaggcggacgaggttgtagtgatggcagctgctatcgattggactactactattactacatggacgtctggggcaaagggaccacggtcaccgtctcctcagcctccaccaagggcccatcggtcttccccctggcaccctcctccaagagcacctctgggggcacagcggccctgggctgcctggtcaaggactacttcctgtcgagcgtctgagcgggctggcaaggcgcatagnnnnnnn

SEQ ID NO: 83452 - DNA, 369 bp, Homo sapiens; identical to SEQ ID NO: 83450
  misc_feature: GYAE6OF02HIVHN.2.12.B01.1.454.CMB.1.raw
  modified_base (364)..(369): a, c, t, g, unknown or other
  misc_feature (364)..(369): n is a, c, g, or t

SEQ ID NO: 83453 - DNA, 398 bp, Homo sapiens
  misc_feature: GYAE6OF02GSA1F.2.12.B01.1.454.CMB.1.raw
  modified_base (372)..(398): a, c, t, g, unknown or other
  misc_feature (372)..(398): n is a, c, g, or t
tcagacgctcgacacacgaccggtgctcgatttagtagtgtagattccgtcgggtcggaatccacgagcgacagcctacatggagcctgagcagcctgacgatctgaggacacggccgtgtattactgtgcaagaggcggacgaggttgtagtgatggcagctgctatcgattggactactactattactacatggacgtctggggcaaagggaccacggtcaccgtctcctcagcctccaccaagggcccatccggtcttccccctggcaccctcctccaaagcgcacctctcgggggcacagcggccctgggctgcctggtcaaggactactcctgtcgagcgtctgagcgggctggcgaggcgcatagnnnnnnnnnnnnnnnnnnnnnnnnnnn

SEQ ID NO: 83454 - DNA, 377 bp, Homo sapiens
  misc_feature: GYAE6OF02I3D7N.2.12.B01.1.454.CMB.1.raw
  modified_base (364)..(365): a, c, t, g, unknown or other
  misc_feature (364)..(365): n is a, c, g, or t
  modified_base (367)..(377): a, c, t, g, unknown or other
  misc_feature (367)..(377): n is a, c, g, or t
tcagacgctcgacacacgaccggtgctcgatttagtagtgtagattccgcgggcgaatccacgagcacagcctacatggagctgagcagcctgagatctgaggacacggccgtgtattactgtgcaagaggcggacgaggttgtagtgatggcagctgctatcgattggactactactattactacatggacgtctggggcaaagggaccacggtcaccgtctcctcagcctccaccaagggcccatcggtcttccccctggcaccctcctccaacgagccacctctcgggggcacagcggccctggctgcctggtcaaggctactcctgtcgagcgtctgagcgggctggcaaggcgcatagnngnnnnnnnnnnn

SEQ ID NO: 83455 - DNA, 367 bp, Homo sapiens
  misc_feature: GYAE6OF02GN5EO.2.12.B01.1.454.CMB.1.raw
  modified_base (363)..(367): a, c, t, g, unknown or other
  misc_feature (363)..(367): n is a, c, g, or t
tcagacgctcgacacacgaccggtgctcgatttagtagtgtagattccgcgggcgaatccacgagcacagcctacatggagctgagcagcctgagatctgaggacacggccgtgtattactgtgcaagaggcggacgaggttgtagtgatggcagctgctatcgattggactactactattactacatggacgtctggggcaaagggaccacggtcaccgtctcctcagcctccaccaagggcccatcggtcttccccctggcaccctcctccaagagcacctctgggggcacagcggccctgggctgcctggtcaaggctacttcctgtcgagcgtctgagcgggctggcaaggcgcatagnnnnn

SEQ ID NO: 83456 - DNA, 371 bp, Homo sapiens
  misc_feature: GYAE6OF02H64X2.2.12.B01.1.454.CMB.1.raw
  modified_base (365)..(371): a, c, t, g, unknown or other
  misc_feature (365)..(371): n is a, c, g, or t
tcagacgctcgacacacgaccggtgctcgatttagtagtgtagattccgcgggcgaatccacgagcacagcctacatggagctgagcagcctgagatctgaggacacggccgtgtattactgtgcaagaggcggacgaggttgtagtgatggcagctgctatcgattggactactactattactacatggacgtctggggcaaagggaccacggtcaccgtctcctcagcctccaccaagggcccatcggtcttcccctggcacccctcctccaagagcacctctggggcacagccggccctgggctgcctggtcaaggactacttcctgtcgagcgtctggagcgggctggcaaggcgcatagnnnnnnn

SEQ ID NO: 83457 - DNA, 369 bp, Homo sapiens
  misc_feature: GYAE6OF02G64H4.2.12.B01.1.454.CMB.1.raw
  modified_base (364)..(369): a, c, t, g, unknown or other
  misc_feature (364)..(369): n is a, c, g, or t
tcagacgctcgacacacgaccggtgctcgatttagtagtgtagattccgcgggcgaatccacgagcacagcctacatggagctgagcagccctgagatctgaggacacggccgtgtattactgtgcaagaggcggacgaggttgtagtgatggcagctgctatcgattggactactactattactacatggacgtctggggcaaagggccacggtcaccgtctcctcagcctccaccaaggcccatcggtcttccccctggccaccctcctccaagagcacctcgtgggggcacagccggccctggctgcctggtcaaggactacttcctgtcgagcgtctgagcggctggcaaggcgcatagnnnnnn

SEQ ID NO: 83458 - DNA, 372 bp, Homo sapiens
  misc_feature: GYAE6OF02HDHAE.2.12.B01.1.454.CMB.1.raw
  modified_base (365)..(372): a, c, t, g, unknown or other
  misc_feature (365)..(372): n is a, c, g, or t
tcagacgctcgacacacgaccggtgctcgatttagtagtgtagattccgcgggcgaatccacgagcacagcctacatggagctgagcagcctgagatctgaggacacggccgtgtattactgtgcaagaggcggacgaggttgtagtgatggcagctgctatcgattggactactactattactacatggacgtctgggggcaaagggaccacggtcaccgtctcctcagcctccaccaagggcccatcggtcttccccctggcaccctcctccaagagcacctctgggggcacagcggccctgggctgcctggtcaaggactacttcctgtcgagcgtctgagcgggctggcaaggcgcatagnnnnnnnn

SEQ ID NO: 83459 - DNA, 381 bp, Homo sapiens
  misc_feature: GYAE6OF02FSS1G.2.12.B01.1.454.CMB.1.raw
  modified_base (373)..(381): a, c, t, g, unknown or other
  misc_feature (373)..(381): n is a, c, g, or t
tcagacgctcgacacacgaccggtgctcgatttagtagtgtagattccgcgggcgaatccacgagcacagcctacatggagctgagcagcctgagatctgaggacacggccgtgtattactgtgcaagaggcggacgaggttgtagtgatggcagctgctatcgattggactactactattactacatggacgtctgggggcaaagggaccacggtcaccgtctcctcagcctccaccaagggcccatcggtctccccctggccaccctcctccaagacgcacctcgtgggggcacgagccggccctgggctggcctggtcaaggacctacttccgtgtcgagcgtctgagcgggctggcgaaggcgcatagnnnnnnnnn

SEQ ID NO: 83460 - DNA, 572 bp, Homo sapiens
  misc_feature: GYAE6OF02IULCS.2.12.B01.1.454.CMB.1.raw
  modified_base (502)..(502): a, c, t, g, unknown or other
  misc_feature (502)..(502): n is a, c, g, or t
  modified_base (531)..(572): a, c, t, g, unknown or other
  misc_feature (531)..(572): n is a, c, g, or t
tcagacgctcgacacacgaccggtgctcgatttagtagtgtagattccgcgggcgaatccacgagcacagcctacatggagctgagcagcctgagatctgaggacacggccgtgtattactgtgcaagaggcggacgaggttgtagtgatggcagctgctatcgattggacttactactattactaacatggacgtcgtgggggacaaaacgggacccaacgggtcccaaccgttcctccctcacgcccctaccgaacccgaaacggggccccaattcccgggttaccctttccccccccgttcgggacccaacccccccttccccgtacccgtaaaacggaccggcccaaccccgttaccgggtcgggggggaccaaccgacgggtccccgggtccccgttgggggaccctcgggtccccgttacggggtaccaaaacgggtacccttaacctttccccgtggtaccggtacggtccgtccgtaggacgggacccggggtntcggggacgaacgggccgtacaacgtagnnnnnnnnnnnnnnnnnnnnnnnnnnnnnnnnnnnnnnnnnn

SEQ ID NO: 83461 - DNA, 445 bp, Homo sapiens
  misc_feature: GYAE6OF02FWKKX.2.12.B01.1.454.CMB.1.raw
  modified_base (416)..(417): a, c, t, g, unknown or other
  misc_feature (416)..(417): n is a, c, g, or t
  modified_base (419)..(445): a, c, t, g, unknown or other
  misc_feature (419)..(445): n is a, c, g, or t
tcagacgctcgacacacgaccggtgctcgatttagtagtgtagattccgcgggcgaatccacgagcacagccctacatggagctgagcagcctgagatctgaggacacggccgtgtattactgtgcaagaggcggacgaggttgtagtgatggcagctgctatcgattggactactactattactacatggacgtctgggggcaaaagggaccacggtcacccgtctcctcagccctccaacccgaagggccccagtccggtccttcccccctggccacccctcctccaagacgccaccctcgtgggggcacgacgccggcccctggggcctcggccgtggtaccgaaggtaccttaccgttccttggtcgagtccgtcgtgacggcgggcgtcgggacgaaggcgacgaagtagnncnnnnnnnnnnnnnnnnnnnnnnnnnnn

SEQ ID NO: 83462 - DNA, 377 bp, Homo sapiens
  misc_feature: GYAE6OF02G0JR1.2.12.B01.1.454.CMB.1.raw
  modified_base (340)..(340): a, c, t, g, unknown or other
  misc_feature (340)..(340): n is a, c, g, or t
  modified_base (366)..(377): a, c, t, g, unknown or other
  misc_feature (366)..(377): n is a, c, g, or t
tcagacgctcgacacacgaccggtgctcgatttagtagtgtagattccgcgggcgaatccacgagcacagcctacatggagctgagcagcctgagatctgaggacacggccgtgtattactgtgcaagaggcggacgaggttgtagtgatggcagctgctatcgattggactactactattactacatggacgtctggggcaaaagggaccacggtcaccgtctcctcagcctccaccaagggcccatcggtcttccccctggcaccctcctccaagagcacctctgggggcacagcggccctgggctgcctggtcaagactacttcctgtcgagccgtntgagcgggctggcaaggcgacatagnnnnnnnnnnnn

SEQ ID NO: 83463 - DNA, 382 bp, Homo sapiens
  misc_feature: GYAE6OF02FS5XQ.2.12.B01.1.454.CMB.1.raw
  modified_base (363)..(363): a, c, t, g, unknown or other
  misc_feature (363)..(363): n is a, c, g, or t
  modified_base (369)..(382): a, c, t, g, unknown or other
  misc_feature (369)..(382): n is a, c, g, or t
tcagacgctcgacacacgaccggtgctcgatttagtagtgtagattccgcgggcgaatccacgagcacagcctacatggagctgagcagcctgagatctgaggacacggccgtgtattactgtgcaagaggcggacgaggttgtagtgatggcagctgctatcgattggactactactattactacatggacgtctgggggcaaagggaccacggtcaccgtctcctcagcctccaccaagggcccatcggtcttccccctggccaccctcctccaagacgcacctctgggggcacagcggccctgggctgcctggtcaaggactacttcctgtcgagcgtctggagcgggctggcgaaggcncatagnnnnnnnnnnnnnn

SEQ ID NO: 83464 - DNA, 422 bp, Homo sapiens
  misc_feature: GYAE6OF02F5AF3.2.12.B01.1.454.CMB.1.raw
  modified_base (397)..(422): a, c, t, g, unknown or other
  misc_feature (397)..(422): n is a, c, g, or t
tcagacgctcgacacacgaccggtgctcgatttagtagtgtagattccgcgggcgaatccacgagcacagcctacatggagctgagcagcctgagatctgaggacacggccgtgtattactgtgcaagaggcggacgaggttgtagtgatggcagctgctatcgattggactactactattactacatggacgtcgtgggacaaagggaccacggtcacccgtctcctcagccctccaccgaaggccccatccggtccttccccctggccacccctcctccaagcgccacctcgtcggggccacgacggccggcccgtgggcctcgccgtggtcaaggtacctacttccgtgtcgagccgtctaggacggcggcgtgggacgaacggcgacagtagnnnnnnnnnnnnnnnnnnnnnnnnnn

SEQ ID NO: 83465 - DNA, 610 bp, Homo sapiens
  misc_feature: GYAE6OF02HUUAY.2.12.B01.1.454.CMB.1.raw
  modified_base (129)..(129): a, c, t, g, unknown or other
  misc_feature (129)..(129): n is a, c, g, or t
  modified_base (311)..(311): a, c, t, g, unknown or other
  misc_feature (311)..(311): n is a, c, g, or t
  modified_base (450)..(450): a, c, t, g, unknown or other
  misc_feature (450)..(450): n is a, c, g, or t
  modified_base (458)..(458): a, c, t, g, unknown or other
  misc_feature (458)..(458): n is a, c, g, or t
  modified_base (468)..(468): a, c, t, g, unknown or other
  misc_feature (468)..(468): n is a, c, g, or t
  modified_base (477)..(477): a, c, t, g, unknown or other
  misc_feature (477)..(477): n is a, c, g, or t
  modified_base (491)..(491): a, c, t, g, unknown or other
  misc_feature (491)..(491): n is a, c, g, or t
  modified_base (503)..(503): a, c, t, g, unknown or other
  misc_feature (503)..(503): n is a, c, g, or t
  modified_base (527)..(527): a, c, t, g, unknown or other
  misc_feature (527)..(527): n is a, c, g, or t
tcagacgctcgacacacgaccggtgctcgatttagtagtgtagattccgcgggcgaatccacgagcacagcctacatggagctgagcagcctgagatctgaggcacggccgtgtattactgtgcaaggnggcggacgagtgtagtgagtggcagctgctatcgattggacttactatattacacagtggacgttcgaggggacaaaacgggaccacggtcaaccgtctcctcacgcctaccgaccgaacgggcccagtccggttccttcccccgtggtccaacccttccgaccaaagcgaccaccgtcggnggggacaccgacggtaccgtcccgtagggcgtcgccgtacggaacgtaaacggtacctaacgttccgtgtaccggacgtccggttacgtcggtaacggcgggtcgtacgggaacgaacggtccgaactagttaacgggntctagcancgagagtacncgacgtcgngtagacgtacgtanactgtactagtntacgtacgacgtagtacgtgagtntacgtctacgtagtaacgtcgttcgatacgtagaacgtcgtactgaacgtcgacgtaacgtctaccggttagacttacgatcg

SEQ ID NO: 83466 - DNA, 432 bp, Homo sapiens
  misc_feature: GYAE6OF02IHUBU.2.12.B01.1.454.CMB.1.raw
  modified_base (125)..(125): a, c, t, g, unknown or other
  misc_feature (125)..(125): n is a, c, g, or t
  modified_base (327)..(327): a, c, t, g, unknown or other
  misc_feature (327)..(327): n is a, c, g, or t
  modified_base (382)..(382): a, c, t, g, unknown or other
  misc_feature (382)..(382): n is a, c, g, or t
  modified_base (398)..(398): a, c, t, g, unknown or other
  misc_feature (398)..(398): n is a, c, g, or t
  modified_base (401)..(401): a, c, t, g, unknown or other
  misc_feature (401)..(401): n is a, c, g, or t
  modified_base (404)..(432): a, c, t, g, unknown or other
  misc_feature (404)..(432): n is a, c, g, or t
tcagacgctcgacacacgaccggtgctcgatttagtagtgtagattccgcgggcgaatccacgagcacagcctacatggagctgagcagcctgagatctgaggacacggccgtgtattactgtgnaagagggcggacgaggttgtagtgatggcagctgctatcgattggactactactattacacatggacgtcgtggggacaaaagggacccacggtccaccgtcctcctcacgccctccaccgaacgggccctagtccggtccttccccgtcggacctcccctccaccaagacgccaccgtcgcggggacacgcgccgggccgngggcctcggcctggacgaaggtacctcttccgtgtcgagtcgtctggagcgggcncggacggacggccganaangcnnnnnnnnnnnnnnnnnnnnnnnnnnnnn

SEQ ID NO: 83467 - DNA, 182 bp, Homo sapiens
  misc_feature: GYAE6OF01ESP1M.13.51.E07.1.454.CMB.1.raw
  modified_base (179)..(182): a, c, t, g, unknown or other
  misc_feature (179)..(182): n is a, c, g, or t
tcagtcacgtactacacgaccggtgctcgatttagcatactctacaacacacaaagggcccatcggtcttcccctggcaccctcctccaagagcacctctgggggcacagcggccctgggctgcctggtcaaggactacttcctagtacgtgactgagcgggctggcaaggcgcatagnnnn

SEQ ID NO: 83468 - DNA, 186 bp, Homo sapiens
  misc_feature: GYAE6OF01ETHVD.13.51.E07.1.454.CMB.1.raw
  modified_base (180)..(186): a, c, t, g, unknown or other
  misc_feature (180)..(186): n is a, c, g, or t
tcagtcacgtactacacgaccggtgctcgatttagcatactctacaacacacaaagggcccatcggtcttccccctggcaccctcctccaagagcacctctgggggcacagcggccctgggctgcctggtcaaggactacttcctagtacgtgactgagcgggctggcaaggcgcatagnnnnnnn

SEQ ID NO: 83469 - DNA, 179 bp, Homo sapiens
  misc_feature: GYAE6OF01AYBVR.13.51.E07.1.454.CMB.1.raw
  modified_base (179)..(179): a, c, t, g, unknown or other
  misc_feature (179)..(179): n is a, c, g, or t
tcagtcacgtactacacgaccggtgctcgatttagcatactctacaacacacaaagggcccatcggtcttcccctggcaccctcctccaagagcacctctgggggcacagcggccctgggctgcctggtcaaggactacttcctagtacgtgactgagcgggctggcaaggcgcatagn

SEQ ID NO: 83470 - DNA, 184 bp, Homo sapiens
  misc_feature: GYAE6OF01DR5S8.13.51.E07.1.454.CMB.1.raw
  modified_base (178)..(184): a, c, t, g, unknown or other
  misc_feature (178)..(184): n is a, c, g, or t
tcagtcacgtactacacgaccggtgctcgatttagcatactctacaacacacaaagggcccatcggtcttcccctggcaccctcctccaagagcacctctggggcacagcggccctgggctgcctggtcaaggactacttcctagtacgtgactgagcgggctggcaaggcgcatagnnnnnnn

SEQ ID NO: 83471 - DNA, 185 bp, Homo sapiens
  misc_feature: GYAE6OF01EYGDT.13.51.E07.1.454.CMB.1.raw
  modified_base (180)..(185): a, c, t, g, unknown or other
  misc_feature (180)..(185): n is a, c, g, or t
tcagtcacgtactacacgaccggtgctcgatttagcatactctacaacacacaaagggcccatcggtcttccccctggcaccctcctccaagagcacctctgggggcacagcggccctgggctgcctggtcaaggactacttcctagtacgtgactgagcgggctggcaaggcgcatagnnnnnn

SEQ ID NO: 83472 - DNA, 188 bp, Homo sapiens
  misc_feature: GYAE6OF01BRKI3.13.51.E07.1.454.CMB.1.raw
  modified_base (180)..(188): a, c, t, g, unknown or other
  misc_feature (180)..(188): n is a, c, g, or t
tcagtcacgtactacacgaccggtgctcgatttagcatactctacaacacacaaagggcccatcggtcttccccctggcaccctcctccaagagcacctctgggggcacagcggccctgggctgcctggtcaaggactacttcctagtacgtgactgagcgggctggcaaggcgcatagnnnnnnnnn

SEQ ID NO: 83473 - DNA, 182 bp, Homo sapiens
  misc_feature: GYAE6OF01DGNA3.13.51.E07.1.454.CMB.1.raw
  modified_base (180)..(182): a, c, t, g, unknown or other
  misc_feature (180)..(182): n is a, c, g, or t
tcagtcacgtactacacgaccggtgctcgatttagcatactctacaacacacaaagggcccatcggtcttccccctggcaccctcctccaagagcacctctgggggcacagcggccctgggctgcctggtcaaggactacttcctagtacgtgactgagcgggctggcaaggcgcatagnnn

SEQ ID NO: 83474 - DNA, 182 bp, Homo sapiens; identical to SEQ ID NO: 83473
  misc_feature: GYAE6OF02IPMQM.13.51.E07.1.454.CMB.1.raw
  modified_base (180)..(182): a, c, t, g, unknown or other
  misc_feature (180)..(182): n is a, c, g, or t

SEQ ID NO: 83475 - DNA, 183 bp, Homo sapiens
  misc_feature: GYAE6OF02IQWXV.13.51.E07.1.454.CMB.1.raw
  modified_base (179)..(183): a, c, t, g, unknown or other
  misc_feature (179)..(183): n is a, c, g, or t
tcagtcacgtactacacgaccggtgctcgatttagcatactctacaacacacaaagggcccatcggtcttccccctggcaccctcctccaagagcacctctggggcacagcggccctgggctgcctggtcaaggactacttcctagtacgtgactgagcgggctggcaaggcgcatagnnnnn

SEQ ID NO: 83476 - DNA, 184 bp, Homo sapiens
  misc_feature: GYAE6OF02G1P4I.13.51.E07.1.454.CMB.1.raw
  modified_base (179)..(184): a, c, t, g, unknown or other
  misc_feature (179)..(184): n is a, c, g, or t
tcagtcacgtactacacgaccggtgctcgatttagcatactctacaacacacaaagggcccatcggtcttcccctggcaccctcctccaagagcacctctgggggcacagcggccctgggctgcctggtcaaggactacttcctagtacgtgactgagcgggctggcaaggcgcatagnnnnnn

SEQ ID NO: 83477 - DNA, 191 bp, Homo sapiens
  misc_feature: GYAE6OF02GKUP8.13.51.E07.1.454.CMB.1.raw
  modified_base (179)..(191): a, c, t, g, unknown or other
  misc_feature (179)..(191): n is a, c, g, or t
tcagtcacgtactacacgaccggtgctcgatttagcatactctacaacacacaaagggcccatcggtcttccccctggcaccctcctccaagagcacctctggggcacagcggccctgggctgcctggtcaaggactacttcctagtacgtgactgagcgggctggcaaggcgcatagnnnnnnnnnnnnn

SEQ ID NO: 83478 - DNA, 560 bp, Homo sapiens
  misc_feature: GYAE6OF01CA2DI.4.29.C07.1.454.CMB.1.raw
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggctttttcttgtggctattttaaaagctgtccagtgtgaggtgcagctgttggagtctgggggaggcttggtccagcggggggggtccctgagactctcctgttctgcctctggattcacctttatgaattttgccatgagctgggtccgccagactccacggaagggctggagtgggtctcaagtcttagtgctagtggtggtcacacatactacgcagactcgtgaagggccgttcaccatctccagagacaattccaagaacaccctgtatctgcaaatgaacagcctgagagccgaggacacggccgtatattactgtgactaaaagtattttggtagctaggttcgttaccccttaaggtttccttttttacgaccttcccgttgggggtcccgtaaaccggggg

SEQ ID NO: 83479 - DNA, 554 bp, Homo sapiens
  misc_feature: GYAE6OF01C9ZLO.4.29.C07.1.454.CMB.1.raw
  modified_base (302)..(302): a, c, t, g, unknown or other
  misc_feature (302)..(302): n is a, c, g, or t
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggctttttcttgtggctattttaaaagctgtccagtgtgaggtgcagctgttggagtctgggggaggcttggtccaggcggggggggtccctgagactctcctgttctgcctctggattcacctttatgtaattttgccatgagctgggtccncagactccacggaaggggctggagtgggtctcaagtcttagtgctagtggtggtcacacatactacgcagactccgtgaagggccggttcaccatctccagagacaattaccaagaacaccctgtatctgacaaatgaacagcctgagagccgaggacacggcgtatattactgtagactaaagtattttagtagtctagttcgtacccttaagttctttttagaccttccgtggggtcccgtaaaccgggg

SEQ ID NO: 83480 - DNA, 620 bp, Homo sapiens
  misc_feature: GYAE6OF01BCCCB.4.29.C07.1.454.CMB.1.raw
  modified_base (305)..(305): a, c, t, g, unknown or other
  misc_feature (305)..(305): n is a, c, g, or t
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggctttttcttgtggctattttaaaagctgtccagtgtgaggtgcagctgttggagtcgtgggggaggcttgggtccaggcggggggggtccctgagactctcctgttctgcctctggattcaccttttatgaattttgcctatgagctgggtccnccagactccgacgggaggggctggagtgggtctcgaagtcttagtgctagtggtggtcacacatactacgcagactccgtagaagggccggttacacctatctccagacgacaattccaaagacacccgtgtactctagacaaatacgaacagcctgagacgacggaggaccgacggccgtaattacgttacgtgtagtacgtaaaacggttagttttgtaaggtcttaacggttcgttaaccccgtttaacggttttccgttttttacggacccgtttacccggttcggggggtaaccccggtaaacccggggg

SEQ ID NO: 83481 - DNA, 581 bp, Homo sapiens
  misc_feature: GYAE6OF01DD2MY.4.29.C07.1.454.CMB.1.raw
  modified_base (353)..(353): a, c, t, g, unknown or other
  misc_feature (353)..(353): n is a, c, g, or t
  modified_base (410)..(410): a, c, t, g, unknown or other
  misc_feature (410)..(410): n is a, c, g, or t
  modified_base (434)..(434): a, c, t, g, unknown or other
  misc_feature (434)..(434): n is a, c, g, or t
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggtctttttcttgtggctattttaaaagctgtccagtgtgaggtgcagctgttggagtcgtgggggaggcttggtccaggcggggggggtccctgagactctcctgttctgcctctggattctacctttatgtaattttgccatgagctgggtccgccagacctccgacgggaagggctgggaggtgggtctcaagttcttagngctagtggtggtcacacatacacgcagactccgtgaacggccgttcacatctcaganacaataccaagaaccaccctgtanctagacaaatgaacagcctgaagacggaccgaggaccgacggccttatattactgtacgaactaaagtacttttaggagtacgtagttacgttacccgttaaacgttctttttacgaccgttcccgttcggggcccgtaaaccgggg

SEQ ID NO: 83482 - DNA, 866 bp, Homo sapiens
  misc_feature: GYAE6OF01CN9NQ.4.29.C07.1.454.CMB.1.raw
  modified_base (260)..(260): a, c, t, g, unknown or other
  misc_feature (260)..(260): n is a, c, g, or t
  modified_base (265)..(265): a, c, t, g, unknown or other
  misc_feature (265)..(265): n is a, c, g, or t
tcagagcactgtagcacgaccggtgctcgatttagagtgctacgaagggaaaggggtgagagaggagtccagccctgggattttcaggtgtcttcatttggtgatcaggactgaacagagagaactcaccatggagttgggctgaactggtctttttcttgtggctattttaaaagctgtccagtgtgaggtgcagctgttggagtcgtgggggaggcgttggtccgaggcggggggggtccctgagactctcctgttcngcctntggattcaccttttatgtaattttgcctagtgagctgggtccgccaggacctccgacgggaaggggctagggaggtgggtctacgtaaggttcttaggtgcgttaggtgggtggtacaacgacaactacgtaacgcgaacgtaccgtccggtaggaaaccggggtcccggtttaccaacccgtacttacccgtacccgaacggtaacgtaacctaaaaccgtttaccccaaaaacggtaaaccctaaacccccgttacggttaaaccttacccgttaacgtaaaccgtaaaacgttaaccggtaaaaccgacggtacccgttagggaaacggaaccgggaccccgggaaaccggggaacccggtaaccccggggtaaacccgggtttaacgtttaaacgtttaacccggttaacggtttaacgggaaaacccgtttaaaaaggtttaacggtttttttaacgggttaacggtacccggtttaacgggtttacccggtttaacccccgttttaaacgggtttttcccggttttttttaacggtaaccccggttttaccccggggtttaccggggggtaaccccggttaaacccccggggggg

SEQ ID NO: 83483 - DNA, 690 bp, Homo sapiens
  misc_feature: GYAE6OF01DE7CV.4.29.C07.1.454.CMB.1.raw
  modified_base (336)..(336): a, c, t, g, unknown or other
  misc_feature (336)..(336): n is a, c, g, or t
tcagagcactgtagcacgaccggtgctcgatttagagtgctacgaagggaaaggggtgagagaggagtccagccctgggattttcaggtgtcttcatttggtgatcaggactgaacagagagaactcaccatggtagtttgggctgaactggtctttttcttgtggtacttaattttaaaagctgtccagtgtgaggtgcagctggttggagtcgtgggggaggcgttgggtccgaggggccggggggggtccctggacgtacctctccttgttcctcgtcctcgtggtattcctacctttatgtaattttgcctatggagtccgtcggggtcccnccaacgacctcccggaacgggaaggggcgtgggaggtcggtctacgtaagttcttagtgtcgtagggtggtacggtcactactactactacgcacgtaccgtccgtagggaacggtcccgtacacctatcctacagacgaactaactacccgaaagaaccctacccgtagtactctacgaacaaatacgaacacgcctaggaacgtacggacccggaaggaccgtaccggtacgttaattacgttaacgtaggtacgaaacgtaaaagtttcgttttagaacgtacgttagttcccgttaaccgtttagttttccgtttagacccgttccgggtacggggacccgtaacccggg

SEQ ID NO: 83484 - DNA, 615 bp, Homo sapiens
  misc_feature: GYAE6OF01DJKGC.4.29.C07.1.454.CMB.1.raw
  modified_base (263)..(263): a, c, t, g, unknown or other
  misc_feature (263)..(263): n is a, c, g, or t
  modified_base (366)..(366): a, c, t, g, unknown or other
  misc_feature (366)..(366): n is a, c, g, or t
  modified_base (425)..(425): a, c, t, g, unknown or other
  misc_feature (425)..(425): n is a, c, g, or t
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggtctttttcttgtggcttaattttaaaagctgtccagtgtgaggtgcagctgttggagtcgtgggggagtcgttggtccgagggcgggggggtccctgagactctcctgttcngcctctggattctacctttatagtaattttcgcctaatgagtcgtcgggtcccgccagacctccgacgggaaggggctaggaggtgggtctcaagtcttaggngtctagtggtgtcacacatactacgcagactccgaggaacgggtccggttacaaccgtntcctaccagaagacctaaacttacccaaagaaaccaccctagtactctagacaaatcgaaacacgcctggaacgcgacccggaaggaccgacggcctaatacttacgtgtaagactaaaagtgttttacgagctacggtcttacccgttaacgttcttttacgacccttcggtcgggccgtaaacccggg

SEQ ID NO: 83485 - DNA, 583 bp, Homo sapiens
  misc_feature: GYAE6OF01BH8P6.4.29.C07.1.454.CMB.1.raw
  modified_base (464)..(464): a, c, t, g, unknown or other
  misc_feature (464)..(464): n is a, c, g, or t
  modified_base (519)..(519): a, c, t, g, unknown or other
  misc_feature (519)..(519): n is a, c, g, or t
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggctttttcttgtggctattttaaaagctgtccagtgtgaggtgcagctgttggagtcgtgggggagcttggtccaggcgggggggtccctgagactctcctgttctgcctctggattcacctttatgtaattttgccatgagctgggtcccgccagacctccgacgggaaggggctggaggtgggtctcgaagtcttagtgctaggtggtgtcacacatactacgcagacctcgtaggaacggcccgttacaccatccaccagacgactaattacccaaagaaccacccttgtactctagactaaatcgaaacngcctggaagacgaccgaggaccgacggccgtatattacgtgtagaacaaaagttntttggagtcgtagttcgtacccttaagtttcttttacgaccgttccggtggggccctaacgggg

SEQ ID NO: 83486 - DNA, 639 bp, Homo sapiens
  misc_feature: GYAE6OF01B3TGG.4.29.C07.1.454.CMB.1.raw
  modified_base (431)..(431): a, c, t, g, unknown or other
  misc_feature (431)..(431): n is a, c, g, or t
  modified_base (555)..(555): a, c, t, g, unknown or other
  misc_feature (555)..(555): n is a, c, g, or t
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggctttttcttgtggctattttaaaagctgtccagtgtgaggtgcagctgttggagtcgtggggggaggcgttggtccgagggccggggggggtccctggagacctcctcctgtgcagcctcgtggttcaccgtcacttacacgccacagtggtaggttcggggtacccgccgacgggcctaccggagggggaacggggcgtgggaggtgggtctcgtagggttctacataacgatcggtactacatcgtactcacgactcgtggacgggccattccacctntcctaccgagacgtacaacttaccaaagtaactattaggtttactcttaacaaatgtaaatagacgtcggccgggaccgaggaccgaccggtccgtactacgtacgtggcggacgggagggggncgtaggtcgggcgttggttacgtttccggtttgggttccggtcggggacccgtaacgggtacccgttgggtcccgccgttcccg

SEQ ID NO: 83487 - DNA, 697 bp, Homo sapiens
  misc_feature: GYAE6OF01AKUSW.4.29.C07.1.454.CMB.1.raw
  modified_base (426)..(426): a, c, t, g, unknown or other
  misc_feature (426)..(426): n is a, c, g, or t
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggctttttcttgtggctattttaaaagctgtccagtgtgaggtgcagctgttggagtcgtgggggaggcttgggtccgagggccggggggggtccctggacgactctcctgttctgcctctggattcacctttatgtaattttgccatgagcgtcgggtcccgccagacctccgacgggaaggggcgtgggaggtgggtctacgaagtcttagtgctaggtggtcggtcacactatactacgcagactcccgtaggaaacgggtcccgttacacctntcctaccagaacgactaacttaccgaaagaacctaccctactactctacgaccaaatcgaaacgacgaccgtaggaaggtaaccggaccgggaacggaaccgtaaccgggtacccgttaacgttaacgtttaccgtaggttacgaaaccgttaaaaaggttagtttttaacggtaacgtacgttaacggttacccgtttaacccgtttaacggtttaccgttttttacggaacccgtttcccggtcgggggtacccggtaaaccccggggg

SEQ ID NO: 83488 - DNA, 613 bp, Homo sapiens
  misc_feature: GYAE6OF01DGDQP.4.29.C07.1.454.CMB.1.raw
  modified_base (542)..(542): a, c, t, g, unknown or other
  misc_feature (542)..(542): n is a, c, g, or t
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggctttttcttgtggctattttaaaagctgtccagtgtgaggtgcagctgttggagtcgtgggggaggcttggtccgaggcgggggggtccctgagactctcctgttctgcctctggattcacctttatgtaattttgccatgagcgtgggtccgccagacctccgacgggaaggggcgtgggaggtgggtcctctaaggtcttagtgctagtggtggtcacacatactacgcagactccggtagaacgggtccgttacacctatcctaccagaagaacaacttacccaagaaccctacccgtgtactctagactaaatgaacgacgacctgaagacgaccggacggaccgaccgggccgttaagttacttacgtagtagaccgtaaaagttnttttaggagtctaggttcgttacccttaagtttccgttttacgacgtttccggcgggtccgtaacccgggg

SEQ ID NO: 83489 - DNA, 692 bp, Homo sapiens
  misc_feature: GYAE6OF01CZMMN.4.29.C07.1.454.CMB.1.raw
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggctttttcttgtggcttattttaaaagctgtccagtgtgaggtgcagctgttggagtcgtgggggaggcttggtccgagggcgggggggtccctgagactctcctgttctgcctcgtggtattccaccttttatgtaattttgccatgagcgtcgggtccgcaggacctccgacgggaaggggctagggaggtgggtctacgtaaagttcgttaggtgtcgttaggtgggttggtaccaacgtaacaacttaacgtaacggactaacgacccgtccggtacggaacggggtcccggtttacacctactccgtaccaaggtaacgaactaaacttacccaaacgaaacctaccccgttagttactccgtagaacaaaatacgaaacacgaccgtaggaacggacggacccgggaggaaccgacgggaccgttaagtacttaacgtgtaacgaactaaaagttagttttagaagtacgtacgttccgttaaccctttaagtttccttttacggaccgtttcccgggtggggtccctaaccgggg

SEQ ID NO: 83490 - DNA, 631 bp, Homo sapiens
  misc_feature: GYAE6OF01BKUW8.4.29.C07.1.454.CMB.1.raw
  modified_base (309)..(309): a, c, t, g, unknown or other
  misc_feature (309)..(309): n is a, c, g, or t
  modified_base (479)..(479): a, c, t, g, unknown or other
  misc_feature (479)..(479): n is a, c, g, or t
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggctttttcttgtggctattttaaaagctgtccagtgtgaggtgcagctgttggagtcgtgggggaggcttggtccgagggcggggggggtccctggagactctcctgttctgcctctggattcacctttatgtaattttgcctatgagcgtgggtcccnccagacctccgacgggaaggggctgggagtgggtctacgaagttcttaggtgcgtaggtggtggtacacacatactacgcagacctccggtgaacggggtcccgttcacctatcctaccagacaacaattacccaaagaaccaccctgtactctagactaaatcgaaacncgacctagaacgacggacccgaagggaccacgggtaccttaatacttacgtgtacgtaactaaaagttgttttaggagtacgtaggttccgttaacccctttaagtttccttttaggaaccctttccgggtacggggcccgtaaaccggggg

SEQ ID NO: 83491 - DNA, 666 bp, Homo sapiens
  misc_feature: GYAE6OF01A27NA.4.29.C07.1.454.CMB.1.raw
  modified_base (431)..(431): a, c, t, g, unknown or other
  misc_feature (431)..(431): n is a, c, g, or t
  modified_base (447)..(447): a, c, t, g, unknown or other
  misc_feature (447)..(447): n is a, c, g, or t
  modified_base (450)..(450): a, c, t, g, unknown or other
  misc_feature (450)..(450): n is a, c, g, or t
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggtctttttcttgtggtcttaattttaaaagctgtccagtgtgaggtgcagctgttggagtcgtgggggagcgttggtccgagggccggggggggtccctggacgactccgtcctgttcctcgcctcgtggtattcctaccttttattgtaatttttcgcctagtgagtccgttcgggtcccgccaggaccgtcccgaacggggaaggggcgtgggaggttgggtctacgtaagttctttaggtgtcgttaggtggtgtcacacatactacgcagcctcggngaacggtccgtcactntcncagacactaactaccaacgaactacctagtactctagacaaatacgaactagcctaggacgacgaccggaacgggaccgacgggtaccgttaactacttacgtagtacgtaaacgtaaaagttacgttttaggtagtacgtaacggtttccgttacccgttaacgttttcctttttacggacccgtttccgggtcgggtacccggtaaacccgggg

SEQ ID NO: 83492 - DNA, 857 bp, Homo sapiens
  misc_feature: GYAE6OF01ENQPL.4.29.C07.1.454.CMB.1.raw
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggtctttttcttgtggacttaattttaaaagctgtccagtgtgaggtgcagctggttggagtagtggggggagcgttggtccgagggccggggggggtccctggacgtacctcctccttgttcctcgtcctcgtggtactttacctaaccttttatagtaactttttcggacctagttggacggtccgtcggggtcccccgaccaacggtacccgtacccggaaacgggggtaacgggggccgttaggggtacgggttcggggttacctacgtaacggtttcgtttaaggtcggtacgttagggtgggttcggtaccgaactaacgtactaaccgtacgactaacgtaccgtacccgggtaggaaaccggggtcccgttaccaacccgtactaccgtacccgaaaggaacgtaaccttaaaccgttaacccgaaaacgtaaccccgttaacccgttacgttaacttaccgtagtaaaccgaaaagttacgaaaccgtacgtaccgtaggaacggaccggaacccggaagggtaacccgaccgggtaccgttaacttaacgtttaacgtcgtaacggtaaacgtaaaaggtttcgttttacggtaagtaccgttaacggttaccgtttaaccccgttttaaacggtttttccgtttttaccggacccggtttccgggttaacccgggggtcccgtaaaacccccggggg

SEQ ID NO: 83493 - DNA, 695 bp, Homo sapiens
  misc_feature: GYAE6OF01CFLEH.4.29.C07.1.454.CMB.1.raw
  modified_base (261)..(261): a, c, t, g, unknown or other
  misc_feature (261)..(261): n is a, c, g, or t
  modified_base (271)..(271): a, c, t, g, unknown or other
  misc_feature (271)..(271): n is a, c, g, or t
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggctttttcttgtggctattttaaaagctgtccagtgtgaggtgcagctgttggagtcgtgggggaggcttggtccgagggccgggggggtccctggagactctcctgttcngcctctggtnttctaccttttatgtaattttgcctattgagcgtcgggtcccgccagaccgtccgacgggaaggggctgggagtgggtctacgaagttcttagtgtctagtggtgtcacacatctacgcagacgtcggtaggaacgggtcccgttcaacctactcctaccgagaacgaactaaacttaaccccaaacgtaacccaacccgttacgtactcgtaacgtacaaatacgaaaccacgtccctaggaacggacggacccggaagggaccgaccgggtaccgttagttaacgttacgttagtacggtaaactaaaagttagtttttacggtaagtccgttaacggttaccgttaccccgttttaaagttttccggtttttacgttaacccgtttcccgggttaccgggggtacccggtaaacccggggg

SEQ ID NO: 83494 - DNA, 767 bp, Homo sapiens
  misc_feature: GYAE6OF01DFYXY.4.29.C07.1.454.CMB.1.raw
tcagagcactgtagcacgaccggtgctcgatttagagtgctacgaagggaaaggggtgagagaggagtccagccctgggattttcaggtgtcttctatttggtgatcaggactgaacagagagaactcaccagtggagttgggctgaactggtcttttctgtggcttaatttaaagctgtccagtgtggaggtgcagtcgttggttgggaggtcggtgggggacggtcgtttcgggtccggacgggggtccgggggggttccctggacgtacctccgttccgttagttccgtcgtacccttcgtacggtactttccgttaaccttttaggtacgttaacgttttcgacctagttacggacgtccggttccgggtaccccgaccgtacggtacccgtaccgggaacggggaacggggtcgtaggggtacggttcgggtaccttacgtaaggttccgttaggtcgtacggtggtacgggttacggtaccgaccaacttagtaccgtacggacctacgtaccgtccggtaggaaccggtcgtaccactctccgaacagaacaacctaacgtacccaaacgaacctccgtagtacgtactacgaactaagtcgaaacgtcgtaccgagacgaacgcccggaagccgtaccggttaacttagtacttcggtaatacgtaaacgtaaagtttcgtttcggagttacgttagttaccccgttacgttaacgttttcgtttacggacccgtttcgggccggtaccgtaacccggg

SEQ ID NO: 83495 - DNA, 756 bp, Homo sapiens
  misc_feature: GYAE6OF01CDZD0.4.29.C07.1.454.CMB.1.raw
tcagagcactgtagcacgaccggtgctcgatttagagtgctacgaagggaaaggggtgagagaggagtccagccctgggattttcaggtgtcttcatttggtgatcaggactgaacagagagaactcaccatggtagttgggctgaactggtctttttcttgtggtcttaattttaaaagctgtccagtgtgaggtgcagctggttggaggtcggtgggggaggtcgttgggtccgaggggtccggggggggtccctggagtacctccgttccgttgttccgtcgccttcgtggtacttcgtacgtttacgaccaacctaatccgtacccgtggtacggttccggtcccgcgacggtcgtaccggaggggacgggtcgtgggacggttcgggcgcgaggctagtcgtaggtaggtaggtaggtaaagttagtaagtttaaacgacgtagtactacgacgtacgtactcgtggtacggtacgggacctacgtaccacctactcctaccgacgaactaaccgtaactactaagtaccgaacctaccttagtactctacgtaacaacgtaacaacgaacgtacgtacgaacggaccgtaacgggaacggtaccggtaaccgggtaccttaccgttaaaccgtaccgtacgggaaccggtaaagggtaaaacggtagggttaaaccgggggtacgggggtaacccttaaaccggttaggtttaccggtttacggtttaacggttaggtttaaaccggggg

SEQ ID NO: 83496 - DNA, 780 bp, Homo sapiens
  misc_feature: GYAE6OF01D2N73.4.29.C07.1.454.CMB.1.raw
tcagagcactgtagcacgaccggtgctcgatttagagtgctacgaaagggaaaggggtgagagaggagtccagccctgggattttcaggtgtcttcatttggtgatcaggactgaacagagagaactcaccatggagtttgggctgaactggtctttttcttgtggcttaattttaaaagctgtccagtgtgaggtgcagctggttggagtcgtgggggaggcttggtccgagggccgggggggtcctgagactctcctgttctgcctcgtggtattctacctttatgtaattttcgcctatgagtcgtgggtcccgccagacctccgacgggaaggggctgggagtcgggtctacgtaaggttcttaggtcgtcttaggtgggtcgtacaacgactaagtaactaccgcaacgtaccgtcccggtaagggaaccggggtccccggtttaccaacccgtacgttcccgttacccgaacggaaacgtaaccctaaaaccgtttaccccgaaaaacgaaccctaaccccgttagttaacttaccgtagaacctaaaagttacgaaacacggcctaaggaacgggaacgaccgggaacgggtaccgaaccgggtacccgttaaatttacgttaacgtacggtacgtaaacgttaaaaaggttacgtttttacgggtaagttacgtaacggtttacccggtttaaccccgtttaaacgttttccgttttttaaccggaacccgtttcccggggttaaccggggtaccccggtaaaccccggggg

SEQ ID NO: 83497 - DNA, 648 bp, Homo sapiens
  misc_feature: GYAE6OF01CLB6A.4.29.C07.1.454.CMB.1.raw
  modified_base (299)..(299): a, c, t, g, unknown or other
  misc_feature (299)..(299): n is a, c, g, or t
  modified_base (346)..(346): a, c, t, g, unknown or other
  misc_feature (346)..(346): n is a, c, g, or t
tcagagcactgtagcacgaccggtgctcgatttagagtgctacgaagggaaaggggtgagagaggagtccagccctgggattttcaggtgtcttcatttggtgatcaggactgaacagagagaactcaccatggagtttggctgaactggctttttcttgtggctattttaaaagctgtccagtgtgaggtgcagctgttggagtctgggggagcgtggtccaggcgggggggtccctgagactctcctgttctgcctctggattcacctttatgaattttgccatgagcgtgggtccnccgaggactccgacgggaagggctggagtgggtctacaagtcttagngctaggtggtcggtacaacactatactaccgctagaccgtccggtaggaaacgggcccggttacacccgtatacctacccagaagaactaaacttaccaaagaaccaaccccttagttaactctggaacaaaagttacgaaacacgaccgttacgaaacggaacgggaccggaaacgggaacccgtaaccgggtacccgttaattaacgttacgttaggtacgaaacctaaaaagttacgtttagtagaccgtagttcgtacccgttagttcttttacgaacttccgtgggcccgtaacggg

SEQ ID NO: 83498 - DNA, 725 bp, Homo sapiens
  misc_feature: GYAE6OF01AKPE6.4.29.C07.1.454.CMB.1.raw
  modified_base (473)..(473): a, c, t, g, unknown or other
  misc_feature (473)..(473): n is a, c, g, or t
  modified_base (517)..(517): a, c, t, g, unknown or other
  misc_feature (517)..(517): n is a, c, g, or t
tcagagcactgtagcacgaccggtgctcgatttagagtgctacgaagggaaaggggtgagagaggagtccagccctgggattttcaggtgtcttcatttggtgatcaggactgaacagagagaactcaccatggagtttggctgactggctttttcttgtggctattttaaaagctgtccagtgtgaggtgcagctgttggagtcgtgggggaggtcttggtccgagggccgggggggggttcccctggacgtacgttccttccgttgtttcctcgtcccttcgttgggtactttcctacccttttagttgttaatttttcggcctagtgaggccgttcgggtccccgcccgagtaccgtacccgacggggaaggggtcctagggaggtggtctacgtagtcttagtgctaggtggtgtcacacatacctacgcagacgtccgtaggaacgggtccgtcaccatcctacaganacaacttaccaagaccacctgtactctgaactaaatcgaacacnccgtaggacggacggaccggaacggaccgtacgggtacccgttaattacgtttaccgaggttacgtaaacgtaaaaacggttgtttttaacggaacgttacggttaacggttacccggttttaaccccgtttaacggtttttaccggtttttttaccggaaccctttcccggggtttaccgggggtacccccggttaaaccccggggg

SEQ ID NO: 83499 - DNA, 878 bp, Homo sapiens
  misc_feature: GYAE6OF01C6P2T.4.29.C07.1.454.CMB.1.raw
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggtcttttcttgtggtcttaattttaaaagctgtccagtgtgaggtgcagctggttggagtcgtgggggagtcgttggtccgagggccggggggtccctgagcctctcctgtcgcacgtcctcgttggtattcctaccggttttagcccaacctaaagtcgtccccgtggtaaggttcggggtcccgaccgacgggccttaccggagggggtaacggggccgtaggggaggttcggggtccgacgacgggcctagtccgtaaggttgggtaagtaggtaaagttgtaaagttttaaacgacgtaagtaccgtacgacgaggtaacctcggtaggttacgggacggggtcccgaacgttacccaacccgtaacgttccgtacccgaaggtaccgaaacttaaaccgttcccaacgttaaccgtaaacccgtaaccccgttaggttaactttccgttaacggtaaccgtaaaagttaaccgaaaaccgtaaccggtaaacgttacggaaacgggtaaccgggaaccccggggtaaggtaaacccggtaacccggggtaacccgtttaaaacgttaaacccggttacccgtacggggtaacccggtaaacccgggtaaaaaagggtaaaccgggttttaaaacgggggggtacccggggggttaaaacccgtttaaacccggtaacggttttaaccgggttcccggttttttaagggtttaaaaacccgggg

SEQ ID NO: 83500 - DNA, 843 bp, Homo sapiens
  misc_feature: GYAE6OF01D6R9V.4.29.C07.1.454.CMB.1.raw
tcagagcactgtagcacgaccggtgctcgatttagagtgctacgaagggaaaggggtgagagaggagtccagccctgggtattttcaggtgtcttcatttggtgatcaggactgaacagagagaactcaccagtggtagtttgggctgaactggtctttttcttgtggtcttaattttaaaagctgtcagtgtgaggtgcagctgttggagtcgtggggagtcgttggtccgaggggtccgggggggtccctggacgtaccttccgtccgttggttcctcgtcccttcgttcggtatttcccgtactttttaatgttaactttttcgacctagtaggacgtccggttcggggtaccccgccgaacggtacccgtaccggaacggggtaaacgggggccgttaggggtaaggttcggggtaccttacgtaaaaggtttcgtttaacgggttcgttaccgttaagggttgggttacggttaccaaccgaacctaacgttaaccgtaccgactaacggtaccgtttaccgggacggtaaacggggtcccgtttaaccaacccgtacttcccgtaccgaaggtaaccgtaacctaaactttacccaaaacgtaaccctacccgttactacgttactagtaacctaaagtacgaacacgtccgtaaggacgacggaccggaacgggtaccgaaccgggtacttaacttaacgttacgtaggttaacgtaaagtaaaagtttcgttttaggtacgtacgttaaaggttacccgtttaaccgttttaacggttttccgtttttaacgaacccggttttcccgggtaccggggtaccgttaaaccccgggg

SEQ ID NO: 83501 - DNA, 806 bp, Homo sapiens
  misc_feature: GYAE6OF01BDJS4.4.29.C07.1.454.CMB.1.raw
tcagagcactgtagcacgaccggtgctcgatttagagtgctacgaagggaaaggggtgagagaggagtccagccctgggattttcaggtgtcttctatttggtgatcaggactgaacagagagaactcaccagtggtaggtttgggctgtaacgttggttcttttttcgttggtggtactttaattttaaaaagtcttgtcctagttggtaggaggtgctagtcgttggttgggacggttcggtggggggaggtcgtttcgggtaccggacgggggtccggggggggttccctgggacgtaccttccgtccgttcgttcgtcgtcctcgtggtacttcctactttattgttaactttcgacctagtacggtacggtcgtccggggtacccgaccgtaacggtaccgtaccgggaaccgggggaaggggtccggtagggtacggttgggtactacgtaacgttcgttaggtgtcggtaggttggtcgtacgactactaactacgtacgacacggtaccgtacggacggtacggtcccgtacacctacgtccacgagaacacttaactaaccgaaacgtacctacccgtgtactcgtaacaacgtaacgtacgaaccgacgtaccgaggaacgacgggaccgtaacgggacctaccgggttaacttaacgttacttacgtaacgtacttaaaaacggttaaacgttttgttaacggtactaccggtttaagttcccgttaaaccgttttacggttttcgtttcccggtaaccggtcccgggttaaccggggacccggttaaacccggg

SEQ ID NO: 83502 - DNA, 882 bp, Homo sapiens
  misc_feature: GYAE6OF01CJ0YP.4.29.C07.1.454.CMB.1.raw
tcagagcactgtagcacgaccggtgctcgatttagagtgctacgaagggaaaggggtgagagaggagtccagccctgggattttcaggtgtcttcatttggtgatcaggactgaacagagagactcaccatggagttggctgaactggtcttttcttgtggtacttaatttaaagctgtccagtgtgaggtgcagcgtggttggacggtcggtgggggacgtcgttcgggtccgacggggccgggggggtcccctaggacgtaccgtcgttccgttgttccgtcgtccgttcgtggtacctttccttaaccgtttattaggttaacgttttcgacccgtaagtcggtacggccggttccgggtcccggacccgtaacggaaccgtacccgggaacgggtaacggggccgtaggggtaacggttcgggtacgttaccgtaagttaccgtttaggtacggtacgttaagggttcgggttacggtacctaacgtacccgttaacgttaacccgaaccgtaccgtaaacggtaccggtttacccgggtaaagggtaaaccccggggtcccgtttaacccaaccgtacttacccgttaccgaacggtaaaccgtaaaccgtaaacttaaccccgaaaaccgtaaacccgtaacccgttagtaaccttacgtacgaaacgtaaactaacgaaactacggtaaccgacgaaacggacccggtacggaaccgggaccgtaaccggtaccgtaattaacttacgtaacggtaagaaccgttaaaagtttaggtttacgaagtaccgttcgtttaaccggttacccgtttaacgtttcccgttttaaacggacccggttttcccgggacggggttaaccccgtaacccgggg

SEQ ID NO: 83503 - DNA, 734 bp, Homo sapiens
  misc_feature: GYAE6OF01EQ2MC.4.29.C07.1.454.CMB.1.raw
  modified_base (550)..(550): a, c, t, g, unknown or other
  misc_feature (550)..(550): n is a, c, g, or t
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggtctttttcttgtggacttaattttaaagctgtccagtgtgaggtgcagcttgtggagtcggtgggggacgtcgttggtccgagggtccggggggggtcctggacgtaccttcctccttgttctgtcctcgtggtacttcctacctttatagtaatttcgcctagtggacgtcgtcgggtcccgaccgacgaccgtccggaacggggaagggtcgtgggaggtcgggtactacgtaagttcgttagtcgtacgttagggtggttacggtacacctaactaactaccgtacgacaacgtaccgtaccgggacgggtaacgggtcccgttacacctacgtccaccgaacgaacgtaactaaaccgttaccgaaacgtaaccctacctacggtactcggtaanactaaactagaaacctacgacctaggaacgacgaccggacgtacgtaccggtaccgttaattacgttaacgtggtaaacgtaagttaaaagttcgttttaggactacgtaccgttacgttaaccccgtttaacgtttccgttttacgtacccggttacccgggtcggggtccggtaacccgggg

SEQ ID NO: 83504 - DNA, 895 bp, Homo sapiens
  misc_feature: GYAE6OF01BRJDH.4.29.C07.1.454.CMB.1.raw
  modified_base (792)..(792): a, c, t, g, unknown or other
  misc_feature (792)..(792): n is a, c, g, or t
tcagagcactgtagcacgaccggtgctcgatttagagtgctacgaagggaaaggggtgagagaggagtccagccctgggattttcaggtgtcttcatttggtgatcaggactgaacagagagaactcaccagtaggtagtttgggctgaactggtctttttctgtggcttatttaaagctatccagtgtgaggtgcgagtcgttaggttggtacggttcggtgggggggacggtcgtttcggggtaccggaacggggtcccggggggggtaccctggtaacgtaccgttcccgttccgtttcgttcctcgtcccgtacgttcggaacttttaccgtaaaccttttacgttacgtttaacttttcggacctaacgttcggacggtccggttacggggtcccccgtaccgtaacggtaacccggttaccgggaaccgggggtaaacggggtccggtacgggggtaacggtttcggggtacccttacgttaaacggtttcgtttaacggtcgtaccgttagggttacggggtcggtacctaacgtaacgtaacgtaacgtaacccggtccgtaaacggtacccgttacggggtacgggtaacccggggtacccgttaaccacccgttaccgtccgtacgtaaacgaacggttactaaacgttaaccccaaaagtacccgtaccttacgtaacgtacctaacggaacttaaagacgtaacccacggttccgtaaggaacccgacggaccggaaccgggtacgaaccggttactttaatacgttaccgtacggtaanaaaccgtttaaagtaagtttcgaccgttacgtacgtttacccgttaactttcggttttactacccggttaccgttccgggtaccgggtcggtaacccccgggg

SEQ ID NO: 83505 - DNA, 699 bp, Homo sapiens
  misc_feature: GYAE6OF01D6JY5.4.29.C07.1.454.CMB.1.raw
  modified_base (196)..(196): a, c, t, g, unknown or other
  misc_feature (196)..(196): n is a, c, g, or t
  modified_base (302)..(302): a, c, t, g, unknown or other
  misc_feature (302)..(302): n is a, c, g, or t
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggtctttttcttgtggcttaattttaaaagctgtccagtgtgaggtncagtctgttggagtcgtgggggagtcgttggtccgagggccgggggggtccctgagaccttctccgtgttctgcctcgtggtacttctacctttatgtaattttcnccatgagcgtcgggtccgccagacctaccggacgggaacggggcctagggaggtcgggtctacgtaaagttcttagtgacgttaggtggtcggtaccactacagtacgtacgacacgtaccctcgggtaggaaccggggtccggttacaaccctactccgtaccaaggaactaacaactttacccgaaacgaacctacccttagtactccgtagaacctaaatacgaaaccgacgtaccagggaacgacggaaccggacgggaccgaaccgggtacccttaagttaacgtttacgagtacgaaagtaaagtttgtttaaggtaagtcgttaacgttaccgttaccttaacggttttctttaccgtacgttcccggtagggggtccctaaacccgggg

SEQ ID NO: 83506 - DNA, 881 bp, Homo sapiens
  misc_feature: GYAE6OF01CF0GW.4.29.C07.1.454.CMB.1.raw
  modified_base (738)..(738): a, c, t, g, unknown or other
  misc_feature (738)..(738): n is a, c, g, or t
tcagagcactgtagcacgaccggtgctcgatttagagtgctacgaagggaaaggggtgagagaggagtccagccctgggtattttcaggtgtcttctatttggtgatcaggactgaacagagagaactcaccagtggtaggtttgggctgaacgttggttctttttcgttggtggtactttaattttaaaagctcgtccgtagtggtgaggtgacagtcgttaggttgggaggtcgggtggggggtacggtcggtttcgggtaccggacgggggtcccggggggggttccctacgggacggtaccttccgttccgtttcgtttccgttcgtcccgttacgttaggttaccttttacccttaaccgtttttagttaagtttaacgttttcggtacctaagttacggtacggtccggttaccggggtcccggaccgtaacggtaccccggtaaccgggaacgggggtaacggggtacggtggggtaacgggtttcgggtaccgttacgttaacggtttaccgtttaggtacggttacggttacgggttacgggttcggtaacctaactaacgttaacgtaaccgtaccgaccgtaacggtacccggttaccgggtaacggggtaaccgggttcccgtaacctaccgtacgttacccgtacgaaggtaaccgtaacctaacgtaaacccgtaaacgaacccttaccgttagttacctacgtacgaaactaacgacgaaacncggtacaggaacgacggaccggaaggtaccgagtaaccgttattaccgtagtcggtaacaaagtttaagttcgttaggactacggttacgttacccgttactttacgtttcttacggcccgttacgggcggacccgtacccgg

SEQ ID NO: 83507 - DNA, 877 bp, Homo sapiens
  misc_feature: GYAE6OF01EUX06.4.29.C07.1.454.CMB.1.raw
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgactggtctttttctgtggcttatttaaagctgtcagtgtgaggtgcagcgttggttggaggttcggtggggggtaggtcgtttcgggtccggaggggtccgggggggggttccctaggacgtaccgttccttcccgttcgtttccgtcgtccccgttcgttacgggtactttaccttaaccttttagttacggtttaactttttcgacctagttcggtacggtccggttcggggtccccgaccgtaacggtacccgtacccgggaacgggggaacggggtcggtaggggtacggttcggggtacctacggtaagtttcgtttaaggtcgtacggttagggttggttcggtacctaacgtaactaacgttaaccgtaaccggtaccgaacggtacccgttacccgggtaacgggtaaccgggggtacccgttacccaaccgtaacgttcccgtaccgaaacggactaaacctaaaccgttaacccgaaaacgtaacccctaacccgtttagtacctacggttacaactaaaacgtacgaaaccgcgtaccgtaggaacggccggtaccggaacgggtacccgtaccgggtacctttaagttacgtttacgtaggtaacgtaaacgtaaaaggtttacgttttaggtaacgtgtaacgtttccgtttaacccgtttaagttttccgttttacggacccgtttcggggtaacccgggtcccggttaacccggggg

SEQ ID NO: 83508 - DNA, 883 bp, Homo sapiens
  misc_feature: GYAE6OF01A6743.4.29.C07.1.454.CMB.1.raw
tcagagcactgtagcacgaccggtgctcgatttagagtgctacgaagggaaaggggtgagagaggagtccagccctgggtattttcaggtgtcttcatttggtgatcaggactgaacagagagaactcaccatggagtttggctgaactggtctttttctgtggcttaattttaaagctgtccagtgtgaggtgcagctgttggagtcgtgggggagtcgttggtccgaggggtccgggggggtccctaggacgtaccttccttccgttgttccgtacgtcccttcgtaggtactttccctaacctttttagtagttaaactttttcgaccgtagtacggacgtccggttcggggtccccgacccgaagtacccgttacccggaacgggggtaacggggtccgtaggggtacggttcggggtaccttacgtaagtttccggtttaggtcggtacgttacgggttacgggttacggtaccgtaaacctaactaaacgttaaccccgttaacgggaacctaacgggttaaccccggttacccgggtttaaggggtaaaccccgggggttcccggttaacccaaccccgttaaccgtttcccgtaacccgaaacggaacgtaaacccttaaaccgttaaccccgaaaacggtaacccctacccgtttaggtaccttacggttacgaaactaaacgttacgaaacttaccggaccgtaacggaacggaccggaacccggtaaacgggaacccggtaccgggttaccttaaagttaccgttaagtaccgagtaaaccgtaaaagtttcgtttacgagtacgttagttacccgttaccttacggtttacgttttacgacccgttccggtagggtcccggtaacccgggg

SEQ ID NO: 83509 - DNA, 537 bp, Homo sapiens
  misc_feature: GYAE6OF02IIKA8.4.29.C07.1.454.CMB.1.raw
  modified_base (298)..(298): a, c, t, g, unknown or other
  misc_feature (298)..(298): n is a, c, g, or t
  modified_base (357)..(357): a, c, t, g, unknown or other
  misc_feature (357)..(357): n is a, c, g, or t
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggctttttcttgtggctattttaaaagctgtccagtgtgaggtgcagctgttggagtctgggggagcttggtccagcgggggggtccctgagactctcctgttctgcctctggattcacctttatgaattttgccatgagctgggtccncagactccgacggaaggggctggagtgggtctcaagtcttagtgctagtggtgtcacanatactacgcagactccgtgaagggccgttcaccatctccagagacaattcaagaacaccctgtactctgacaaatagaacagctgagagcgagacacggccgtatattactgtgacaaagtattttgtagctagtcgtaccctaagttctttttagactccgtcggggtacctaaccggg

SEQ ID NO: 83510 - DNA, 540 bp, Homo sapiens
  misc_feature: GYAE6OF02GMH0C.4.29.C07.1.454.CMB.1.raw
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggctttttcttgtggctattttaaaagctgtccagtgtgaggtgcagctgttggagtctgggggagcttggtccagcggggggggtccctgagactctcctgttaactgcctctggattcacctttatgaattttgccatgagctgggtccgccagactccacggaaggggctggagtgggtctcaagtcttagtgctagtggtggtcacacatactacgcagactccgtgaagggccggttcaccatctccagagacaattccaaagaaccaccctgtactctgacaaatgaacagcctgagagccgaggacacggcctatattactgtgacaaagtatttagagtcagttcgtcccttaagttcttttagactccgtgggcctaacggg

SEQ ID NO: 83511 - DNA, 561 bp, Homo sapiens
  misc_feature: GYAE6OF02GLGHP.4.29.C07.1.454.CMB.1.raw
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggctttttcttgtggctattttaaaagctgtccagtgtgaggtgcagctgttggagtctgggggaggcttggtccagcggggggggtccctgagactctcctgttctgcctctggattcacctttatgaattttgccatgagctgggtccgccagactccacggaaggggctggagtgggtctcaagtcttagtgctagtggtggtcacacatactacgcagactcgtgaagggccgttcaccatctccagagacaattccaagaacaccctgtatctgacaaatgaacagcctgagagccgaggacgacggccgtatattactgtagactaaaagtattttagtagtcgtaggttacgttacccgttaagttcctttttacgaccgtttccgttcggggccctaaccgggg

SEQ ID NO: 83512 - DNA, 583 bp, Homo sapiens
  misc_feature: GYAE6OF02F6XO7.4.29.C07.1.454.CMB.1.raw
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggctttttcttgtggctattttaaaagctgtccagtgtgaggtgcagctgttggagtctgggggaggcttggtccaggcggggggggtccctggagactctcctgttctgcctctggattcacctttatgtaattttgccatgagctgggtccgccagacctccgacggaaggggctgggagtgggtctcaagtcttagtgctaggtggtggtcacacatactacgcagactccgtagaacgggcccggttcaccctatcctaccagacgactaacttaccaaacgaaccaccctgtactctgacaaatcgaacacgacctgagacgccgaggaccacgggcctaagtattacgtgtagactaaagtagttttagagtactagttcgtacccttaagttctttttacgaccttccggtgggacccgtaacgggg

SEQ ID NO: 83513 - DNA, 549 bp, Homo sapiens
  misc_feature: GYAE6OF02IR9CI.4.29.C07.1.454.CMB.1.raw
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggctttttcttgtggctattttaaaagctgtccagtgtgaggtgcagctgttggagtctgggggaggcttggtccagcggggggggtccctgagactctcctgttctgcctctggattcacctttatgaattttgccatgagctgggtccgccagactccacggaaggggctggagtgggtctcaagtcttagtgctagtggtggtcacacatactacgcagactccgtgaagggccggttcaccatctccagagacaattccaagaacaccctgtatctgacaaatgaacagcctgagagccgagacacggccgtatacttactgtagacaaagtagttttgacgtctagtcgtacccttaagttctttttagaccttccgtcggggccctaaccgggg

SEQ ID NO: 83514 - DNA, 555 bp, Homo sapiens
  misc_feature: GYAE6OF02JDZE2.4.29.C07.1.454.CMB.1.raw
  modified_base (300)..(300): a, c, t, g, unknown or other
  misc_feature (300)..(300): n is a, c, g, or t
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggctttttcttgtggctattttaaaagctgtccagtgtgaggtgcagctgttggagtctgggggaggcttggtccagcggggggggtccctgagactctcctgttctgcctctggattcacctttatgaattttgccatgagctgggtccnccagactccgacggaaggggctgggagtgggtctcaagtcttagtgctagtggtggtcacacatactacgcagactccgtgaacgggcccggttacaccatcctaccagagacaattaccaaagaaccaccctgtatctgacaaatgaaacagcctgagacgccgagacgacggccgtaatacttacgtgtgactaaagtattttgtagactagtcttaccctagtttcttttcgacttccgtgggcctaacggg

SEQ ID NO: 83515 - DNA, 560 bp, Homo sapiens
  misc_feature: GYAE6OF02IKZDN.4.29.C07.1.454.CMB.1.raw
  modified_base (449)..(449): a, c, t, g, unknown or other
  misc_feature (449)..(449): n is a, c, g, or t
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggctttttcttgtggctattttaaaagctgtccagtgtgaggtgcagctgttggagtctgggggaggcttggtccaggcggggggggtccctgagactctcctgttctgcctctggattcacctttatgaattttgccatgagctgggtccgccagactccacgggaaggggctgggagtgggtctcaagtctttagtgctagtggtggtcacacatactacgcagacctccgtagaagggccgttcaccatcctcagagaacaattacaaagaacaccctgtatctgacaaatgaacancctgagagccgagacacggcctatattactgtagacaaagtgtttagtacgtactagttacgttaccctaaggtttcttttaggaccttccgtggggacccgtaaccgggg

SEQ ID NO: 83516 - DNA, 727 bp, Homo sapiens
  misc_feature: GYAE6OF02HHMRA.4.29.C07.1.454.CMB.1.raw
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggctttttcttgtggctattttaaaagctgtccagtgtgaggtgcagctgttggagtcgtgggggagcttgggtccaggcggggggggtccctggagactctcctgttctgcctctggattcacctttatgtaattttgccatgagctgggtcccgcagactccgacggaaggggctggagtgggtctcgaagtcttagtgctagtggtggtcacacatactacgcagacctccgtagaacgggtcccggttacaccgtaactccgtaccgaggaacgaacctaaactttacccaaaaacggaaaccctaacccccgttagggttaacttccgtacggtaacctaaaaagtcggaaaaacctaacggcccttaagggaaacggtaacggacccggaaagggtaacccgaacccggggtacccgttaaagtttaacgtttaaaccgttggtaacgtaaccgtaaaaaaggttcgttttttaggaaacgtccgtaaggttacccggtttaccccttaaaggtttttcccgtttttagaacccgttacccggtttacgggggaccccttaaacccgggggg

SEQ ID NO: 83517 - DNA, 582 bp, Homo sapiens
  misc_feature: GYAE6OF02FVO0J.4.29.C07.1.454.CMB.1.raw
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggctttttcttgtggctattttaaagctgtccagtgtgaggtgcagctgttggagtctgggggaggcttggtccaggcggggggggtccctgagactctcctgttctgcctctggattcacctttatgtaattttgccatgagctgggtcccgccagactccgacgggaaggggctgggagtgggtctcgagtcttagtgctagtggtggtcacacatactacgcagactcgtagaacgggccgttcaccatctaccagagactaactaccaaagaaccaccctgtactctacgacaaatcgaacacgacctagagacgccgaggaccgacggaccgtaatacttagtcgtagacaaagtagtttagtagcgtagttcgtacccgttaagtttcctttttacgaccgttccgttacggggaccgtaaccgggg

SEQ ID NO: 83518 - DNA, 808 bp, Homo sapiens
  misc_feature: GYAE6OF02I1JSS.4.29.C07.1.454.CMB.1.raw
  modified_base (657)..(657): a, c, t, g, unknown or other
  misc_feature (657)..(657): n is a, c, g, or t
tcagagcactgtagcacgaccggtgctcgatttagagtgctacgaagggaaaggggtggagagaggagtccacgcccgtgggtattttcgaggtgtcttctagtttggtgatcgaggactgaacagagagaactcaccagtggtagtttgggctgaacgtggttctttttcgttgtggtacttaagttttaaaagctgtccagtgtgaggtgcagctgttggagtcggtgggggacggtcgttggtccgaggggtccgggggggtcctggacgtacgtcctccgttcgtttcgtcgtccttcgtaggtacttcctaccgtttagtgttaacgttttgacctagttgacggtcggttcggggtccccgccgaacggtaccgtaccggaacgggtaacggggtccgttagggaggtcggggttacctacgtaaacggtttcgttaaggtcggtacgttagggttcggggtcggttaccaaccgtaactacgttaaaccggtaccggtacgtaaacggtaccgttacccgggtaaggggaaacccggggtcccggtttaccaaccggtacttccgtaacccgaaggaaccgtaacgtaaacttaaccgaaacgtaaacccgtacccgttagtactcgttacgaacctaaaagtcgaaacncgtaccgtagacgacggaccgtacgaaccgacggtacgtaacttaagtaccgtagttacgaataaagtttctttaaggacgtctaacggttccttacccgttaagtttccgttttacgacggttacccgttacggggaccgttaacccggg

SEQ ID NO: 83519 - DNA, 584 bp, Homo sapiens
  misc_feature: GYAE6OF02F8XD0.4.29.C07.1.454.CMB.1.raw
  modified_base (303)..(303): a, c, t, g, unknown or other
  misc_feature (303)..(303): n is a, c, g, or t
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggctttttcttgtggctattttaaaagctgtccagtgtgaggtgcagctgttggagtctgggggaggcttggtccgaggcggggggggtccctgagactctcctgttctgcctctggattcacctttatgtaattttgccatgagctgggtccnccagacctccgacggaaggggctgggagtgggtctcgaagttcttagtgctagtggtggtcacacatactacgcagactccggtagaacgggtcccgttacacctatctccagacgacaacttccaaagaaccaccctgtactctagacaaatacgaacacgcctgagacgccgaggacacggccgtaatacttactgtagacgaaagtagttttggagtacgtagttcgttacccgttaagttctttttacgaccttccggtcggggaccctaaccgggg

SEQ ID NO: 83520 - DNA, 761 bp, Homo sapiens
  misc_feature: GYAE6OF02IRMH7.4.29.C07.1.454.CMB.1.raw
tcagagcactgtagcacgaccggtgctcgatttagagtgctacgaagggaaaggggtgagagaggagtccagccctgggattttcaggtgtcttcatttggtgatcaggactgaacagagagaactcaccatggagttggctgactggcttttctgtgctatttaaagctgtccagtgtgaggtgcagctgttggagtcgtgggggaggtcgttgggtccgagggccggggggggtccctggaggactccgtccgtgttctgcctcgtggtacttcctacctttatgttaattttcgacctatgagtctcgggtccgtaccacgacctaccgacgggaacgggtcgtggaggtcgggtacctacgtaaagttcgttaagttcggacgttaagggttggtcggtaccaacgtacgaacttaacgtaccgcgaaggtaaccgtccggtaagggaaccgggtccgttaccaacctactacctaccgaagacgaacctaaacgttaccgaaaacgtaaaccctaacccgttagtaacttaccgtaacgtaaaccgtaaaacgtaacgaaaccgtaacgtacccgtaaggaaccggtacggaacccggaacggtaaaccggaaccgggtacccgtaagttaaacgttacgtagtaacgtactaaaaaggttacgttttaggtaacgtactaacggttcgttaacccgttaaaggttttccttttaacgggtacccttaccgggtccgggtaacccggtaacccggg

SEQ ID NO: 83521 - DNA, 922 bp, Homo sapiens
  misc_feature: GYAE6OF02HJMIU.4.29.C07.1.454.CMB.1.raw
tcagagcactgtagcacgaccggtgctcgatttagagtgctacgaagggaaagggtgagagaggagtccagccctgggattttcacggtgtcttcatttggtgatcaggactgaacagagagaactcaccatggagtttgggctgaactggctttttcttgtggctattttaaaagctgtccagtgtgaggtgcagctgttggagtcgtgggggagcttggtccgaggcgggggggtccctggacgactcgtcctgttctgccttctggtacttccgtaaccttttatgtaatttttcgaccaagttcgagtcgtcgggtcccgccgtaagacccttcccgaacggggtaaacggggcgttacggggaacgggttcggggtaccttacgtaaacggtttacctttaagggtcggtaccgttaaggttggggttcgggttacaaccgtaacgtaacgttaaccgttaacgacgaacgtaaccgtcccggtaggaaacgggggtccccggttttaccaacccgtacttcccgttacccgaacgggtaacgtaaaccttaaacgttaccccgaaaaacgtaaaccccgttaaaccccgttaggtttaaccttccgttaacgtaacccgtaaaaattaccggtaaaaccgtacggttaccccgtaagggaaacggtaaccgggtaacccgggaaacgggaacccggtttaacccggggtacccgtttaaacggttttaaccggtttaacgttaacgggttaaccggtaaccgtaaaaaagggtttttacgttttttaacggggtaaagtaccgttaacgggttacccggttttaaaccccgtttaagtttttaccccggtttttttaacggtaaccccggttcccggggttttacccggggggaaccccgtttaaaccccgggggg

SEQ ID NO: 83522 - DNA, 618 bp, Homo sapiens
  misc_feature: GYAE6OF02H3TH4.4.29.C07.1.454.CMB.1.raw
  modified_base (279)..(279): a, c, t, g, unknown or other
  misc_feature (279)..(279): n is a, c, g, or t
  modified_base (291)..(291): a, c, t, g, unknown or other
  misc_feature (291)..(291): n is a, c, g, or t
  modified_base (294)..(294): a, c, t, g, unknown or other
  misc_feature (294)..(294): n is a, c, g, or t
  modified_base (296)..(296): a, c, t, g, unknown or other
  misc_feature (296)..(296): n is a, c, g, or t
  modified_base (304)..(304): a, c, t, g, unknown or other
  misc_feature (304)..(304): n is a, c, g, or t
  modified_base (326)..(326): a, c, t, g, unknown or other
  misc_feature (326)..(326): n is a, c, g, or t
  modified_base (364)..(364): a, c, t, g, unknown or other
  misc_feature (364)..(364): n is a, c, g, or t
  modified_base (373)..(373): a, c, t, g, unknown or other
  misc_feature (373)..(373): n is a, c, g, or t
  modified_base (382)..(382): a, c, t, g, unknown or other
  misc_feature (382)..(382): n is a, c, g, or t
  modified_base (462)..(462): a, c, t, g, unknown or other
  misc_feature (462)..(462): n is a, c, g, or t
tcagagcactgtagcacgaccggtgctcgatttagagtgctacgaagggaaaggggtgagagaggagtccagccctgggattttcaggtgtcttcatttggtgatcaggactgaacagagagaactcaccatggagtttggctgaactggctttttcttgtggctattttaaaagctgtccagtgtgaggtgcagctgttggagtcgtgggggaggctttggtccaggccggggggggtccctgagactctcctgttctgcctctggattcacctttangtaattttgccntgngntgggtccncagctcacgggagggcgtaggngtcgggtctctaagtctttagtgcttagtggtggtcanacatacacncagactcgngaacgggccgttcgacctagtctaccgagacgacaattaccaagaaacctcccgattatctagtaccaaaagtgaaaccncgtacctaggacgacggcggacggaaccggtaccggtaccgtaacgttaacttacgtcgtagtaacgtaaagtttacttttaggaacgtcgtacgttacgttacccgtttaggtttaccttttcggtacccttccggtcgggtacccggtaacggg

SEQ ID NO: 83523 - DNA, 605 bp, Homo sapiens
  misc_feature: GYAE6OF02F5PZ0.4.29.C07.1.454.CMB.1.raw
  modified_base (405)..(405): a, c, t, g, unknown or other
  misc_feature (405)..(405): n is a, c, g, or t
  modified_base (522)..(522): a, c, t, g, unknown or other
  misc_feature (522)..(522): n is a, c, g, or t
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggctttttctgtggctattttaaaagctgtccagtgtgaggtgcagctgttggagtctgggggaggcttggtccagcgggggggtccctgagactctcctgttctgcctctggattcacctttatgtaattttgcctatgagctgggtccgccagtactccacgggaaggggctgggagtgggtctacgaagtcttagtgcttagtggtggcacacactactacgcagactccgtaggaacgggccggttacactntcctaccagagtacaaacttccgaaacgaaccaccctaggtactcgttagacctaaagtacgaacagaccctggaagacgccggtaagaccgtacggccgtaatagtttactggtanacaaagttgttttaggagtcctaaggttccgtacccgttaaaggtttctttcggaccttccgggtcgggaccctaacccgggg

SEQ ID NO: 83524 - DNA, 617 bp, Homo sapiens
  misc_feature: GYAE6OF02IA3DO.4.29.C07.1.454.CMB.1.raw
  modified_base (311)..(311): a, c, t, g, unknown or other
  misc_feature (311)..(311): n is a, c, g, or t
  modified_base (372)..(372): a, c, t, g, unknown or other
  misc_feature (372)..(372): n is a, c, g, or t
  modified_base (452)..(452): a, c, t, g, unknown or other
  misc_feature (452)..(452): n is a, c, g, or t
tcagagcactgtagcacgaccggtgctcgatttagagtgctacgaagggaaagggggtgagagaggagtccagccctgggattttcaggtgtcttcatttggtgatcaggactgaacagagagaactcaccatggagtttgggctgaactggctttttcttgtggctattttaaaagctgtccagtgtgaggtgcagctgttggagtcgtggggggaggcttggtccgagggccgggggggggtccctggagactctcctgttctgcctctggattcacctttatgtaattttgccatgagcgtgggtccncagacctccgacgggaaggggctggagtggtctcgaagtcttagtgctaggtggtggtcanacatactacgcagactccgtaggaacgggtcccggttacacctactctaccgagacgacaacttaccaaagaaccacctntactctacgacaaatgaacacgcagacgacgaccgaggaccacggtccgttaagtattaaccgtagtacgtaactaaagttagtttggtacgtagtacgttacgttaccctttaagttaccgtttttacggacccgtttccggtaccggggtaccgtaacccggg

SEQ ID NO: 83525 - DNA, 644 bp, Homo sapiens
  misc_feature: GYAE6OF02JZCUQ.4.29.C07.1.454.CMB.1.raw
  modified_base (558)..(558): a, c, t, g, unknown or other
  misc_feature (558)..(558): n is a, c, g, or t
  modified_base (571)..(571): a, c, t, g, unknown or other
  misc_feature (571)..(571): n is a, c, g, or t
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgactggctttttcttgtggctattttaaagctgtccagtgtgaggtgcagctgttggagtcgtgggggaggcgttggtccgaggccgggggggtccctggagactctcctgttctcgcctctggtacttcctacctttatgttaattttcgacctatgacgtcgttcgggtcccgaccacgaccgtacccgacgggaacggggccgtaggggaggtcgggtcctacgtaacgttcttaggtgtacgttaggtggtcggtcacactatacctacgcacgaccgtccggtaggaacggggtcccgttacaccctactccgaccagacgactaactaccaaagaacctaccctgtactctagacaaagtcaacgcgactacggagacgaccggagaccgacgtcgtaatacttacgngtacgataagttntttaggagtacgtaggttaccgttacccgttagtttccgtttagccgttccggttcgggacccgttaaccggg

SEQ ID NO: 83526 - DNA, 556 bp, Homo sapiens
  misc_feature: GYAE6OF02IV7OA.4.29.C07.1.454.CMB.1.raw
  modified_base (370)..(370): a, c, t, g, unknown or other
  misc_feature (370)..(370): n is a, c, g, or t
  modified_base (389)..(389): a, c, t, g, unknown or other
  misc_feature (389)..(389): n is a, c, g, or t
  modified_base (442)..(442): a, c, t, g, unknown or other
  misc_feature (442)..(442): n is a, c, g, or t
  modified_base (460)..(460): a, c, t, g, unknown or other
  misc_feature (460)..(460): n is a, c, g, or t
  modified_base (503)..(503): a, c, t, g, unknown or other
  misc_feature (503)..(503): n is a, c, g, or t
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggctttttcttgtggctattttaaaagctgtccagtgtgaggtgcagctgttggagtcgtgggggaggcttggtccaggcgggggggtccctgagactctcctgttctgcctcgtggattctacctttatgtaattttgcctatgagctcgggtccgccagacctccgacgggaaggggctgggaggtgggtctcgaagtcttagtgctagtggtggtcanacatactagcagactccgngaacgggtccgttcacactcctcgagacgacaacttaccaacgaacacccgtntactctgacaatagaacngcctgagacgcgagacgaccggtctatatactgagataaagtntttagacgactagtacgtcctagttctttcgacgttccgtgggacctaccggg

SEQ ID NO: 83527 - DNA, 631 bp, Homo sapiens
  misc_feature: GYAE6OF02FME6D.4.29.C07.1.454.CMB.1.raw
  modified_base (303)..(303): a, c, t, g, unknown or other
  misc_feature (303)..(303): n is a, c, g, or t
  modified_base (415)..(415): a, c, t, g, unknown or other
  misc_feature (415)..(415): n is a, c, g, or t
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggctttttcttgtggctattttaaaagctgtccagtgtgaggtgcagctgttggagtctgggggaggcttggtccgaggcggggggggtccctggagactctcctgttctgcctctggattcacctttatgaattttgccatgagctgggtccnccagactccgacggaaggggctgggagtgggtctcgaagtcttagtgctaggtggtggtcacacatactacgcagactccgtgaacgggtccggttacaccatcctccaganacaattccaagaacaccctgtactacgtgacctaaatagaacagccgtagacggacgaccggagggaacgaccgggaccgttaatacgtttacgtagttgacgaaaagttacgtttttaggtaacgtaccgtaaggtttaccgttacccgtttaaacggtttcctttttttacggtacccgtttcccgttagggggggtaccccctaaaccggggg

SEQ ID NO: 83528 - DNA, 616 bp, Homo sapiens
  misc_feature: GYAE6OF02IIP9J.4.29.C07.1.454.CMB.1.raw
  modified_base (261)..(261): a, c, t, g, unknown or other
  misc_feature (261)..(261): n is a, c, g, or t
  modified_base (303)..(303): a, c, t, g, unknown or other
  misc_feature (303)..(303): n is a, c, g, or t
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggctttttcttgtggctattttaaaagctgtccagtgtgaggtgcagctgttggagtcgtgggggaggcttgggtccgaggcggggggggtccctggagactctcctgtgcngcctctgggtcaccgtcacttacagccacatgagttggtccncaggctccgaggggaggggctgggagtgggtctcgaggttctacagtaacgatggtactacatcgtactcacgactccgtgaacgggccagttccacctatcctccagacgacaattaccaagaactagtaggtttactcttaactaaatagaatagactggcgggaccgaggaccgacggccgtacttactacgtgtcggcggagggggagacgtaggtcggtcgttagggttactttcccgtttagggttttcggtccgggggtaccgtaaccgggggtaaccccgtcgggttaccccgtaccgttccccg

SEQ ID NO: 83529 - DNA, 638 bp, Homo sapiens
  misc_feature: GYAE6OF02FOCCP.4.29.C07.1.454.CMB.1.raw
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggctttttcttgtggctattttaaaagctgtccagtgtgaggtgcagctgttggagtctgggggaggcttggtccaggcggggggggtccctgagactctcctgttctgcctctggattcacctttatgtaattttgcctatgagcgtgggtccgccagacctccgacgggaaggggctgggagtgggtctcgaagttcttagtgcttaggtggtggtcacgacatactacgcagactccgtgaacggggcccgttaccacctatcctaccgagacgaactaacttaccgaaagaacctaccctagtaactccgtagacctaaatacgaaacacgtacctaggaacgacggacccggaaggaccgaaccggtaccgtattaacgttacctagtacgacgtaaagttacgttttaggacgtacgtacgttacgtacccttaaggtttctttttacgaccgttccggttacggggtacccgtaacccgggg

SEQ ID NO: 83530 - DNA, 835 bp, Homo sapiens
  misc_feature: GYAE6OF02GKYZS.4.29.C07.1.454.CMB.1.raw
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggtctttttcttgtggctattttaaaagctgtccagtgtgaggtgcagctgttggagtcgtgggggaggtcgttggtccgagggtccgggggggtccctggacgactctcctgttctcgtcctcgtggtacttcctaaccttttagtagttaaatttttcgacctaagttggacggtccgttcggggttccccgacccgtaacggtacccgttacccggaaccgggggtaacgggggtccgttaggggacggttcgggggttcctaccggtaaaggttccgtttaaggtcggtacgttggggttggtcggtacaaccgactacgttaaccgtacgacaacggaccgttccggtaggaacggggtccggtttaccaccgtacgttccgtaaccgacggaacgtaacctaacgttacccgaaaacgtaaccctaccttagtacctacgtacgaactaaacgttcgaaaccgtacgtaccgtacggtaacgaccggtaccggaaggacccgtaaccgggtacgttaacgttacgttaaccggttgtaaccgtaacgttaaaacggtttacgtttttaacggaacggttaccgttaacgtttacccggtttaaacccgtttaaggttttcccgttttaaccggtaccgtttccccgggggtaacggggttaccccggtaaaccccggggg

SEQ ID NO: 83531 - DNA, 627 bp, Homo sapiens
  misc_feature: GYAE6OF02HNJQY.4.29.C07.1.454.CMB.1.raw
  modified_base (306)..(306): a, c, t, g, unknown or other
  misc_feature (306)..(306): n is a, c, g, or t
  modified_base (469)..(469): a, c, t, g, unknown or other
  misc_feature (469)..(469): n is a, c, g, or t
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggctttttcttgtggctattttaaaagctgtccagtgtgaggtgcagctgttggagtcgtgggggaggcttggtccaggcggggggggtccctgagactctcctgttctgcctctggattcgaccttttatgtaattttgcctatgagctgggtccnccagctccacgggaggggctggagtcgggtctcgaagtcttagtgtcgtaggtggtggtcacacatactacgcagactccgtaggaacgggtccgttacaccatcctaccgagaagactaacttaccaaagaaccaccctagtactctacgacaaatgaaacncgtacctagaacggacgaccggaggaccgaccggtccgtaattacttacgttgtacgaactaaaggttacgttttaaggacgtaacgtaggttccgttaacccgtttaaggtttcctttttacgacccgtttccggtcggggtacccgtaacccgggg

SEQ ID NO: 83532 - DNA, 603 bp, Homo sapiens
  misc_feature: GYAE6OF02GYV1B.4.29.C07.1.454.CMB.1.raw
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggctttttcttgtggctattttaaaagctgtccagtgtgaggtgcagctgttggagtctgggggaggcttggtccaggcggggggggtccctgagactctcctgttctgcctctggattctacctttatgtaattttgcctatgagtcgtcgggtccgccagacctccgacgggaagggcgtgggagttgggtctacaaggtcttaaggtgcttaggtggttggtccacacatactacgcacgactccgtagagggtcccgttcacctatcctcagacgactaattaccaaagaaccaccgtagtactctagacaaagtagaacacgactagagacgaccggagacgacggtccgttaatacttacgtagtacgactaaagtatttaggagtactaagttcgtaaccgttaagtttccttttacgaccgttccggtacgggtaccgtaaccggg

SEQ ID NO: 83533 - DNA, 757 bp, Homo sapiens
  misc_feature: GYAE6OF02JI3GN.4.29.C07.1.454.CMB.1.raw
  modified_base (151)..(151): a, c, t, g, unknown or other
  misc_feature (151)..(151): n is a, c, g, or t
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgactggntttttctgtggctattttaaaagctgtcagtgtgaggtgcagctgttggagtcgtgggggagtcgttggtccaggccgggggggggttcccttggaggtaccgttccgttccttcggtttcctcggcctcgttggattccgtacctttatcgttaattttcgacctagtgacgtcgtcgggtccgccgagcctaccgacggaagggctggaggtcggtctcgaagtcttagtgtcgttagtggtacgtcaacgtactattaccgtacgcgaacgtaccgtccggtacggaaacgggtcccggtttacgacccgtgtaccttacccgaacgtaacgaaaccgtaaacttacccaaacgaaacccgttacccgtacggttactaccgttgaacctaaagttacgaaacgtagtacccttaggaaccggacgaccggaacgtaaccggaaccggtaccgttaacgttaccgttaacgttagtacggtaaccgtaaaggtttaacgtttaggttaaccgtacgttaacggttacccggtttaccgttaaaccggtttttcttttaccggttaccgtacccgggtttcggggtaccccgttaaacccgggg

SEQ ID NO: 83534 - DNA, 648 bp, Homo sapiens
  misc_feature: GYAE6OF02JOKAS.4.29.C07.1.454.CMB.1.raw
  modified_base (282)..(282): a, c, t, g, unknown or other
  misc_feature (282)..(282): n is a, c, g, or t
  modified_base (389)..(389): a, c, t, g, unknown or other
  misc_feature (389)..(389): n is a, c, g, or t
  modified_base (413)..(413): a, c, t, g, unknown or other
  misc_feature (413)..(413): n is a, c, g, or t
  modified_base (507)..(507): a, c, t, g, unknown or other
  misc_feature (507)..(507): n is a, c, g, or t
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggtctttttcttgtggtctatttaaaagctgtccagtgtgagtgcagctgttggagtcgtggggaggtcgttggtccgaggccgggggggtcctgagactcgtcctgttctgcctcgtggtattctacctttntagtaatttcgcctatgactcgtcggttccgccagtacctccggaacgggacgggcgtaggacgtcgggtctacgtaagtcgtagtgcgtaggtggtacggtctacnctacgttacgacgtacaggtaccnctaaggacggtaacgggtcccgtttacgaactcgtacccgtacacggaaacgtaactaacgttaccaacaaccgtacctagtactcgtacgaanagtaacacgacgagtcgagcggaccgacggacgtaccggtcgtaactagttacgacgtagtacgtaaagttcgttagtaacgtactacggttacttaccgttaacggtttcctttaacgccgttaccggtcggtaacccgg

SEQ ID NO: 83535 - DNA, 918 bp, Homo sapiens
  misc_feature: GYAE6OF02IJ91T.4.29.C07.1.454.CMB.1.raw
tcagagcactgtagcacgaccggtgctcgatttagagtgctacgaagggaaaggggtgagagaggagtccagccctgggattttcaggtgtcttcatttggtgatcaggactgaacagagagaactcaccatggtagtttgggctgaactggtctttttcttgtgcttatttaaagctgtccagtgtgaggtgcagctgttggagttcggtgggggagtcgttggtccgagggtccggggggggtccctggacgtaccgttcctccgttgtttccgtcgtcccttcgtggtactttacctaccgttttaagtacggttaactttttcgacctagtcggtacgtccggttacgggtaccccggacccgacggtacccgttacccggaacgggggtaacggggtcgttagggacgggttcgggtaccttacgtaaaggtttcgtttaaggtcgtcgttaaggtgggttcgtacctaacgacgtaacgtacgtaaccgcgtaacgtaccgtccggtaagggtaccgggtcccggttacaccgtacgttacccgtcgaacgaaccgtaaccttaaacgttaaccgaaaaccggttaaaccctacccgttagttacgttccgttaaacggaactaaaaggttaccgaaacgtaccgtaccgttacgggaaacgggaccgggtaacccggaaagggaaccccggaacccgggtttaacccgtttaaaagtttaacccgttaaccgggtttagttaaacccgaaaacgtttaaaacggttttttcgtttttaaccggtaaccggttacggtttaaccgggtttaaccccgttttaaccccgtttttaaggttttttttaccccgttttacgggtaaccccgtttcccggggttaccgggggtaaccccggttaaacccccggggg

SEQ ID NO: 83536 - DNA, 806 bp, Homo sapiens
  misc_feature: GYAE6OF02FL54S.4.29.C07.1.454.CMB.1.raw
  modified_base (160)..(160): a, c, t, g, unknown or other
  misc_feature (160)..(160): n is a, c, g, or t
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctagaactggtctttttnttgtggctattttaaaagctgtccagtgtgaggtgcagctgttggagtcgtgggggagcgttggtccgagggcggggggggtccctggagaccgtctcctgttcgtcgcctcgtggtacttcctacctttatgtaagtttttcgcctatgaggtcgtacggggtcccgccgagaccgttccgaacgggaacgggcgtggaggttcgggtcgtccgtaaggttccttaggtcgtacgttagggttcggtaggttaccacgactaagttaaccgtacggaccacggtaaccgttaccgggtacgggtaacggggtccccggtttaacaacccgtacttaccgttaccgaaacggtaacggtaacctaaacttaacccgtaaaaccgtaaacccgttaccccttaacggttaactttaccgtacgaacgtaaacgttaccgaaacgtaccggtaccgtaaggtaacggacggaacccgggaacggaaccggtaccgggttaaccgttaacttaactttaaccgttagtacggtaacgtaaacggttacgtttttaagaacggttacgtaacggtttaccgttacccgtttaacggttttcgtttttaaccggtccgttaccgggttacggggtacccggtaacccgggg

SEQ ID NO: 83537 - DNA, 944 bp, Homo sapiens
  misc_feature: GYAE6OF02GQIZJ.4.29.C07.1.454.CMB.1.raw
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggctttttcttgtgctattttaaagctgtcagtgtgaggtgcgagctgttggagtcgtgggggaggcgtttgggtccgagggtccggggggggtcccctggacggtacttccgtccgttgtttccgtcgtcccttcgtggtactttccgtaacccttttagtagttaaagtttttcgcccgtaagttggaacggtccgttcgggggttaccccgacccgtaagtaacccgttcccggaaaccggggaacgggggtccgtaggggtacgggtttcgggtaccgttacgttaaacggttacgtttaggtcggtaccgtttaagggttcggggtttagggttaccctaacggtaaccttaaacgttaacccgttaacggcctaaacggttaccccgttaccgggttacgggtaacccgggggttcccggttttacccgaaccccgtaacgttcccgtaacccgaaaggtaaacgaaacccgttaaactttaaccccgaaaaacggtaaaacccccgttaaccccgtaaggttaccgttccgttaacgtaaacctaaaacgttaccgaaacctaacgtcccgttaagggaacggtaccggtacccgggaaacggaacccgggtaacgggtaaccccgtttaagtttaaccgttaaccggttacgttaccggaaaccgttaaaggtttacggtttttagggaaccgttcggttaacggttaccgtttaaccccgtttaggttttaccttttttaccgggtaccggttacccgggtttaccgggaacccggttaacccggg

SEQ ID NO: 83538 - DNA, 656 bp, Homo sapiens
  misc_feature: GYAE6OF02GRWVE.4.29.C07.1.454.CMB.1.raw
  modified_base (486)..(486): a, c, t, g, unknown or other
  misc_feature (486)..(486): n is a, c, g, or t
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggctttttctgtggctatttaaagctgtcagtgtgaggtgcagctggttggagtcgtgggggaggtcttggtccgaggccggggggggtccctggagactctcctgttctcgcctcgtggtacttccgtacctttagtgtaattttcgcctatgagtcgtcgggtccgccagacctccgaacgggaggggcgtgggaggtgggtctacgagttcgttagtgtacgtaggtggtggtcacacatacacgcaagactccgtaggaacgggtccgttacaactctcctacagacaactacttaccaaagaacctaccctagtactcgttacgaactaaanacgaacacgtacctagacggacgaccggaggaaccgaccgggtacttacgtaacttaacgtgtaacgactaaaaggttctttaaggtacgtacgtacggttaacgttacccgttaagttttccgtttttacgaacccgtttccgggtaccggggtacccgtaacccgggg

SEQ ID NO: 83539 - DNA, 620 bp, Homo sapiens
  misc_feature: GYAE6OF02G5AOI.4.29.C07.1.454.CMB.1.raw
  modified_base (267)..(267): a, c, t, g, unknown or other
  misc_feature (267)..(267): n is a, c, g, or t
  modified_base (281)..(281): a, c, t, g, unknown or other
  misc_feature (281)..(281): n is a, c, g, or t
  modified_base (306)..(306): a, c, t, g, unknown or other
  misc_feature (306)..(306): n is a, c, g, or t
  modified_base (369)..(369): a, c, t, g, unknown or other
  misc_feature (369)..(369): n is a, c, g, or t
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggctttttcttgtggctattttaaaagctgtccagtgtgaggtgcagctgttggagtcgtgggggaggcgttggtccaggcggggggggtccctggagacctctcctgttctgcctcnggattcacctttangtaattttgccatgagctgggtccnccagacctccgacgggaaggggctggaggtgggtctcaagtcttagtgctaggtggtggtcanacatactacgcagtacctccgtaggaacgggccggtttccacgtactctaccgagagacaattaccaaagaacctaccctagtactcgttgactaaagtacgtaaaccagtacctaggacggaagtcccgaaggtaaccgaccgggtacgttacgtaacttaacgtcgtagacgtaaaagtacttttaggagtcgaagttcgtacccttaagttcgttttacgaccgttccgtacggggcctaacccgggg

SEQ ID NO: 83540 - DNA, 706 bp, Homo sapiens
  misc_feature: GYAE6OF02FG2TK.4.29.C07.1.454.CMB.1.raw
  modified_base (190)..(190): a, c, t, g, unknown or other
  misc_feature (190)..(190): n is a, c, g, or t
  modified_base (318)..(318): a, c, t, g, unknown or other
  misc_feature (318)..(318): n is a, c, g, or t
  modified_base (483)..(483): a, c, t, g, unknown or other
  misc_feature (483)..(483): n is a, c, g, or t
tcagagcactgtagcacgaccggtgctcgatttagagtgctacgaagggaaaggggtgagagaggagtccagccctgggattttcaggtgtcttcattggtgatcaggactgaacagagagaactcaccatggagtttgggctgaactggtcttttctgtggctatttaaaagctgtccagtgtgaggtncagctgttggagtcgtgggggagtcgttggtccgaggccgggggggtccctggacgactctccgtgttctgtcctcgtggattccacctttatggtaattttcgaccagtgagtcgtcggggtacccnccgagaccgtaccgacgggtaaacgggtcgtacgggtaggttcgggtacctacgtaaacggttccttaggtcgtacttaagggttggttcggtacacctacgaacttaaccgtacgaccagaaccgtccggtaggaacggggtccgttacaccgatccgtcaganaacgacttaccgaaacgaacctaacccgtgtacgtctacgaactaaactacgaaaccgtacgaccgttaggaacgacggaccggaacgaacgaaccggtaccgtaacttaacgttaacgtgtacgaacgtaaaagtcgttttaaggtagtaacgtacgttccgtaacccgttaacgttttcgtttaaccgtccgtacccgggttcgggaaccgtaaccccggg

SEQ ID NO: 83541 - DNA, 742 bp, Homo sapiens
  misc_feature: GYAE6OF02FWKQY.4.29.C07.1.454.CMB.1.raw
tcagagcactgtagcacgaccggtgctcgatttagagtgctacgaagggaaaggggtgagagaggagtccagccctgggattttcaggtgtcttcatttggtgatcaggactgaacagagagaactcaccagtggagtttggctgactggtctttttctgtgctattttaaagctgtccagtgtgaggtgcagtcgtgttggagttcggtgggggacggtcgtttcggtccgagggtccgggggggtccctggacgtacctcttccgttgttcctcggtcctacgttggtactttacctaccttttatagttaatttttcgacctagtgacgtcgttcggggtccccgaccgtacgaccctaccggaacgggtacggggtccgtagggacgggttgggtaccgtacgtaagttcgtttaggttcgtaccgttaggtcggttcggttacaaccgtaacgtaacttacgtacccggacgacgtacccgttaccgggtacggaaccgggttcccgttacaaccgtactccgtaccagacgtaaccagttaaccgaaaccgtacctacccgttagtacttcgtacgaaacttaaacgtacaaactcggtaccctaggacgtaaccgggacccggagacccggtaaccgtacgttaactaacgtttacaggtactaagtaaattgtttaggacgtctaacggttcttaccgtagtttctttacgcgtcggttacgggcgtaacccgg

SEQ ID NO: 83542 - DNA, 773 bp, Homo sapiens
  misc_feature: GYAE6OF02G6MJ7.4.29.C07.1.454.CMB.1.raw
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggctttttcttgtggctattttaaaagctgtccagtgtgaggtgcagctgttggagtcgtgggggaggcttggtccgagggccgggggggggtccctggacggactctcctgttctgcctcgtggattcgtacctttatgtaacttttgccctagttgagtcggtcgggtcccgaccgaggtacctaccgaacggggaacggggtcgtgggaggttcggggtctacgtaacggttcttaggtgtacgtaggttggtcggtacacctactagtaacctacgctaacgtaccgttacccgggtagggaaaccggggttcccgggtttaccaaccccgtaacttacccgttacccgaaacggtaacgtaaacctaaactttaaccgaaacgtaaaccctacccgttacgttacgttactcgaactaaacgtgaaacctacggtaccctaggaacggaccgggtaacccggaggaaccggacccgggtacgttaacgttacgtaacttggtaacgtacgtaaaaggtttacgtttaggtaaccgtacctaaggtttccgtaacccctttaacggttttccgtttttacggacccgttttccgggtacggggtccccttaaaccggggg

SEQ ID NO: 83543 - DNA, 676 bp, Homo sapiens
  misc_feature: GYAE6OF02H4UXR.4.29.C07.1.454.CMB.1.raw
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggctttttcttgtggctattttaaaagctgtccagtgtgaggtgcagctgttggagtctgggggaggcttggtcaggcggggggggtccctgagactctcctgttctgcctctggattcacctttatgaattttgccatgagcttgggtccgccagacctccgacgggaagggctggagtggggtctctaagtcttagtgctagtggtggtcacacatactacgcagactcgtagaaggggtccgttcacctactctaccagagacaaacttcaaacgaaccaccctgtactctgacaaagtgaaacagacctgagacgtaccgaacggacgaaccgggttaccgttaagtaaacgtttaaccgttaggtaccgtaacgtaaaaacggttaacgtttttaagggtaaccgttacgtaacggtttacccgttaacccccgttttaaaacggtttttcgttttttttaacccggtaacccgttttaccccgggttaccggggggggtacccccttaaaaacccgggggg

SEQ ID NO: 83544 - DNA, 848 bp, Homo sapiens
  misc_feature: GYAE6OF02I87YQ.4.29.C07.1.454.CMB.1.raw
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctagaactggtctttttcttggtggtctaattttaaaagcttagtcctagtgtgaggtgcagctggttggagtcgtgggggaggcgttggtccgagggccggggggggtccctggacgactctccttgttcctcgtcctctggtacttcctacctttatgttaattttcgacctagtggtagccggtcgggtccccgccgtaacgacctcccggtaacggggaaggggtccgtagggaggttcgggttactaccgtaaagtttcgttacggtacgtacgttagggttcgggtacggtaccgtaacgaacctaacgttaacctaaccggtacgtaaccggaccggttcccggtaaggggtaaaccggggtacccggtttaaccacccgtacttcccgtaacgaacggaagtaaaccctaaacttaacccggaaaaactaaccccgacccttaggttacctacgtttaggaaacctaaagttaaccgaacgttaaccgccgggttaagaacggaccgggtaacccgggaaacggtaccccgggtaaaccgggtacccttaaacgggttaactttacggtacggtacgtaaactaaagggtttacgttttaacggaacgtaacggttacgttaccgtttaaccggtttaacggttttcttttaccggttaaccccggttcccggggtacgggacccggtaaacccgggg

SEQ ID NO: 83545 - DNA, 764 bp, Homo sapiens
  misc_feature: GYAE6OF02GKZWD.4.29.C07.1.454.CMB.1.raw
tcagagcactgtagcacgaccggtgctcgatttagagtgctacgaagggaaaggggtgagagaggagtccagccctgggattttcaggtgtcttcatttggtgatcaggactgaacagagagaactcaccatggaggtttgggctgaactggtctttttcttgtggctattttaaaagctgtccagtgtgaggtgcagctgttggagtcgtgggggaggtcgttgggtccgagggccggggggggtccctggacgactcctcctgttctcgcctcgtggtacttctacctttatgtaattttgcctatgtagtcgtcgggtcccgccgaacgtaccgtacccgacggggaacgggggtccgtaggggacgggttcggggtccttacgtaaacggttcgtttaggtcggtaccgttagggttggggttcggtacccaactaacctaacttaaccgtaccgtccaaacggtacccgttaccggtacgggtaacggggtccccggtttaccaccgtactcccgtaccgaagaacgtaacctaacttaacccaaagtaaaccctacccgttacgttactccttaacgaactaaacgtacgaaaccgtacgaccgtaaggacggaccggtaccggaacggaccgaccgggtaccttaattacgttaacgtgtaagtaacgtaaagttgtttaacggactcgtacgttaccgttaccgttaacggttttcttttaccggaccttccgggtaccgggtaccgtaacccggg

SEQ ID NO: 83546 - DNA, 821 bp, Homo sapiens
  misc_feature: GYAE6OF02GJ9HX.4.29.C07.1.454.CMB.1.raw
tcagagcactgtagcacgaccggtgctcgatttagagtgctacgaagggaaaggggtggagagaggagtccagccctgggattttcaggtgtcttcatttggtgatcaggactgaacagagagaactcaccatggagtttgggctgaactggtctttttcttgtggtcttattttaaagctgtctagtgtgaggtgcgagtctgttggagttcggtgggggaggtccgttcggtaccggtagggggtccgggggggggtcccttggacggtaccttccgtaccgttgttcctgccttcgtggtacttcgtaccttttagtagttaagttttcgaccgtattggacgtcggttcgggtacccgtccgtacgaacctccggaacgggggtacgggtaccgtgggaggttcgggtcttacgtaacgttacgttagtcgagttaggtgggtcgtaccgataccgtataaccgtacgctaagaccgttccgggaggttaaccgggccggttaccaaccgcttcccgtaccgtacgacgtaaacctaaccgtaaccgtaaaccgtaaaccctccgtacgttaaacggttccctaaagggtaacctaaaccgttaaccgaaacgtaccgttacccgtacgggacgtaaccggacggtaacgggaaccgtacccggtaaccgttaacgttacgtttaccgtagtaaccgtacgaaaaggtttcgttttaacggtacggtacctaagtttcccgttaaaccgtttacggttttacctttttaccggaacccggtttaccccgggttagggaccccgggttaaacccgggg

SEQ ID NO: 83547 - DNA, 836 bp, Homo sapiens
  misc_feature: GYAE6OF02HDVR6.4.29.C07.1.454.CMB.1.raw
tcagagcactgtagcacgaccggtgctcgatttagagtgctacgaagggaaaggggtgagagaggagtccagccctgggattttcaggtgtcttcatttggtgatcagactgaacagagagaactcaccatggagtttggctgactggtctttttctgtggacttaattttaaaagctgtccagtgtgaggtgcgagctggttggagtcggtggggagtcgttggtccgagggtccggggggtccctaggacgacgttccgtccgttgttccgtcgtcctcgtggtactttcctaacctttagtagttaattttcgacctagtcggacgtcggttcggacccgtaccgtaacggtacccgtaccggtaaacggggaacggggtcgttaacggggtacgggttcgggttaaccttacggaacggttttacttaggtacggttaccgttaagggttcgggttacgtaccgaaccttacgtaacgttaaccgtaaccgacgtaacgtacccgttacggtaacggaaccgggtacccggtttaccacccgtaacgtacccgtaaccgaagtaaccgtaaccgtaaacgtaacccgtaaacgaacccgttaacccgtagttaacctacgttaaccaacgttaaagaaccgaaaccgacggtacccgtaggtaaaccgggaacgtaccggacgggaaccgtaccggttaaccttaagtaaccgtttaacgtacgtaacgtaagttaacggtttagtttaacggagttacgtaaccgttacgttaacccgttaacgtttccgttttacgacccgtttaccgggtaccggtaccgtaacccggg

SEQ ID NO: 83548 - DNA, 800 bp, Homo sapiens
  misc_feature: GYAE6OF02HE3C7.4.29.C07.1.454.CMB.1.raw
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggcttttcttgtggctattttaaaagctgtccagtgtgaggtgcagctgttggagtcgtgggggaggcttgggtccgagggccgggggggtccctggagacttcctcctgttctgccctcgtggtattcctacctttagtagtaacttttcgacctagttggacggtccgtcgggtccccgacccacggtaccctcccggaacggggaacggggtccgtagggacgggttcgggtaccgtacgtaaggttcgttaggtgtcgtaggttgggtcggttaccaacgtactacttaaccgtacgacgtacggtaccgtcggtacgggaacgggggtcccggtttaccgaacccgtacgtacccgtaccgtaaggacgtaacctaaacgttacccgaaaacgtaaaccctacccgttaaggttaaccttcgttacgaaacctaaaagttacgaaaacccgtaacggtaccctagggaacggtaaccgggacccggtaaacgggaacccggaacccgggtaaccgtttaacgtaaacgtttaaccgtgttaaccgacgtaaaaggttgttttaaggacgtagtacgttaccgttaccccgttaagttttcccgttttaggtacccgttccgggtacgggtacccggtaacccgggg

SEQ ID NO: 83549 - DNA, 658 bp, Homo sapiens
  misc_feature: GYAE6OF02JIPG7.4.29.C07.1.454.CMB.1.raw
  modified_base (324)..(324): a, c, t, g, unknown or other
  misc_feature (324)..(324): n is a, c, g, or t
  modified_base (367)..(367): a, c, t, g, unknown or other
  misc_feature (367)..(367): n is a, c, g, or t
  modified_base (390)..(390): a, c, t, g, unknown or other
  misc_feature (390)..(390): n is a, c, g, or t
  modified_base (407)..(407): a, c, t, g, unknown or other
  misc_feature (407)..(407): n is a, c, g, or t
  modified_base (434)..(434): a, c, t, g, unknown or other
  misc_feature (434)..(434): n is a, c, g, or t
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggtctttttcttgtggctatttaaaagctgtcagtgtgaggtgcagctgttggagtcgtgggggagtcgttggtccagggtcgggggggtccctggagtacctctccttgttctgccttcgtggtacttcgtacctttatgttaattttcgacctagtcgagtcgtgggtacccnccagacctcgacggaagggtctcggagtgggtctacgaggttntagtgcttaggtggtggtaccanacactacgtacgcgacncgtcgtacggaacgggtccgttacacnctctcgagtagactagtaccaagacctacctgtactcgtagactaaagtcgaaacgtcgaccgtagaacggtaccgaccggagaaccctacgggtaccttaacgttaaagtcccgttagacgtaaacgtaacggttagtttttccggaaagtcgtaacgtttaccgttaccgttaacggtttttcgtttcccgacgtttccggcggggaaccttaacccggggg

SEQ ID NO: 83550 - DNA, 667 bp, Homo sapiens
  misc_feature: GYAE6OF02GPNSG.4.29.C07.1.454.CMB.1.raw
  modified_base (318)..(318): a, c, t, g, unknown or other
  misc_feature (318)..(318): n is a, c, g, or t
  modified_base (527)..(527): a, c, t, g, unknown or other
  misc_feature (527)..(527): n is a, c, g, or t
tcagagcactgtagcacgaccggtgctcgatttagagtgctacgaaggggaaaggggtgagagaggagtccagccctgggatttttcaggtgtcttcatttggtgatcaggactgaacagagagaactcaccatggagtttgggctgaactggctttttcttgtggctattttaaaagctgtccagtgtgaggtgcagctgttggagtcgtgggggagcttggtccaggccgggggggtccctgacgactctcctgttctgcctctggatttcctaccttttatagtaattttgcctatcggagtcgtcggggtcccncccaggaccttcccgaacgggaacggggcctgggacggttgggtccgtacaaggttctttaaggtcgtcgttaggtgggttacggtactacgaacgtattaccgtaacgacaacggactacccggtggaaccgggtcccggttaccaccgtactctacccgagacgtaacaacttacaaacgtaacccacctagtactctgtaaccaanacgacacgacgtagaacgagaccgaggaccgacggacgtaactagttacgtagtacgtacgtaaagtgtttagacgtactaacggttcgttaaccttacgtttacttttacgaccttcggtaccgggaccgtaacccggg

SEQ ID NO: 83551 - DNA, 753 bp, Homo sapiens
  misc_feature: GYAE6OF02JPEEV.4.29.C07.1.454.CMB.1.raw
tcagagcactgtagcacgaccggtgctcgatttagagtgctacgaagggaaaggggtgagagaggagtccagccctgggattttcaggtgtcttcatttggtgatcaggactgaacagagagaactcaccatggagtttgggctgaactggtcttttcttgtggctattttaaagctgtcctagtgtgaggtgcagtcttggttggtagttcggtgggggtaggtcgtttcgggtccgacgggtccgggggggtccctaggacgaccgtcctccgttcgttctcggtccttcgtggtacttccgtaacctttgtacgttacttttcgaccatggacgtcgtcgggtacccgcctaacggtaccgtaccgtaacggggaacgggtcgttacgggaggttcgggttacgtccggtaagttacgtttacggtcggtacgttagggtcgggttcgttacgaacgtaactacgtaacgtaccgacaacggtaccgtacggtacgggtaacggtcccggttacaaccgtactaccgtcagacgtactaactaccgaaacgacctaccgttatacgtactacgtaacaaacgtacgaacctacgctaaggaccgaacgcccggtaacggaaccgccggttacttataaaccgttgtcgtaacgaacttaaagttacgtttacggtatacgtaggttaccctttacgttaacgtttccgttttcgacccgttacgggtttacccgggaccttaacccgggg

SEQ ID NO: 83552 - DNA, 775 bp, Homo sapiens
  misc_feature: GYAE6OF02IA383.4.29.C07.1.454.CMB.1.raw
  modified_base (514)..(514): a, c, t, g, unknown or other
  misc_feature (514)..(514): n is a, c, g, or t
tcagagcactgtagcacgaccggtgctcgatttagagtgctacgaagggaaaggggtgagagaggagtccagccctgggattttcaggtgtcttcatttggtgatcaggactgaacagagagaactcaccatggagtttggctagactggtctttttcttgtggacttattttaaaagcttcgttccgagtgttggaggtgacgagtccgttggttggtacgttcggtaggggggtacgtcggtttcggtaccggagggggtcccggggggggttaccttcgggaagtacccgtcttacccggttcgttcgtcgccgttactagggtacttccgttaaccttttatgttaacgttttgaccttagtcgtacgtcggtcggtcccggaccgaacgtaccgtacccgaacgggggtaacggggtcccggttagggtaacggtcgggttccgttaagtaacgtttacgtttagtcggtacgttaggttcggtagttccaacgacttaactacgtacncgataccgtcggtaggaacggttcccgtacaccgtatacccgtcgtaaacgaacgtaactaaactacccgtaaaaacgaccctaccgtttacgtacgtaaccgctaaagtaaactaacgaaaccgcggtacccgtaggacgccgggaacggaaccggtacggaaccgtcgtaaattacggttgtactaggaacctaaggttcgttaggtaccagttcgttacgtacttcgttacttacggtctcggtacggcgtaaccggg

SEQ ID NO: 83553 - DNA, 966 bp, Homo sapiens
  misc_feature: GYAE6OF02G909P.4.29.C07.1.454.CMB.1.raw
  modified_base (308)..(308): a, c, t, g, unknown or other
  misc_feature (308)..(308): n is a, c, g, or t
tcagagcactgtagcacgaccggtgctcgatttagagtgctacgaagggaaaggggtgagagaggagtccagccctgggattttcaggtgtcttcatttggtgatcaggactgaacagagagaactcaccatggtagtttgggctgaactggtcttttcttgtggctattttaaagctgtccagtgtgaggtgcagtctgtggagtcgtgggggaggtcttggtccgagggtccgggggggtccctgagacttcctccgttgttcctcgcctcgtgtacttctactttatgtaacttttcgcctatgngtacgtcgggtcccgccgacgtacctccggtaacggggaacggggtccgtaggggtacggttcggggtaccttacgtaacggttacgtttaaggtcggtaccgttacgggttcggggttacggtaccgaacgttaacctaacgttaaccgaaccggtaccgaacgtaaccgttaccgggtaacgggtaaccgggggtcccggtttaacccaccgtaaccttaccgtacccggaagaaaccggtaaacctaaactttaaccccggaaaaagtaaccccgttaacccccgtttaagttaacccggttacgttaacgtaaaccgtaaaaaccggttactaaaaccccgtaaccggtaccggttaaggaaaccgggttaaccccgggaaccccggggtaaacgggaaaacccccgggtaacccggggttttaaccgtttaaaacgttttaaaccggttttaaaccgggttacgtttaaaccgggaaaaaccctttaaaacgggtttttaaggtttttttaaccggggaaacggttaccggtttaaacgggttaccccggtttttaaaccccggtttaccggttttttttaaccgttttcccgggtaaacccggttttcccgggggttaccccggggggtaaccccggttaaacccccggggg

SEQ ID NO: 83554 - DNA, 136 bp, Homo sapiens
  misc_feature: GYAE6OF01EIW4L.36.23.C01.1.454.CMB.1.raw
  modified_base (136)..(136): a, c, t, g, unknown or other
  misc_feature (136)..(136): n is a, c, g, or t
tcagtacgctgtctcacgaccggtgctcgatttagtacacgtgattagggattgggggaagaggaagactgacggtcctgcctggtcaaggactacttccagacagcgtactgagcgggctggcaaggcgcatagn

SEQ ID NO: 83555 - DNA, 521 bp, Homo sapiens
  misc_feature: GYAE6OF01BFU08.36.23.C01.1.454.CMB.1.raw
tcagtacgctgtctcacgaccggtgctcgatttagtacacgtgattagggattgggggaaatactttctgagactcatggacctcctgcacaagaacatgaaacacctgtggttcttcctcctcctggtggcagctcccagatgggtcctgtctcaggtgcagctgcagcagtcgggcccaggagtggtgaagccttcggagaccctgtccctcacccgcgctgtgtctggagcctccctcggcggagatgaatggtggagttgggtccgccagcccccagggaaggggctgagttggattggtgaataaatgagaccgggggcaccaactacaatgcgtccctcagggtcgagtcaccatatctgcagacaagtccaagaaccacttctccctgaggctgacctctgtgaccgccgcggactcggccatatattattgtgcgagtagttttgctaggatcttggggcgtatcgacgtctggggtcagggatcgcggtcatcgtctcctcagcctcacccg

SEQ ID NO: 83556 - DNA, 522 bp, Homo sapiens
  misc_feature: GYAE6OF01D1DJR.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggtttccaacagcattcaggcagcgccccgaaactcttaatttatgaggtctttcgtcggccctcaggggtttctagtcgcttctccgctcaagtctggcacacggcctccctcgaccactctctacgactccaggctgaggacgaggctcgactattattgcagctcatatactagaagtactaatggtatcctactggtctggttcggtcgggagggtaccgaagttcgaccgtccgtacggtcacgcccgaggtaccg

SEQ ID NO: 83557 - DNA, 668 bp, Homo sapiens
  misc_feature: GYAE6OF01CY7TJ.36.23.C01.1.454.CMB.1.raw
  modified_base (273)..(273): a, c, t, g, unknown or other
  misc_feature (273)..(273): n is a, c, g, or t
tcagtacgctgtctcacgaccggtgctcgatttagtacacgtgattagggattggggggggtctcaggagtcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgtcttataattatgtctccttggttccaacngctattcaggcacgccgacccgtaaacttcttaatttatgtacggttctttcggtccggtcctcgtagggtttcctaggtcgtctttccgtccggtcctaccgtaacgttccgttgggaccctaaacgacccggtccctcccgtacgtaaccctacgttcctacgtaacgacccttaccgaagggtcctagggaacgggacgacgggtcctaggtaactttacgtttaatcgactacgtccttactaattacgttaacgtagtaaacgtcctaaagttcggtaacctccgtaacggtcggtcttcgggttccgggacggggtaacgggtaacccgtaacgggttccgtaccccggttacgtaacgggtaccgaccggaccccgaaggttcccccg

SEQ ID NO: 83558 - DNA, 515 bp, Homo sapiens
  misc_feature: GYAE6OF01DQ1FW.36.23.C01.1.454.CMB.1.raw
  modified_base (225)..(225): a, c, t, g, unknown or other
  misc_feature (225)..(225): n is a, c, g, or t
  modified_base (282)..(282): a, c, t, g, unknown or other
  misc_feature (282)..(282): n is a, c, g, or t
tcagtacgctgtctcacgaccggtgctcgatttagtacacgtgattagggattggggggtctcaggaggcagcgctctcaggacatctccaccatggcctgggctctgctgctcctcaccctcctcactcagggcacagggtcctgggcccagtctggcctgacacagcctgtctccgtgtctgagactcctggacagtcgatcacatctcctgcactggaaccngcagtgacgttggtgcttataattatgtctcctggttccaacagcattcaggcagcncccgaaatctaatttatgtagtctttcgtcggcctcagggtttctagtcgcttctccggctccaagtctggcaacacggcctcctgaccatctctagactccaggctgagacgaggctgactatattgcagctcatatactagaagtcaaatggtaactcaactggcttggttccggagggagggacctaagttcgaccggtcctagggtaccaacggtcccgaaaggtcccg

SEQ ID NO: 83559 - DNA, 499 bp, Homo sapiens
  misc_feature: GYAE6OF01DMVHQ.36.23.C01.1.454.CMB.1.raw
  modified_base (322)..(322): a, c, t, g, unknown or other
  misc_feature (322)..(322): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacatagcctgcctccgtgtctgagactcctggacagtcgatcaccatctcctgcactggaaccagcagtgacgttggtgcttataattatgtctcctggttccaacagcattcaggcagccgcccgaaactcttaatttatgagtctttcgtcgcctnagggtttctagtcgcttctccggctccaagtctggcaacacggcctccctgaccatcctctagactcaggctagaggacgaggctgactattattgcagctcatatactagaagtcaatggtatccatggtctgttcggcggagggaccaagtcgaccgtctaggcacgccaggtcc

SEQ ID NO: 83560 - DNA, 507 bp, Homo sapiens
  misc_feature: GYAE6OF01EXXL5.36.23.C01.1.454.CMB.1.raw
  modified_base (422)..(422): a, c, t, g, unknown or other
  misc_feature (422)..(422): n is a, c, g, or t
tcagtacgctgtctcacgaccggtgctcgatttagtacacgtgattagggattgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaatttatgtaggtctttcgtcgccctcgtagggtttctagtcgcttctccggctccaagtctggcaacacggcctcctgaccatctctagactccaggctgaggacgaggctgactattatgcanctcatatactagaagtcaatggtatccactggctggttcggcgggaggccaaggttcgaccgtctacggtacacgcccgaggtcc

SEQ ID NO: 83561 - DNA, 493 bp, Homo sapiens
  misc_feature: GYAE6OF01B9Q2Q.36.23.C01.1.454.CMB.1.raw
  modified_base (454)..(454): a, c, t, g, unknown or other
  misc_feature (454)..(454): n is a, c, g, or t
tcagtacgctgtctcacgaccggtgctcgatttagtacacgtgattagggattgggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgcccgaaactcttaatttatgagtctttcgtcggcctcagggtttctagtcgcttctccggctccaagtctggcaacacggcctcctgaccatctctagactccaggctgagacgaggctgactattatgcagctcatatactgaagtcaatggtaatcactggctgttcggnggagggccaagttgaccgtcctaggtcagcccaaggtcc

SEQ ID NO: 83562 - DNA, 531 bp, Homo sapiens
  misc_feature: GYAE6OF01DYLF3.36.23.C01.1.454.CMB.1.raw
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctctggttccaacagcattcaggcagcgccccgaaattcttaatttatgtagttctttcgtcggtcctcgtagggttctagtcgtcttctccggctccaagtctggcacgacggcctcctgacctatcctctacgactccgaggctggagacgagctgactatatgcagctactatatactagtaagtcaatggtaactccgagttcggcttgggttcggacggagggtacctaggttccgaccgttaccgtacggtacacggcccgaaggtcccg

SEQ ID NO: 83563 - DNA, 521 bp, Homo sapiens
  misc_feature: GYAE6OF01CJ1AW.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttatattatgtctctggttccaacagcattcaggcagcgcccgaaactcttaatttatgagttctttcgtcggcctcgagggtttctagtcgcttctccggctcaagtctggcaacacggcctcctgaccatctctagactcagctgagacgagctgactattatgcagctacatatactgaagtcaagtcggtaactccaacgtggacttggttccggcgggaacgggacctaaggttcgaacccgttcctagggacccaggcccgaaaggtcccg

SEQ ID NO: 83564 - DNA, 494 bp, Homo sapiens
  misc_feature: GYAE6OF01A8AQD.36.23.C01.1.454.CMB.1.raw
  modified_base (459)..(459): a, c, t, g, unknown or other
  misc_feature (459)..(459): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaatcttaatttatgaggttctttcgtcggtccctcgagggtttctagtcgcttctccggctccagtctgcaacacggcctccctgaccatctctagactccagctggacgacgaggctgacttattattgcagctcatatactgaatcaatgtatccatgctgtcggnggaggcagtgaccgtctagtcacgccaaggtcccg

SEQ ID NO: 83565 - DNA, 512 bp, Homo sapiens
  misc_feature: GYAE6OF01CX44D.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaatttatgaggttctttcgtcggccctcgagggtttctagttcgcttctccggctcaagtctggcaacacggcctccctgaccatctctagactcagctgaggcgaggctgactattattgcagctcatatactgaagtcaagtggtatcctactggtcttgtcgggcggagggaccaagttcgaccgtccgtaggtccacgcccgaaggtccc

SEQ ID NO: 83566 - DNA, 507 bp, Homo sapiens
  misc_feature: GYAE6OF01DDU1J.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcatttcaggcagcgcccgaaactcttaatttatgaggttctttcgtcggccctcaggggtttctagtcgcttctccggctccaagtctggcaacacggcctccctgaccatctctagactccaggctgaggacgaggctgactattattgcagctcatatactgaatcaatggtatccatggctggttcggcggaggaccaagttgaccgtcctaggtcacgcccgaaggtcccg

SEQ ID NO: 83567 - DNA, 538 bp, Homo sapiens
  misc_feature: GYAE6OF01EMFMA.36.23.C01.1.454.CMB.1.raw
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttgtgcttataattatgtctcctggttccaacagcattcaggcagcgccccgaaactcttaatttatgagtctttcgtcgcctcagggtttctagtcgcttctccggctccaagtctggcaacgacggcctccctgaccatctctagactccaggctgaggacgaggctgactattattgcagctcatatactagaagttcaatggtatcctacgtcggcttggttccgggacgggtaaggggacctaacgggtttgaaccccggttccgtacgggttacgacgtccccgaaagggtccccg

SEQ ID NO: 83568 - DNA, 489 bp, Homo sapiens
  misc_feature: GYAE6OF01BLEC5.36.23.C01.1.454.CMB.1.raw
  modified_base (457)..(457): a, c, t, g, unknown or other
  misc_feature (457)..(457): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctggcccagtctggcctgacacagcctgcctccgtgtctgagactcctggacagtcgatcaccatctcctgcactggaaccagcagtgacgttgtgcttataattatgtctcctggttccaacagcattcaggcagccgccccgaaactcttaatttatgaggttctttcgtcggccctcgtagggtttctagtcgcttctccggctccaagtctggcaacacggcctcctgaccatctctagctcagctgaggacgagctgacttattattgcagctcatactactgaagtcaatgtatcatgctgtcggnggaggcagtgaccgtcaggcagcccaggtccc

SEQ ID NO: 83569 - DNA, 715 bp, Homo sapiens
  misc_feature: GYAE6OF01EI79V.36.23.C01.1.454.CMB.1.raw
  modified_base (380)..(380): a, c, t, g, unknown or other
  misc_feature (380)..(380): n is a, c, g, or t
tcagtacgctgtctcacgaccggtgctcgatttagtacacgtgattagggagttggggggggtctcaggaggcagcgctctcaggacatctccaccatggcctgggctctgctgctcctcaccctcctcactcagggcacagggtcctgggcccagtctggcctgacacagcctgcctcgtgtctgagactcctggacagtcatcacatctcctgcactggaaccagcagtgtactttggtagtaacaatcatgtctcctggtaccaacagtacccaggacaaacgcccccaaactcatctattttgacgtcggtagtcggcctgagtaatttctaatcgcttctctggctccaagtctgacccaacacggccttcccgngacctatcctcgtcgggcctaccgacgccgttaggaacggtaccggaacggtcttagtaacttttaactttaccttcgtttccctacgtaactactttaacgaacggtcccgggttaaggtttaaccgtttcgggttaccgtttttcccgggggaccgggggtacccgggtaaccccccgtacccggttaccggtaacccccgggtttacccggttaaccggggtttaccgaacccgggtacccccgtaaaacgggggttcccccgtttacccgggtacccccccccggtttacgggtttaccccttaacccgttcccggttttcccccccgggg

SEQ ID NO: 83570 - DNA, 526 bp, Homo sapiens
  misc_feature: GYAE6OF01C233D.36.23.C01.1.454.CMB.1.raw
  modified_base (194)..(194): a, c, t, g, unknown or other
  misc_feature (194)..(194): n is a, c, g, or t
  modified_base (369)..(369): a, c, t, g, unknown or other
  misc_feature (369)..(369): n is a, c, g, or t
  modified_base (379)..(379): a, c, t, g, unknown or other
  misc_feature (379)..(379): n is a, c, g, or t
  modified_base (410)..(410): a, c, t, g, unknown or other
  misc_feature (410)..(410): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactccnggacagtcatcaccatctcctgcactggaaccagcagtgacgttggtgcttataattatgtctcctggttccaacagcattcaggcagccgaccccgaaactcttaatttatgtagttctttcgtcggccctcgtagggtttctagtcgtcttctccggctccagtctggcaacncggcctcccngaccatctctagacctccaggctgaggacgngctgactattattgcagctacattactactagaagtctaagtgtactcccagtggtctggttcggcggtaggacctaaggttcgacccgttcgtaggtccacgcccgaaggtcccg

SEQ ID NO: 83571 - DNA, 489 bp, Homo sapiens
  misc_feature: GYAE6OF01AZTAV.36.23.C01.1.454.CMB.1.raw
  modified_base (451)..(451): a, c, t, g, unknown or other
  misc_feature (451)..(451): n is a, c, g, or t
tcagtacgctgtctcacgaccggtgctcgatttagtacacgtgattagggattgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgcccgaaactcttaatttatgagtctttcgtcgcctcagggtttctagtcgcttctccggctccaagtctggcaacacggcctccctgaccatctctagactccagctgaggacgagctgactattatgcagctcatatactgaagtcaatgtatcatgctggttcgnggaggccagttgaccgtctaggtcagcccgaaggtccg

SEQ ID NO: 83572 - DNA, 516 bp, Homo sapiens
  misc_feature: GYAE6OF01AJADT.36.23.C01.1.454.CMB.1.raw
  modified_base (371)..(371): a, c, t, g, unknown or other
  misc_feature (371)..(371): n is a, c, g, or t
tcagtacgctgtctcacgaccggtgctcgatttagtacacgtgattagggattgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgcccgaaactcttaatttatgagtctttcgtcgcctcagggtttctagtcgcttctccggctccaagtctggcaacacggcctccctnaccatctctagactccaggctgaggacgaggctgactatattgcagctcatatactagaagtcaatggtatccactcggtcttcggttcgggcggtagggccctaaggttcgaccgttccgtaggtaccacgcccgaaggtcccg

SEQ ID NO: 83573 - DNA, 759 bp, Homo sapiens
  misc_feature: GYAE6OF01C6RY8.36.23.C01.1.454.CMB.1.raw
  modified_base (269)..(269): a, c, t, g, unknown or other
  misc_feature (269)..(269): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgacgactcctggacagtcgatcaccatctcctgcactggaaccagcagtgacgttgtgcttataatatgtctcctggttccaanagctattcaggcagccgacccgaaactcttaatttatgtagttctttcgtccggtcccttacgtacggggtttctacggttccgtcgtttccgtcccggtcctacccgtaaacggttccgttacggggacctaaaccgtacccgggtccccttaccccgtacggtaccctaacgttccttaccgttaacgtacccttaccgtacgggtccgttacgggaacgggtaccggagggtaccgttacggtaaaccctttagttttaacgtttcggtacctaacgggttcccttaactaacgtttaaccttaaacgttacggttaaaacgttaccgtaaacggttacgggttaacttaccccggtaagtttccgggtcgttacgggtttaccggggacggggtaacggggtaacccttaacgggtttaccggtaaccccggttacccggttaacgggtacccgttaacggacccccggtaaagggttccccccgg

SEQ ID NO: 83574 - DNA, 520 bp, Homo sapiens
  misc_feature: GYAE6OF01DJ1US.36.23.C01.1.454.CMB.1.raw
  modified_base (270)..(270): a, c, t, g, unknown or other
  misc_feature (270)..(270): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacngcattcaggcagccgccccgaaactcttaatttatgaggttctttcggtcgcctcgtagggtttctagtcgcttctccggctcagtctgcaacacggcctcctgaccatcctctacgactccaggtctaggacggacgaggctacgacttattagttgctagtctcattactactagaagtcaagtgtactccgatggctggtcggacggaggacaaggttgaccgtctaggccacgtcccgaaggtccg

SEQ ID NO: 83575 - DNA, 503 bp, Homo sapiens
  misc_feature: GYAE6OF01AKVA8.36.23.C01.1.454.CMB.1.raw
  modified_base (228)..(228): a, c, t, g, unknown or other
  misc_feature (228)..(228): n is a, c, g, or t
  modified_base (363)..(363): a, c, t, g, unknown or other
  misc_feature (363)..(363): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggcagcgccccgaaactcttaatttatgaggtctttcgtcggcctgagggtttctagtcgcttctccggctccagtctggcaacncggcctccctgacccatctctagactccaggctgaggacgaggctgactattattgcagctcatatactgaagtcaatggtatccatgcttggtcggcggaggccaaggttgaccgtcgtaggtcacgcccgaaggtccg

SEQ ID NO: 83576 - DNA, 535 bp, Homo sapiens
  misc_feature: GYAE6OF01A3ULI.36.23.C01.1.454.CMB.1.raw
tcagtacgctgtctcacgaccggtgctcgatttagtacacgtgattagggattggggggaagaggaagactgacggtcctgtctcaggtgcagctgcagcagtcgggcccaggagtggtgaagccttcggagaccctgtccctcacctgcgctgtgtctggagcctccctcggcggagatgaatggtggagttgggtccgccagcccccagggaaggggctgagttggattggtgaaataaatgagaccgggggcaccaactacaatgcgtccctcaggggtcgagtcaccatatctgcagacaagtccaagaaccacttctccctgaggctgacctctgtgaccgccgcggactcggccatatattattgtgcgagagtttttgcaggatcttggggcggtatcgacgtctggggtcaagggatcacggtcatcgtctcctcagcctccaccaagggcccatccggtcttccccctggccgccctgcctccaggacgccacctccgagacgcacacgcggccctgggctgcccg

SEQ ID NO: 83577 - DNA, 488 bp, Homo sapiens
  misc_feature: GYAE6OF01E0NUY.36.23.C01.1.454.CMB.1.raw
  modified_base (459)..(459): a, c, t, g, unknown or other
  misc_feature (459)..(459): n is a, c, g, or t
  modified_base (479)..(479): a, c, t, g, unknown or other
  misc_feature (479)..(479): n is a, c, g, or t
tcagtacgctgtctcacgaccggtgctcgatttagtacacgtgattagggattggggggggtctcaggaggcagcgctctcaggacatctccaccatggcctgggctctgctgctcctcacccttctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaatttatgtagtctttcgtcggccctcaggggtttctagtcgcttctccgctccagtctggcaacacggcctccctgacctatctctagactccaggctgaggacgaggctgactattatgcagctcatatactagaagtcaatgtatcactgctgttcgngaggcagtgaccgtctagtnagccaggcg

SEQ ID NO: 83578 - DNA, 500 bp, Homo sapiens
  misc_feature: GYAE6OF01D3YWB.36.23.C01.1.454.CMB.1.raw
  modified_base (460)..(460): a, c, t, g, unknown or other
  misc_feature (460)..(460): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaatttatgaggtctttcgtcggccctcagggtttctagtcgcttctccggctccaagtctggcaacacggcctccctgaccatctctagactccaggctgaggacgaggctgactattatgcagctcatatactgaatcaatgtatccatggctggttcggnggagggaccaagttgaccgtctaggtcacgcccaaggtcc

SEQ ID NO: 83579 - DNA, 504 bp, Homo sapiens
  misc_feature: GYAE6OF01ER1Y6.36.23.C01.1.454.CMB.1.raw
  modified_base (423)..(423): a, c, t, g, unknown or other
  misc_feature (423)..(423): n is a, c, g, or t
  modified_base (462)..(462): a, c, t, g, unknown or other
  misc_feature (462)..(462): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaatttatgagtctttcgtcggcctcagggtttctagtcgcttctccggctccaagtctggcaacacggcctccctgaccatctctagactccaggctgaggacgagctgactattattgcagctnatatactgaagttcaatggtatcacgtgcttgttcgggngagggaccaagttgaccgtcgtagtcacgcccgaaggtcccg

SEQ ID NO: 83580 - DNA, 497 bp, Homo sapiens
  misc_feature: GYAE6OF01BGC8V.36.23.C01.1.454.CMB.1.raw
  modified_base (461)..(461): a, c, t, g, unknown or other
  misc_feature (461)..(461): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaatttatgtagtctttcgtcggccctcgagggtttctagtcgcttctccggctccaagtctggcaacacggcctccctgaccatctctacgactccaggctgaggacgaggctgactattatgcagctcatatactagaagtcaatgtatccatgctggtcgnggaggacagtgaccgtctaggcacgcccgaggtccg

SEQ ID NO: 83581 - DNA, 518 bp, Homo sapiens
  misc_feature: GYAE6OF01ANMBZ.36.23.C01.1.454.CMB.1.raw
  modified_base (440)..(440): a, c, t, g, unknown or other
  misc_feature (440)..(440): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaatttatgaggtctttcgtcggccctcgaggggtttctagtcgcttctccggctccaagtctggcacacggcctccctgaccatctctagactccaggctgaggacgaggctgactattattgcagctcatatactgaattnaattggtatccactggtctggttccgggaggtagggaccaaggttcgaccgttccgtaggtcacgcccgaaggtcccg

SEQ ID NO: 83582 - DNA, 523 bp, Homo sapiens
  misc_feature: GYAE6OF01BXXL9.36.23.C01.1.454.CMB.1.raw
  modified_base (471)..(471): a, c, t, g, unknown or other
  misc_feature (471)..(471): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgccccgaaactcttaatttatgaggttctttcgtcgccctcgtagggtttctagtcgcttctccggctccaagtctggcaacacggcctccctgaccatctctagcctcaggctgaggacgaggctgactattattgcagctcatatactagaagttcaatcggtatccgacgtggtctggttcggngggacgggacctaaggttcgaccgttccgtaggtcacggcccgaaggtcccg

SEQ ID NO: 83583 - DNA, 507 bp, Homo sapiens
  misc_feature: GYAE6OF01BBSIV.36.23.C01.1.454.CMB.1.raw
tcagtacgctgtctcacgaccggtgctcgatttagtacacgtgattagggattggggggggtctcaggaggcaccgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgcccgaaactcttaatttatgtaggtctttcgtcgccctcgtagggtttctagtcgcttctccggctcagtctgcacacgcctcctgacatctctagactccaggctgagacgagctgactattatgcagctcatatactagaatcaatggtatccatggctggttcggcggtaggacctaggttcgaccgttcgtacggtcagcccgaaggtcctaccccgg

SEQ ID NO: 83584 - DNA, 501 bp, Homo sapiens
  misc_feature: GYAE6OF01AKJKX.36.23.C01.1.454.CMB.1.raw
  modified_base (365)..(365): a, c, t, g, unknown or other
  misc_feature (365)..(365): n is a, c, g, or t
  modified_base (380)..(380): a, c, t, g, unknown or other
  misc_feature (380)..(380): n is a, c, g, or t
  modified_base (461)..(461): a, c, t, g, unknown or other
  misc_feature (461)..(461): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaatttatgaggtctttcgtcggccctcaggggtttctagtcgcttctcggctccaagtctggcaacncggcctccctgaccntctctagactccaggctgaggacgaggctgactattattgcagctcatatactgaagtcaatgtatccactggctgtcggnggaggccagttcgaccgtcgtaggtcagcccaaggtcccg

SEQ ID NO: 83585 - DNA, 567 bp, Homo sapiens
  misc_feature: GYAE6OF01D6WDS.36.23.C01.1.454.CMB.1.raw
  modified_base (382)..(382): a, c, t, g, unknown or other
  misc_feature (382)..(382): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcacatctcctgcactggaaccagcagtgacgttggtgcttataattatgtctcctgttccaacagcattcaggcacgccgacccgtaaattcttaatttatgtagttctttcgtcggtcctgtagggttctagtcgtcttcgtccggctccaagtctggaccaacgtcggccctccncgacctatctactacgctccgaggtctaggacggacgagtctagacttattgttgactagtctagtatagtactagtaactcaagttcggtactaccgtagtcggtacgttcggttacgggacggtaacgggtacctaacggttccgacccggttccgtaaggtccgaccgtcccgacggtcccg

SEQ ID NO: 83586 - DNA, 504 bp, Homo sapiens
  misc_feature: GYAE6OF01BYK8P.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaatttatgagtctttcgtcggcctcagggtttctagtcgcttctccggctccaagtctggcaacacggcctccctgaccatctctagactccagctgaggacgaggctgactattattgcagctcatatactgaagtcaagtggtatccactggcttggttcggcggagggccaagttcgaccgtctaggtcacgcccaaggtccc

SEQ ID NO: 83587 - DNA, 704 bp, Homo sapiens
  misc_feature: GYAE6OF01EDYJ9.36.23.C01.1.454.CMB.1.raw
  modified_base (229)..(229): a, c, t, g, unknown or other
  misc_feature (229)..(229): n is a, c, g, or t
  modified_base (274)..(274): a, c, t, g, unknown or other
  misc_feature (274)..(274): n is a, c, g, or t
  modified_base (299)..(299): a, c, t, g, unknown or other
  misc_feature (299)..(299): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacgagggtcctgggcccagtctggcctgacacagcctgccctccgtgtctgagactcctggacagtcgatcaccatctctgcactggaaccngcagtgacgttgtagttataacttgtctctgtaccaacagcaccngcagacgccccaaatcatgtattangagtacagaaatccgcctcgtacgggtttctgactcgtcttctcgtcggtcctaccgaagttcgtgggaccgaccgtacccggtcccttccccgtaggtaaccctagttcccgttcggtcggggtcccctcccgtaacggtcccgttagggaacgggacggtaacgggtccttaggtaacttttacgttacgttcgacctacgtaccttactaagttaaacgttaaaccgaaaggttaccgaccgtaacgtacctaacccgttccgttaccggttaacccggtttaccgggtaaaccgttaccgggggaaaccccgttaacggggttacccctaaaccgggtttccggttaacccggttaaccgggttacccctaaaccgggaaccccccggtaaaacccccggg

SEQ ID NO: 83588 - DNA, 604 bp, Homo sapiens
  misc_feature: GYAE6OF01BE40H.36.23.C01.1.454.CMB.1.raw
  modified_base (426)..(426): a, c, t, g, unknown or other
  misc_feature (426)..(426): n is a, c, g, or t
tcagtacgctgtctcacgaccggtgctcgatttagtacacgtgattagggattggggggaagaggaagactgacggtcctgtctcaggtgcagctgcagcagtcgggcccaggagtggtgaagccttcggagaccctgtccctcacctgcgctgtgtctggagcctccctcggcggagatgaatggtggagttgggtccgccagcccccagggaaggggctgagttggattggtgaaataaatgagaccgggggcaccgaactacaatgcgtccctcaggggtcgagtcaccatatctgcagacagtccaagaccacttctcctgaggctgacctctgtgaccgccgcggactcggccatactattattgtgcgagagtttttgctaggatcgttggggcggtagtcgacgtcgtgggtcaagggntcgacggtcatcgtctcctcacgcctccaccgaacgggccctaacgtccggttccttcccccgtcggcccgtcccccttcggcccttcccgacgggtaccgcccgtaacccgttcccggacggacgacccgtaaccgaccggacccgggcccctcgggggtccctcggtacccccggg

SEQ ID NO: 83589 - DNA, 562 bp, Homo sapiens
  misc_feature: GYAE6OF01D9LIN.36.23.C01.1.454.CMB.1.raw
  modified_base (268)..(268): a, c, t, g, unknown or other
  misc_feature (268)..(268): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctctgcactggaaccagcagtgacgttggtgcttataattatgtctctgttcaacngcattcaggcacgcgccccgaaactcttaatttatgtaggttctttcgtcgccctcgtagggtttctagtcgtcttctccgctcagtctggcaacacggcctccctgaccatctctagactcgagctgaggacgagctgactattatgcagtctctatatactgtaagtcaagttggtactcccgagttcggtcgttaggttccggggagggtaacggggtaaccctaaacgggtttcgtaacccgggttcccgttaacgggtacccaaaccgggtccccgaaagggtcccccg

SEQ ID NO: 83590 - DNA, 566 bp, Homo sapiens
  misc_feature: GYAE6OF01BME7J.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctctgcactggaaccagcagtgacgttggtgcttataattatgtctcctggttccaacagcattcaggcagcgccccgaaactcttaatttatgagtctttcgtcgccctgtagggtttctagtcgtcttctccggctccaagtctggacaacgacggcctccctgacctatctctagactccaggctgaggacgagctgactattatgcagctacattactactagaagttcaagttggtaactccgtacgtggtacgttcgggttaccgggcgggaacgggtacccgtaaaggtttccggtaaccccggttaccgttacgggttacccaacggcccccgtaaagggtcccccg

SEQ ID NO: 83591 - DNA, 497 bp, Homo sapiens
  misc_feature: GYAE6OF01B21VB.36.23.C01.1.454.CMB.1.raw
  modified_base (362)..(362): a, c, t, g, unknown or other
  misc_feature (362)..(362): n is a, c, g, or t
  modified_base (458)..(458): a, c, t, g, unknown or other
  misc_feature (458)..(458): n is a, c, g, or t
tcagtacgctgtctcacgaccggtgctcgatttagtacacgtgattagggattggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaatcttaatttatgagtctttcgtcggccctcaggggtttctagtcgcttctccggctccaagtctggcaacncggcctcctgaccatctctagactccaggctgaggacgaggctgactattattgcagctcatatactgaatcaatggtatccatggctggttcggnggagggccaaggttgaccgtctaggtcagcccaaggtcc

SEQ ID NO: 83592 - DNA, 524 bp, Homo sapiens
  misc_feature: GYAE6OF01C7S75.36.23.C01.1.454.CMB.1.raw
  modified_base (226)..(226): a, c, t, g, unknown or other
  misc_feature (226)..(226): n is a, c, g, or t
  modified_base (487)..(487): a, c, t, g, unknown or other
  misc_feature (487)..(487): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcacatctcctgcactggaaccngcagtgacgttggtgcttataattatgtctcctggttccaacagcattcaggcagcgacccgaaatcttaatttatgagttctttcgtcgcctcgagggtttctagtcgcttctcggctccaagtctggcaacacggcctcctgaccatctctggctcagcctgaggacgaggctgattattactcgttctcactattacaagccggtagttacgttggtcgtttcggcgggcggacccaccgtcgaccgtccgtaggtcncgcccgaaggcctacgcccctcggtctactcttcccg

SEQ ID NO: 83593 - DNA, 515 bp, Homo sapiens
  misc_feature: GYAE6OF01BV65B.36.23.C01.1.454.CMB.1.raw
  modified_base (378)..(378): a, c, t, g, unknown or other
  misc_feature (378)..(378): n is a, c, g, or t
  modified_base (464)..(464): a, c, t, g, unknown or other
  misc_feature (464)..(464): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaatcttaatttatgagttctttcgtcggccctgtagggtttcagtcgcttctccggctccaagtctggcaacacggcctcctgaccntctctagactccaggctgaggacgagctagactattatgcagtctcaatatactagaagtcaagtgtatccactggcttggtcggngggaacgggcctaaggttcgacccgtcgtaggtccacgcccgaaggtcccg

SEQ ID NO: 83594 - DNA, 493 bp, Homo sapiens
  misc_feature: GYAE6OF01CFXR1.36.23.C01.1.454.CMB.1.raw
  modified_base (413)..(413): a, c, t, g, unknown or other
  misc_feature (413)..(413): n is a, c, g, or t
tcagtacgctgtctcacgaccggtgctcgattagtacacgtgattagggattggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttgtgcttataattatgtctcctggttccaacagcattcaggcagcgcccgaaatcttaattatgagtctttcgtcgcctcgagggtttctagtcgcttctccggctccaagtctggcaacacggcctcctgaccatctctagactccaggctgagacgaggctgactatatgcagctnatatactgaagtcaatgtatccatggctggttcggaggaggaccaagttcgaccgtctaggtccacggcccgaaggtccc

SEQ ID NO: 83595 - DNA, 506 bp, Homo sapiens
  misc_feature: GYAE6OF01B1C2R.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcaggtgacgttggtgcttataattatgtctcctggttccaacagcattcaggcagccgcccgaaatcttaatttatgagtctttcgtcggccctgtagggtttctagtcgcttctccggctccaagtctggcaacgacggcctcctgaccatctctagactcgagctgacggacgagctgactattatgcagctcatatactgaatcaagtggtactccgatggctggttcggacggaggctaagttcgaccgtctaggtacacgccgaaggtcccg

SEQ ID NO: 83596 - DNA, 504 bp, Homo sapiens
  misc_feature: GYAE6OF01C1OOX.36.23.C01.1.454.CMB.1.raw
  modified_base (270)..(270): a, c, t, g, unknown or other
  misc_feature (270)..(270): n is a, c, g, or t
  modified_base (350)..(350): a, c, t, g, unknown or other
  misc_feature (350)..(350): n is a, c, g, or t
  modified_base (442)..(442): a, c, t, g, unknown or other
  misc_feature (442)..(442): n is a, c, g, or t
  modified_base (492)..(492): a, c, t, g, unknown or other
  misc_feature (492)..(492): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctctggttccaacngcattcaggcagccgacccgaaactcttaatttatgagttctttcgtcggccctcgtagggtttctagtcgcttctccgntccaagtctggcaacacggcctcctgacctatctctagactccaggctgacggacgaggtctgactattattgcagctcattatactgaatnaatgtactccagtgctgttcggcggaggacctagttgacccgtctagtcncgccgaaggtcc

SEQ ID NO: 83597 - DNA, 512 bp, Homo sapiens
  misc_feature: GYAE6OF01AIK45.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaatttatgaggttctttcgcggcctcgagggtttctagtcgcttctccggctcagtctggcacacggcctcctgaccatctctagactccagctgaggacgaggctgactattattgcagctcatactactagaagtcaatggtatccactggtctaggttcggagggacgggcctaaggttcgacccgttcgtaggcacgcccgaaggtcccg

SEQ ID NO: 83598 - DNA, 499 bp, Homo sapiens
  misc_feature: GYAE6OF01BDT6D.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaattatgagtctttcgtcgcctcagggttctagtcgcttctccggctccaagtctggcaacacggcctccctgaccatctctagactccaggctgaggacgaggctgactattattgcagctcatatactgaatcaatgtatccatgctgtcggacggaggaccaggtgaccgttctaggtccaacggcccgaaggtcccg

SEQ ID NO: 83599 - DNA, 506 bp, Homo sapiens
  misc_feature: GYAE6OF01BQ3VT.36.23.C01.1.454.CMB.1.raw
  modified_base (464)..(464): a, c, t, g, unknown or other
  misc_feature (464)..(464): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgcccgaaactcttaattatgagtctttcgtcgcctcgagggtttctagtcgcttctccggctcaagtctggcaacacggcctccctgaccatcctctagacctcaggctgaggacgaggctgacttattattgcagctacgatatactgaattcaatggtatccagtggcttggtcggnggaggaccaagttcgaccgtctaggtcacgccgaaggtcccg

SEQ ID NO: 83600 - DNA, 520 bp, Homo sapiens
  misc_feature: GYAE6OF01A9QN5.36.23.C01.1.454.CMB.1.raw
  modified_base (363)..(363): a, c, t, g, unknown or other
  misc_feature (363)..(363): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctgggcctgacacagcctgcctccgtgtctgagactcctggacagtcgatcgaccatctcctgcactggaaccagcagtgacgttggtgcttataattatgtctcctggttccaacagcattcaggcagcgcccgaaactcttaatttatgagtctttcgtcgccctcagggtttctagtcgcttctccggctccaagtctggcacncggcctcctgaccatctctagactcagctgaggacgaggctgactattatgctagctcatatactgaacgtcaagtggtatccgtacgtggtctggttcgggaccggtagggacctaggttcgacccgttccgtacggtccacgcccgaaggtcccg

SEQ ID NO: 83601 - DNA, 516 bp, Homo sapiens
  misc_feature: GYAE6OF01DBSY8.36.23.C01.1.454.CMB.1.raw
  modified_base (442)..(442): a, c, t, g, unknown or other
  misc_feature (442)..(442): n is a, c, g, or t
  modified_base (480)..(480): a, c, t, g, unknown or other
  misc_feature (480)..(480): n is a, c, g, or t
  modified_base (504)..(504): a, c, t, g, unknown or other
  misc_feature (504)..(504): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgaccccgaaaacttcctttaattttactgtaggtttctttcgtccggccctcgtaggggtttctagtcgctttctccggctccaagtctggcaacacggcctccctgaccatctctacgactccaggctgacggcgagctgactattattgcagctnatatactgaatcaagtgtactcctagtgctggttcggnggaggtacagttcgaccgtctagnacgccaggtccg

SEQ ID NO: 83602 - DNA, 509 bp, Homo sapiens
  misc_feature: GYAE6OF01C20QA.36.23.C01.1.454.CMB.1.raw
  modified_base (236)..(236): a, c, t, g, unknown or other
  misc_feature (236)..(236): n is a, c, g, or t
  modified_base (250)..(250): a, c, t, g, unknown or other
  misc_feature (250)..(250): n is a, c, g, or t
  modified_base (270)..(270): a, c, t, g, unknown or other
  misc_feature (270)..(270): n is a, c, g, or t
  modified_base (272)..(272): a, c, t, g, unknown or other
  misc_feature (272)..(272): n is a, c, g, or t
  modified_base (297)..(297): a, c, t, g, unknown or other
  misc_feature (297)..(297): n is a, c, g, or t
  modified_base (311)..(311): a, c, t, g, unknown or other
  misc_feature (311)..(311): n is a, c, g, or t
  modified_base (457)..(457): a, c, t, g, unknown or other
  misc_feature (457)..(457): n is a, c, g, or t
tcagtacgctgtctcacgaccggtgctcgatttagtacacgtgattagggagttgggggggtctcaggaggccagcgctctcaggacattctccaccatggcctgggctctgctgctcctcaccctcctcactcagggcacagggtcctgggtcccagtctggcctgacacagcctgcctccgtgtctgacgactcctggacgagtccgatccaccattcgtcctgcactggaccngcagtgacgttgtncttatatatgtctctgtcangnatcaggcagcgccgaatcttaattngagtcttgcgcctnaggtttcagtcgcttcaccgatccaagtctaggcctaaacgccggacctcccgtgaccattctctagacctcagtcagagacgtagctgactattatgacagtctacgatatactagaagtcaagtgtaatccagtgactgtcggnggtacggacctaaggttcgaccgttaccgtagactacggcccgaaggtcccg

SEQ ID NO: 83603 - DNA, 516 bp, Homo sapiens
  misc_feature: GYAE6OF01BSOOA.36.23.C01.1.454.CMB.1.raw
  modified_base (370)..(370): a, c, t, g, unknown or other
  misc_feature (370)..(370): n is a, c, g, or t
  modified_base (467)..(467): a, c, t, g, unknown or other
  misc_feature (467)..(467): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctctgttccaacagcattcaggcagcgccccgaaactcttaatttatgtaggttctttcgtcggtcccttcgtaggggtttctagtcgtcttctccggctccaagtctggcaacncggcctccctgaccatctctagactcaggctgaggacgagctgactattattgcagctcattatactgaatcaatggtaatccatgcgttggtcggnggagggaccaaggttcgaccgttcgtaggtaccacgcccgaaggtcccg

SEQ ID NO: 83604 - DNA, 742 bp, Homo sapiens
  misc_feature: GYAE6OF01DKMJ2.36.23.C01.1.454.CMB.1.raw
tcagtacgctgtctcacgaccggtgctcgatttagtacacgtgattagggattgggggaagaggaagactgacggtcctgtctcaggtgcagctgcagcagtcgggcccaggagtggtgaagccttcggagaccctgtccctcacctgcgctgtgtctggagcctccctcggcggagatgaatggtggagttgggtccgccacggcccccgagggaaggggctggtagttggagttaggtagaaagtaagtgacgggaccgggacaacctaactacaagtcgccgtcccgtacgacgggtcgagtccactatatcgtcgacacgaacacgtaccaacgaaaaccctcgttacctcccgtagacggtctcgacccttcgtcggtcgacccggtccgcggtaccgtcggacctagttacttagtttagtttggtacgtcgtaaggtaggttttttcgacgtagggtacgtcggtttggggtaccggtacgttacgtcgggtcgtaggggtacgaggacgtacgacccggtgtactccgtctccgtccaccgtaccgtacccgaacccgaaggtccccgtccgttacccggtcccgttacccccgtccggcccgtccccgtccggtaccgtaccggaaccggtacccgtcccgtaacccgtacccggaaccgtacccggacccgtaccccggtacccgggtacccgggttccccgggttccggtcccggttccggtaaccccggg

SEQ ID NO: 83605 - DNA, 557 bp, Homo sapiens
  misc_feature: GYAE6OF01A33UI.36.23.C01.1.454.CMB.1.raw
  modified_base (229)..(229): a, c, t, g, unknown or other
  misc_feature (229)..(229): n is a, c, g, or t
  modified_base (272)..(272): a, c, t, g, unknown or other
  misc_feature (272)..(272): n is a, c, g, or t
  modified_base (364)..(364): a, c, t, g, unknown or other
  misc_feature (364)..(364): n is a, c, g, or t
  modified_base (378)..(378): a, c, t, g, unknown or other
  misc_feature (378)..(378): n is a, c, g, or t
  modified_base (407)..(407): a, c, t, g, unknown or other
  misc_feature (407)..(407): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacgagggtcctgggcccagtctggcctgacacagcctgcctccgtgtctgagactcctggacagtcgatcaccatctcctgcactggaaccngcagtgacgttggtgcttataattatgtctcctggttccaacngcattcaggcagccgccccgaaactcttaatttatgagttctttcgtcggccgtcgtagggtttctagtcgtcttcgtccggctccaagtcngcacacggcctccncgacatctctacgctccagctgaggacgngctgacttattagtgcacgtctacattactacttagaacgtactaagttggtactcctagttcggtcgttcgggttcgggcgggaacggggtccctaaaggttcggacccgttaccgtacggtaccacggtaccccgtagggtacccccg

SEQ ID NO: 83606 - DNA, 552 bp, Homo sapiens
  misc_feature: GYAE6OF01C95ZB.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgacccgaaactacttaatttatgtagttctttcgtcggccctgtaggggtttctagttcgtcttctcccggtctcctaagtctgggcaacaccggccctccctcgaccatctctagactccaggtctgaggacgagctagactattattgcagtctcatatactgaatcaagtcggtataccacgtggtcttggtaccggcgggaagggtaccctaaaggtttcgacccggttaccttagggtaccaacggcccgaaagggtccccg

SEQ ID NO: 83607 - DNA, 637 bp, Homo sapiens
  misc_feature: GYAE6OF01DJBB6.36.23.C01.1.454.CMB.1.raw
  modified_base (242)..(242): a, c, t, g, unknown or other
  misc_feature (242)..(242): n is a, c, g, or t
  modified_base (495)..(495): a, c, t, g, unknown or other
  misc_feature (495)..(495): n is a, c, g, or t
tcagtacgctgtctcacgaccggtgctcgatttagtacacgtgattagggattggggggggtctcagaaggcagcgctctcaggacatctccaccatggcctgggctctgctgctcctcaccctcctcactcagggcacagggtcctgggcccagtctggcctgacacagcctgcctccgtgtctgagactcctggacagtcatcaccatctcctgcactggaaccagcagtgacgttggtnacttataattatgtctctggttaccaacaacattcgaggcacgccgtaccccgtaaattcctttaatttaagtgaaggtttcctttccggtcggtcccttacgtaggggttttctacgttcggtctttaccgtccggcttacccgtaagtccgtaggaccaaaacgcccggtccctcccgtgaaccctattcctactacgacctcccgaggctacgaaggtacgagtcctgaacttagtattgctaagctacnttaactatagtaagtacaaagttcggtactccgtaacgtggaccttgggttaccgggaccggaaggggaacccttaaaggtttcggaacccccggttacgttaacgggaccaacggaccccgtaaagggtccgtcccccggg

SEQ ID NO: 83608 - DNA, 498 bp, Homo sapiens
  misc_feature: GYAE6OF01DZIQ4.36.23.C01.1.454.CMB.1.raw
  modified_base (461)..(461): a, c, t, g, unknown or other
  misc_feature (461)..(461): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgccccgaaactcttaatttatgaggtctttcgtcggccctcgtagggtttctagtcgcttctccggctcaagtctgcaacgcggcctcctgaccatctctagctccagctgaggacgagctgactattattgcagctcattatacgtgaagtcaatggtactccgatgctgtcggnggaggaccagttgaccgtctaggtcacgccaggtccc

SEQ ID NO: 83609 - DNA, 504 bp, Homo sapiens
  misc_feature: GYAE6OF01B3R9K.36.23.C01.1.454.CMB.1.raw
  modified_base (240)..(240): a, c, t, g, unknown or other
  misc_feature (240)..(240): n is a, c, g, or t
  modified_base (329)..(329): a, c, t, g, unknown or other
  misc_feature (329)..(329): n is a, c, g, or t
  modified_base (367)..(367): a, c, t, g, unknown or other
  misc_feature (367)..(367): n is a, c, g, or t
tcagtacgctgtctcacgaccggtgctcgattagtacacgtgattagggattgggggggtctcaggaggcaccgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggngcttataattatgtctcctggttccaacagcattcaggcagccgcccgaaactcttaatttatgaggtctttcgcggcctgagggtttntagtcgcttctcggctcaagtctggcaacacgcctccngaccatctctagactccagctgaggacgaggctgactattatgcagctcataatctagaagtcaatggtactctactgcttgtcggcggaggaccaggttcgaccgttaccgtaggtacagcccaaggcgtacccgg

SEQ ID NO: 83610 - DNA, 524 bp, Homo sapiens
  misc_feature: GYAE6OF01BQ1DL.36.23.C01.1.454.CMB.1.raw
  modified_base (228)..(228): a, c, t, g, unknown or other
  misc_feature (228)..(228): n is a, c, g, or t
  modified_base (404)..(404): a, c, t, g, unknown or other
  misc_feature (404)..(404): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggcagcgccccgaaactcttaatttatgagttctttcgtcggccctcgaggggtttctagtcgcttctccggctccaagtctggcacacggcctccctgaccatctctagactccagctgagacgngctgactatatgcagctcatatactagaagtcaagtggtactccgactggcttggttccgggacggtacgggacctaggttcgacccggttcctagggtaccacgtcccgaagggtcccg

SEQ ID NO: 83611 - DNA, 800 bp, Homo sapiens
  misc_feature: GYAE6OF01BGXI2.36.23.C01.1.454.CMB.1.raw
  modified_base (288)..(288): a, c, t, g, unknown or other
  misc_feature (288)..(288): n is a, c, g, or t
tcagtacgctgtctcacgaccggtgctcgatttagtacacgtgattagggagttgggggggtctcaggaggcagcgcctctccagggactatcgtcctaccattggcctgggctcgtgctagctcctcaaccctcctcactcgagggtcacagggtcctgggcccagttctggcctgactaacagcctgcctccgtgtctgagctcctggacagtcgagtcacctatcctcctgcgactggaaccagcagtgacgttgtgcttataattatgtcttcctggttccaangcattcagcagccgcccgaatcttaattatgaggttctttcgcggtccctgtacgggtttctagtcgtcttcgtccggtactaccgtaagttctcgggaccaaccgaccggtccctacccgtaggaccctacttccctacctaagtaccccttcccgaagggtccttaaggaaccgggtaccggaaacgggtcccttaaggtaaacccgttttagtttaacgttttcggacccgtaacggtaccttaccgtaaacgttacgttaacccgtttaggaaaacggtttacccaaaacgggtttacggggttaaacccttaccccgggtaaccgttttaccgggggttaaccccgttttttcggggttaaccccgggggttaaccgggggtaaaaccggggttaaacccccgttaaaacggggttttaccccgtaaacccccgggtttacccggtttaacgggggtttaccccgaaacccggggtaccccccggtaaaacggggttacccccccgg

SEQ ID NO: 83612 - DNA, 649 bp, Homo sapiens
  misc_feature: GYAE6OF01A9O7D.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctgttccaacagcattcaggcagccgccccgaaactcttaatttatgtaggttctttcgtcggtcccttcgtacggggtttctacgtcgtctttctccggctccgaagttcgtggaccaacgaccggtccctcccgtcggaccctacttcctactacgacctccgaggtcctaggaacgggaccgacgggccttagtaccttaagtttattcgacctaggtccttcgtaattactaacgttagtaaacgttacaagttcggtaacttcccgtaacgttcgggtaccgtttgggttaccggggacggggtacggggtaaccctaagggtttcccggaacccggttaccgttaacgggttaccaaccgggtccccgtaaaggggtcccccgg

SEQ ID NO: 83613 - DNA, 703 bp, Homo sapiens
  misc_feature: GYAE6OF01D08U2.36.23.C01.1.454.CMB.1.raw
  modified_base (227)..(227): a, c, t, g, unknown or other
  misc_feature (227)..(227): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcacatctcctgcactggaaccngcagtgacgttggtgcttataattatgtcttcctggttaccaacagctattcaggcacgccgaccccgtaaacttctttaatttatgtaggtttcctttcggtaccggtccctcggtacgggtttcctaggttccgtcctttccgtcccggtccttaccgaaacggttcctacgggaccctaaaccgtaccggtccccttcccgtacgaaccctactcctaccgtacgacctcccgagggccttagggacggacggtacgtacgtagtacgtttatttagttcggctaacgccttactaagttaactacgttaagtaacgttacgtaagttcggtaaccttaccgtacgttcgtaccggtttagggttacccggggaccggggtaacgggtaacccgttaacgggtttacccgtaaccccgggtttaccggttaacgggtaccctaaaccgggtccccggtaaacggtccccccgg

SEQ ID NO: 83614 - DNA, 670 bp, Homo sapiens
  misc_feature: GYAE6OF01BXAE7.36.23.C01.1.454.CMB.1.raw
  modified_base (230)..(230): a, c, t, g, unknown or other
  misc_feature (230)..(230): n is a, c, g, or t
  modified_base (266)..(266): a, c, t, g, unknown or other
  misc_feature (266)..(266): n is a, c, g, or t
  modified_base (304)..(304): a, c, t, g, unknown or other
  misc_feature (304)..(304): n is a, c, g, or t
tcagtacgctgtctcacgaccggtgctcgatttagtacacgtgattagggagttggggggggtctcaggaggcagcgctctcaggacatctccaccatggcctgggctctgctgctcctcaccctcctcactcagggcacgagggtcctgggcccagtctggcctgacacagcctgcctccgtgtctgagctccgtggacagtcatcacatctcctgctacgtggaaccngcagtgacgttgtgtcttatatatgtctctgtcaangcatcgaggcacgaccgacccgtaattcttaagtttangttacgttctttccggtccggtccgttgtacgggtttcctagtccgtccgttccgtccgtactcgaacgttcgtacgtaccaaccgtaccggtccctaccgtacgacctacttaccgtactaacgtaccttcgaggtcgtacgggaacgtcggacgtccttaggtaactttattagtcgactacgtactttacgaagttacttaacgtagaaacgtttacaacggttacgtaacttccgtacggtttcggcccgtttacggggttccgggaaccggggttaaacgggtaacccgttaagggttcccgggtaaccccgtttacggtaacgggttaccaaccggtaccccgggtaaccggttccccgg

SEQ ID NO: 83615 - DNA, 595 bp, Homo sapiens
  misc_feature: GYAE6OF01D5PYC.36.23.C01.1.454.CMB.1.raw
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgaccccgaaactcttaatttagtgtagttctttcgtcggtccctcgtagggttctagtcgtcttcgtccgtctccaagtctggacaacgcggccctcctgacctatctctacgctccgaggctagaggacgagctagacttattatgctagtctctatatacgtagtaacgttacaagttggtaactccgtacgttggtaccgttcgggttaccggggacgggtaacggggtaacccgttaaagggtttccggtaaccccggttccggtaacgggttccgaaccggtaccccgaacgggttacccccgg

SEQ ID NO: 83616 - DNA, 566 bp, Homo sapiens
  misc_feature: GYAE6OF01E0NHV.36.23.C01.1.454.CMB.1.raw
  modified_base (266)..(266): a, c, t, g, unknown or other
  misc_feature (266)..(266): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcatcaccatctcctgcactggaaccagcagtgacgttggtgcttataattatgtctctgttccaanagcattcaggcagcgaccccgaaattcttaatttatgtagttctttcgtccgccctcgtagggtttctagtcgcttctccggctccaagtctggcaacgaccggcctccctcgacctatccttactagaccttccgaggtctaggacggacgaaggctaggaacttatttagttgcacgctacatactactagaaagttcaattcggtaactccacgttggtcttcgggttccggagggacgggaaccctaaggttcgacccggttaccgtaggtaccaacggtccccgaaagggtcccg

SEQ ID NO: 83617 - DNA, 565 bp, Homo sapiens
  misc_feature: GYAE6OF01BO1FF.36.23.C01.1.454.CMB.1.raw
  modified_base (273)..(273): a, c, t, g, unknown or other
  misc_feature (273)..(273): n is a, c, g, or t
  modified_base (448)..(448): a, c, t, g, unknown or other
  misc_feature (448)..(448): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagacctcctggacagtcatcaccatctcctgcactggaaccagcagtgacgttggtgtcttataattatgtctccttggttccaacngcattcaggcagccgacccgtaaactctttaatttatagtacgttctttcggtccgtcctcgtagggtttctacgtcgtcttcgtccgtctccgaagtctcggacaacgtacgtcctcctcgacctatcctctaacgcctcgaggctggacggacgagtctgacttagtatcganacgtctatatactacgtagaacgtctaagtcgtactccacgttggtctgggttccggacggtacgggtacctaggttcgaccgtacctacggtaccacgggtccgtacggtccccgg

SEQ ID NO: 83618 - DNA, 496 bp, Homo sapiens
  misc_feature: GYAE6OF01EC1Y1.36.23.C01.1.454.CMB.1.raw
  modified_base (228)..(228): a, c, t, g, unknown or other
  misc_feature (228)..(228): n is a, c, g, or t
  modified_base (400)..(400): a, c, t, g, unknown or other
  misc_feature (400)..(400): n is a, c, g, or t
  modified_base (412)..(412): a, c, t, g, unknown or other
  misc_feature (412)..(412): n is a, c, g, or t
  modified_base (457)..(457): a, c, t, g, unknown or other
  misc_feature (457)..(457): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcagcagcgcccgaaactcttaatttatgagttctttcgtcggccttcgagggtttctagtcgtcttctccggctccaagtctggcaacacggcctcctgaccatctctagctcagctgagacgnggctgactattntgcagctcatatactgaagtcaagtgtatccatggctggttcggnggaggccagttcgaccgtctaggtcacgcccaaggtccg

SEQ ID NO: 83619 - DNA, 522 bp, Homo sapiens
  misc_feature: GYAE6OF01D9BTZ.36.23.C01.1.454.CMB.1.raw
  modified_base (228)..(228): a, c, t, g, unknown or other
  misc_feature (228)..(228): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttgtgcttataattatgtctctgttcaacagcattcagcagcgccccgaaactcttaatttatgtagttctttcgtcggccctgtagggtttctagtcgcttctccggctccaagtctgcacacggcctcctgaccatctctacgactccgagctggaggacgaggctgactattattgcagctctaatatactgaagtcaagttggtatccacgtggctcgggttcggcggacgggacctaaggttcggacccgttcgtacggtaccacgtcccgaaggtcccg

SEQ ID NO: 83620 - DNA, 526 bp, Homo sapiens
  misc_feature: GYAE6OF01DUFVA.36.23.C01.1.454.CMB.1.raw
  modified_base (302)..(302): a, c, t, g, unknown or other
  misc_feature (302)..(302): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctctgtcaacagcattcaggcagccgaccccgaaactcttaatttangtaggttctttcgtcgcctcgtagggtttctagtcgtcttctccggctcaagtctggcaacacggcctcctgaccatctctagactccaggctagaggcgaggctagactattattgcagctcatactactgaagtcaagttggtactccacgtggcttggttccggacggacgggtacctaacggttcgacccgttcgtaggtccgacgcccgaaggtccccg

SEQ ID NO: 83621 - DNA, 501 bp, Homo sapiens
  misc_feature: GYAE6OF01AYLDF.36.23.C01.1.454.CMB.1.raw
  modified_base (228)..(228): a, c, t, g, unknown or other
  misc_feature (228)..(228): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggcagcgcccgaaactcttaatttatgagtctttcgtcgccctcagggtttctagtcgcttctcggctccaagtctggcacacggcctcctgaccatctctagactccagctgaggacgaggctgactattattgcagctcatatactgaagtcaatggtaactccatggcttggtcggcggagggaccagttgaccgtcctaggtccaggcccaaggtcccg

SEQ ID NO: 83622 - DNA, 503 bp, Homo sapiens
  misc_feature: GYAE6OF01BUVZN.36.23.C01.1.454.CMB.1.raw
tcagtacgctgtctcacgaccggtgctcgattagtacacgtgattagggattggggggggtctcaggaggcaccgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgcccgaaactcttaatttatgaggtctttcgtcggcctcgagggtttctagtcgcttctccggctccagtctggcacacggcctccctgaccatctctagactccaggctgaggacgaggctgactattatgcagctcatatactagaagtcaatggtatccactggctggttcggcggagggaccaggttcgaccgtctaggtcagcccaggctcccgg

SEQ ID NO: 83623 - DNA, 678 bp, Homo sapiens
  misc_feature: GYAE6OF01AW4ZW.36.23.C01.1.454.CMB.1.raw
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcacgtggaaccagcagtgacggttgtgcttataattatgtctccttggttaccaacagcattcgaggccagccgaccccgtaaacttctttaaactttagtagtacggtttctttccgtccggtcccttcgtagggtttctacggtccgtcttccgtccggcctaccgaagttctacggactaaaccgaccggtccctcccgtacgaccctaactcctactacgacctccgaaggtctagggacggacgaggtcttagtaccttatttacgttcgactacgtcttacgtaacgttacgtaacgtagtaaacgttaccgtaagttacggtaaccttcccgtaacgttcgggtccgtttcgggttaccggggaccgggtaacggggtaacccttaaagggtttcccggtaacccggttcccggtaacgggtaccgaacccggtaccccggtaacgggtccccgg

SEQ ID NO: 83624 - DNA, 512 bp, Homo sapiens
  misc_feature: GYAE6OF01DR1MI.36.23.C01.1.454.CMB.1.raw
  modified_base (270)..(270): a, c, t, g, unknown or other
  misc_feature (270)..(270): n is a, c, g, or t
  modified_base (387)..(387): a, c, t, g, unknown or other
  misc_feature (387)..(387): n is a, c, g, or t
  modified_base (467)..(467): a, c, t, g, unknown or other
  misc_feature (467)..(467): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctgttccaacngcattcaggcagcgccccgaaactcttaatttatgtaggttctttcgtcggtccctcgagggtttctagtcgtcttctccggctcaagtctggcaacacggccctccctgaccatcnctagactccgagctgagacgagctgactattatgcagctcatatactagaatcaatggtactctactggtctggttcggnggaggccaaggttcgaaccggtctaggtcacgcccgaaggtcccg

SEQ ID NO: 83625 - DNA, 718 bp, Homo sapiens
  misc_feature: GYAE6OF01AT5BM.36.23.C01.1.454.CMB.1.raw
  modified_base (266)..(266): a, c, t, g, unknown or other
  misc_feature (266)..(266): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcacatctctgcactggaaccagcagtgacgttgtgcttatattatgtctcctggttccaangcattcaggcacgccgacccctaaacttctttaatttagtgtacggttctttccggtccggtcccttacggtacggggtttctaacggttccgtccgtttccgtcccgggtccttacccgtaaacggttccgtacgggtaccctaaacccgtcccgggtaccccttccccgtacgtaacccctaattcccttaccgttaaccgtaccttaccccggaacggtccgttaacgggaacgggtaacccggtagggttcccgttaacggttaacctttaagtttacgttcggacctagtcccctataacttacgtacgttacgtaacgttactaagttcggttaacctcccgtacgtcggtaccgttcgggttccgggacgggacgggtaaccgttaaggttccggaacccggttaccggtaacggtaccgtaccggacccgtaacgggttccccg

SEQ ID NO: 83626 - DNA, 529 bp, Homo sapiens
  misc_feature: GYAE6OF01EY5YU.36.23.C01.1.454.CMB.1.raw
  modified_base (228)..(228): a, c, t, g, unknown or other
  misc_feature (228)..(228): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcatttcaggcagcgccccgaaactcttaatttatgagtctttcgtcggccctcagggtttctagtcgcttctccggctccaagtctgcacacggcctccctgaccatctctagactccagctgaggacgagctgacttattattgcagctcaattactactgaagttcaatggtactccgactggtcttggttccgggacgggtacgggacctaaggttcgaaccggtccgttaggtacacgtcccgaagggtcccg

SEQ ID NO: 83627 - DNA, 630 bp, Homo sapiens
  misc_feature: GYAE6OF01BEOTC.36.23.C01.1.454.CMB.1.raw
  modified_base (617)..(617): a, c, t, g, unknown or other
  misc_feature (617)..(617): n is a, c, g, or t
tcagtacgctgtctcacgaccggtgctcgatttagtacacgtgattagggattggggggaaatactttctgagactcatggacctcctgcacaagaacatgaaacacctgtggttcttcctcctcctggtggcagctcccagatgggtcctgtctcaggtgcagctgcagcagtcgggcccaggagtggtgaagccttcggacgaccctgtccctcacctgcgctgtgtctggacgccctcccgtcgggcggagatggaagttgggtggtagttcggggtcccgccgacggccccgaggggaacggggctggaggttggagtttgggtagtaaaagtaaagtggaacggaccggggcaaccgaaactacgaagtcgccgtcccgtcgacggggtcgacgtcacatatctgacagacaacgtaccaaagaaccctacttcctacccgtgacgctacgacctcgtcgtcgacccgccggccggaccgtccggacctaattacttacgtttagttgtcgacgtagttggttttgacgtaggtacttcggtgggtacgtcgtcggtacggtcggtaggggtacgaagggtacgtcgacggtcgtacgtccgtctcccgtcnccgtccctacccg

SEQ ID NO: 83628 - DNA, 562 bp, Homo sapiens
  misc_feature: GYAE6OF01DLT1O.36.23.C01.1.454.CMB.1.raw
  modified_base (551)..(551): a, c, t, g, unknown or other
  misc_feature (551)..(551): n is a, c, g, or t
tcagtacgctgtctcacgaccggtgctcgatttagtacacgtgattagggattggggggggaaatactttctgagactcatggacctcctgcacaagaacatgaaacacctgtggttcttcctcctcctggtggcagctcccagatgggtcctgtctcaggtgcagctgcagcagtcgggcccaggagtggtgaagccttcggagaccctgtccctcacctgcgctgtgtctggacgcctccctcggcggagatgaatggtggagttgggtccgccacgccccgagggaaggggctggagttggatttggagaaataaagtggaggaccgggggcaccaaactacaatcgccgtccctcgaggggtcgagtcaccatatctgcagacaagtccaagaccacttctccctgacggctgacctctgtcgaccgccgcggactccggccatatattattgtgcgagtagtttttggcgtaggtagtcggttggggcggttacgtcggtacgttcgtgggggtcgaagggactcgacggtcacgtcgtctcctcncgtcctacccg

SEQ ID NO: 83629 - DNA, 579 bp, Homo sapiens
  misc_feature: GYAE6OF01A57WZ.36.23.C01.1.454.CMB.1.raw
  modified_base (254)..(254): a, c, t, g, unknown or other
  misc_feature (254)..(254): n is a, c, g, or t
  modified_base (270)..(270): a, c, t, g, unknown or other
  misc_feature (270)..(270): n is a, c, g, or t
  modified_base (351)..(351): a, c, t, g, unknown or other
  misc_feature (351)..(351): n is a, c, g, or t
tcagtacgctgtctcacgaccggtgctcgatttagtacacgtgattagggagttggggggggtctcaggaggcagcgctctcaggacatctccaccatggcctgggctctgctgctcctcaccctcctcactcagggcacagggtcctgggcccagtctggcctgacacagcctgcctcgtgtctgagactcctggacagtcgatcaccatctcctgcactggaaccagcagtgacgttggtgcttataattangtctcctgttccaacngcattcaggcagccgaccccgtaaatcttaatttatgtacggtctttcgtccggtcctcgtagggtttctagtcgtcttcnccggtctccgtaacgtcgtcggacaaccacggcccttccctacgaccctagtccttctacgacctccgaggtctggaacggacgaggtctagacttattagtgctagctacgaataactacaagtcgactaagctactcgtcgttccgttacggtaaccgtgggaaccctagggtcctaacgtgttacccgtaggttccgaacgtccccaaaggcccctaaacccccg

SEQ ID NO: 83630 - DNA, 553 bp, Homo sapiens
  misc_feature: GYAE6OF01CV4L5.36.23.C01.1.454.CMB.1.raw
  modified_base (227)..(227): a, c, t, g, unknown or other
  misc_feature (227)..(227): n is a, c, g, or t
  modified_base (429)..(429): a, c, t, g, unknown or other
  misc_feature (429)..(429): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttgtgcttataattatgtctctggttccaacagcattcaggcagccgcccgaaactcttaatttatgagttctttcgtcgcctcgtagggtttctagtcgtcttctccggctccaagtctggcaacacggccctcctgaccatcctctagacctccgaggtctggaacggacgaggctgaccttattattgcngtctctaatactactgaagttcaattggtaactccgtactgggtcttcggttccgggacgggaacgggtacccgaaaggtttcggacccgttccgtaacgggtccacggcccgaagggtccccg

SEQ ID NO: 83631 - DNA, 744 bp, Homo sapiens
  misc_feature: GYAE6OF01AL3FH.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctcctgcactggaaccagcagtgacgttggtgtcttataattatgtctcctggttccaacagctattcgaggtcacgccgaccccgtaaacttctttaaatttatggtacggtttcctttccggtcccggtcccgttcgtacggggttttcctacggttccgtccgtttccgtcccggtcctttacccgtaaacggttccgtacgggtacctaaaacccgtacccggtcccccttccccgtacggtaacccctacttaccctaccgttaaccggacccttcccgaacgggtaccgttacgggaacgggtaaccggtacgggtcccttaaggtaacctttaacgtttacgttacggtaccgtacgtccgttacctaattaacgttacgtaacggtaacggttactaagttacggtaacttcccgtacgttcggtcgttaccgggttccgggacggggtaaccgggtaccgttaacgggttccggaccccggttacgtacgggtaccgtaaccggtccccgaaagggttccccg

SEQ ID NO: 83632 - DNA, 594 bp, Homo sapiens
  misc_feature: GYAE6OF01D3DMJ.36.23.C01.1.454.CMB.1.raw
tcagtacgctgtctcacgaccggtgctcgatttagtacacgtgattagggattgggggggaagaggaagactgacggtcctgtctcaggtgcagctgcagcagtcgggcccaggagtggtgaagccttcggagaccctgtccctcacctgcgctgtgtctggagcctccctcggcggagatgaatggtggagttgggtccgccagcccccagggaaggggctgagttggattggtgaaataaatgagaccgggggcaccaactacaatgcgtccctcgaggggtcgagtcaccatatctgcagacaagtccaagaacccacttcctccctgacggctgacctctgtgaccgccgcggactcggccatatattattgtgcgtagtagtttttgcgtaggtatcgttggggtcggttagtcgtacggtcgtggggtacgaagggtactacgacggtctacgtcgtctccctcgacgccctccaccgaacgggccctacgtccgtccttcccccgtcggccgccccgtcgcctccgacggacgccgtaccctccggacgacgcaccgtacggcccggcccgtgggccctggtcccgg

SEQ ID NO: 83633 - DNA, 555 bp, Homo sapiens
  misc_feature: GYAE6OF01BH5Z5.36.23.C01.1.454.CMB.1.raw
  modified_base (364)..(364): a, c, t, g, unknown or other
  misc_feature (364)..(364): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaatcttaatttatgagttctttcgtccggcctgtagggtttctagtcgtcttctccggctccagtctgcaacncggcctcctgaccatctctagactcagctgaggacgagctgactatattgacagctctatatacgtgtaacgttacaagttacggtactaccgtacgtgggtaccttgggttccgggacgggtacggggtaacctaaggttccggacccggttaccgtacgggttaccaacggccccgtaaagggtccccg

SEQ ID NO: 83634 - DNA, 613 bp, Homo sapiens
  misc_feature: GYAE6OF01EMCHA.36.23.C01.1.454.CMB.1.raw
  modified_base (278)..(278): a, c, t, g, unknown or other
  misc_feature (278)..(278): n is a, c, g, or t
  modified_base (429)..(429): a, c, t, g, unknown or other
  misc_feature (429)..(429): n is a, c, g, or t
  modified_base (435)..(435): a, c, t, g, unknown or other
  misc_feature (435)..(435): n is a, c, g, or t
  modified_base (440)..(440): a, c, t, g, unknown or other
  misc_feature (440)..(440): n is a, c, g, or t
tcagtacgctgtctcacgaccggtgctcgatttagtacacgtgattagggattggggggggtctcaggaggcagcgctctcaggacatctccaccatggcctgggctctgctgctcctccaccctcctcactcgagggcacgagggtcctcgggcccagtcgtggcctgacacagcctgccctccgtgtctgagacctccgtggacagtcgatcaccatcctctgcacgtggaaccagcagtgacgttggtgtcttataattatgtctctgttccaanagcattcagcgagccgaccccgaattcttaatttagtgtacgttctttcgtccggtcctgtagggtttctagtcgtcttcgtccggctccagtctgacacgcgcctcctgaccatctcacgactcgagcgtgaggacggagctgacttatnttgacngctanatactacgtagaagttcaagttacggttactaccgtacggttggtaccgtttcgggttccggggtacgggtaacgggggaaccctttaaaggggtttaccccggaaccccggtttacccggttaacgggttacccgaaacccgggtaaccccggtaaacgggttccccccggg

SEQ ID NO: 83635 - DNA, 651 bp, Homo sapiens
  misc_feature: GYAE6OF01DKTWM.36.23.C01.1.454.CMB.1.raw
  modified_base (230)..(230): a, c, t, g, unknown or other
  misc_feature (230)..(230): n is a, c, g, or t
  modified_base (267)..(267): a, c, t, g, unknown or other
  misc_feature (267)..(267): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacgagggtcctgggcccagtctggcctgacacagcctgcctccgtgtctgagactcctggacagtcgatcaccatctcctgcacgtggaaccngcagtgacgttgtgcttatattatgtctctgtaccangctattcagcacgccgacccgtaacttcttaatttagtgtacgttctttcggtccgtccgtcgtagggtttctacgtccgtctttccgtccgtctaccgtagtcgtacggacctaaccgtccggtcccttcccgtacgtaccctacttacctaccgtacgtacctccgacggtacgtacggaacgggacgacggtcgttacgtaacgttatttacgtcgactacgtactactaacttactacgttagtaacgttactaagttcggtactaccgtacgtcgggtcgttcgggttaccgggaccgggtaacgggtaccgttaaacggttccggtaaccccggttaccgttacggtaccgtacccggaccccgtaacgggtcccccg

SEQ ID NO: 83636 - DNA, 523 bp, Homo sapiens
  misc_feature: GYAE6OF01A04YN.36.23.C01.1.454.CMB.1.raw
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcacatctcctgcactggaaccagcagtgacgttggtgcttataattatgtctcctggttccaacagcattcaggcagcgcccgaaactcttaatttatgagtcttcgtcgcctcaggtatttcaatcgcttctctggctcaagtctgccaacacggcctcctcgaccatctcgtgggtcctccagcctgaggacgaggctgattattactgttctcactattcaagccgtagtacgttcggtcgtttcggcgggtccggacccaccgtcgacccgtccgtcgtcgacgacccgacggctccgccccgttcgtctacccg

SEQ ID NO: 83637 - DNA, 552 bp, Homo sapiens
  misc_feature: GYAE6OF01B6Z68.36.23.C01.1.454.CMB.1.raw
  modified_base (274)..(274): a, c, t, g, unknown or other
  misc_feature (274)..(274): n is a, c, g, or t
  modified_base (306)..(306): a, c, t, g, unknown or other
  misc_feature (306)..(306): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacgagggtcctgggcccagtctggcctgacacagcctgcctccgtgtctgagactccgtggacagtcgatcaccatcctcctgcacgtggaaccagcagtgacgttggtgtcttataattatgtctctgttccaacngcattcagcagccgacccgaactcttaattangtagttcttcgtcgcctcgtagggtttctagtcgtcttctccggctccaagtcgtggacaacgaccggtcctccctgaccatctactagactccaggctggaggacgaggctgtactatttatgcagctcatatactagaatacaagttggtaactcctagtcggtcgttcggttcgggacgggaacgggtacccgtaaggttcggacccgttacgtacgggtaccacggacccgtaaggtccccg

SEQ ID NO: 83638 - DNA, 602 bp, Homo sapiens
  misc_feature: GYAE6OF01DMHIR.36.23.C01.1.454.CMB.1.raw
  modified_base (227)..(227): a, c, t, g, unknown or other
  misc_feature (227)..(227): n is a, c, g, or t
  modified_base (306)..(306): a, c, t, g, unknown or other
  misc_feature (306)..(306): n is a, c, g, or t
  modified_base (325)..(325): a, c, t, g, unknown or other
  misc_feature (325)..(325): n is a, c, g, or t
tcagtacgctgtctcacgaccggtgctcgatttagtacacgtgattagggattggggggggtctcaggaggcagcgctctcaggacatctccaccatggcctggctctgctgctcctcaccctctcactcgagggcacagggtcctgggcccaggtctggcctgacacagcctgcctccgtgtctgagactcctggacagtcgatcacatctcctgcactggaaccngcaggtgacgttggtgcttataattatgtctcctggttccaacagcattcaggcagcgacccgaaactccttaatttangtacgtctttcgtcgcctntagggttctagtcgtcttcgcggtctcaagtctcggcaacgacggcctcccgtgaccattccgtctacgacttccgaggtctaggacggtaggacgtcttaggacttaacgtttattacgctagtcttcaagttataccgttagaacgttctaaacgttgggtaacttcccgtaagtcgggtaccttcgggttaccgggacgggtaacgggtaacccacggtttaccggacccggttaccggttacggtacccacgtaccccggaaggttcccccgg

SEQ ID NO: 83639 - DNA, 543 bp, Homo sapiens
  misc_feature: GYAE6OF01B7C7A.36.23.C01.1.454.CMB.1.raw
  modified_base (228)..(228): a, c, t, g, unknown or other
  misc_feature (228)..(228): n is a, c, g, or t
  modified_base (271)..(271): a, c, t, g, unknown or other
  misc_feature (271)..(271): n is a, c, g, or t
  modified_base (385)..(385): a, c, t, g, unknown or other
  misc_feature (385)..(385): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacngcattcaggcagcgccccgaaactcttaatttatgaggttctttcgtcggccctcgtacggggtttctagtcgcttcgtccggctccaagtctggcaacgcggcctcctgaccntctctagctccagcctgacggacgaggctgactattattgcagctcatactactagaagttcaatggtactccaacgttggtccttgggttcggacgggaacgggtacctaacggttcgaacccggttcgacggtcaaccggccccgtaagggtcccg

SEQ ID NO: 83640 - DNA, 1056 bp, Homo sapiens
  misc_feature: GYAE6OF01EJITY.36.23.C01.1.454.CMB.1.raw
  modified_base (310)..(310): a, c, t, g, unknown or other
  misc_feature (310)..(310): n is a, c, g, or t
tcagtacgctgtctcacgaccggtgctcgatttagtacacgtgattagggagttggggggggtctcgacggaggccaggcgtcctacgtcaggtaccattcgtccaccatggcctgggctactggctggcctcctccacctcgtcgtacggtcagggcacgtaggggtttccttgggtccctaggttcctagggaccgttgaccactacgtccgttggtcctccgtggtctggacggacgttccggggtaggaccgtagggttaccggacgggttccaacctaagtcctccgtcgctacgtacggaaccncgtacgaagtcgaacggttggttcgtaccttaagttaacgttttacgtcgttccttccgttacgggttacccaacgtacggtcctaacgtttcgggaaggggtcgtacgggtacccggtaccccggtaaactttacgttttaaacgttttaagttacggttaacgggtttcccgtttttccgggttacccggggttaccccggtttacgggttaacgggggtttttccggttaacgggtttcccggtttcccgttttacccggttaccccggggttacccgtttaaccccggttaaacgggttttccgggttaacgggggtaaccccgggtaaaacccggttacccgggttaccccgtttaccccgttaccgggttaaacccctttaaccgttacccggttaacccgttaaaccggtaaccccgttaaccccgtaaacgggtacccgttacggggtaaccgggtaaacccggtaacgggttacccgtttaacggtaacgtttaacgtttaccggttacgacccgtacggaccgttaccgtaacgttaaccgtaacgttaacggtaaacgttacgttaaagttacggtttaaccgttacccggtaacggttccgggtaaccgtttaccggggttaacccgggttaacggggtaaccgggtaaaccggttaaacgggttacccggttacccgggttaccgggttaacggggttacccgtacgggtaccccggtaacgggtcccccggg

SEQ ID NO: 83641 - DNA, 525 bp, Homo sapiens
  misc_feature: GYAE6OF01ELQ2U.36.23.C01.1.454.CMB.1.raw
  modified_base (167)..(167): a, c, t, g, unknown or other
  misc_feature (167)..(167): n is a, c, g, or t
  modified_base (210)..(210): a, c, t, g, unknown or other
  misc_feature (210)..(210): n is a, c, g, or t
  modified_base (228)..(228): a, c, t, g, unknown or other
  misc_feature (228)..(228): n is a, c, g, or t
  modified_base (270)..(270): a, c, t, g, unknown or other
  misc_feature (270)..(270): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacncagcctgcctccgtgtctgagactcctggacagtcgatcaccntctcctgcactggaaccngcagtgacgttggtgcttataattatgtctctggttccaacngcattcaggcagcgcccgaatcttaattatgtagtctttcgtcgcctcgtagggtttctagtcgtcttctccggctccaagtctggcaacacggcctcccgtgacctatctctacgactccgagctagagacgagctgactattatgcagctcatatactagtaagtctaatgtactcacgtgtcgttacggtcgggacggacggaccgtaaggttcgtaaccgtccgtaggtccgaacggccctaagggtcccg

SEQ ID NO: 83642 - DNA, 521 bp, Homo sapiens
  misc_feature: GYAE6OF01B70AU.36.23.C01.1.454.CMB.1.raw
  modified_base (219)..(219): a, c, t, g, unknown or other
  misc_feature (219)..(219): n is a, c, g, or t
  modified_base (226)..(226): a, c, t, g, unknown or other
  misc_feature (226)..(226): n is a, c, g, or t
  modified_base (266)..(266): a, c, t, g, unknown or other
  misc_feature (266)..(266): n is a, c, g, or t
  modified_base (289)..(289): a, c, t, g, unknown or other
  misc_feature (289)..(289): n is a, c, g, or t
  modified_base (316)..(316): a, c, t, g, unknown or other
  misc_feature (316)..(316): n is a, c, g, or t
  modified_base (357)..(357): a, c, t, g, unknown or other
  misc_feature (357)..(357): n is a, c, g, or t
  modified_base (399)..(399): a, c, t, g, unknown or other
  misc_feature (399)..(399): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacgagggtcctgggcccagtctggcctgacacagcctgcctccgtgtctgagctcctggacagtcgatcacatctctgcacnggaaccngcagtgactttggtgtaacaatcatgtctctggtaccaanagtaccaggcaaacgccccaaancatctattttgacgtcgtagtcgcctnagtattctaatcgtcttctcgtcgctcagtctcgaccaacncggcctcctgaccatctctcggctccagccgtagacggacgnggtctagtaactttacgtactgctaagtctactaatactaacaagttacgcacgtccactctcgtcgtacggactcgggacaaggttcactcgtactacggtcagacccaagccctaacccg

SEQ ID NO: 83643 - DNA, 529 bp, Homo sapiens
  misc_feature: GYAE6OF01AWV4G.36.23.C01.1.454.CMB.1.raw
  modified_base (487)..(487): a, c, t, g, unknown or other
  misc_feature (487)..(487): n is a, c, g, or t
tcagtacgctgtctcacgaccggtgctcgatttagtacacgtgattagggattggggggggtctcaggaggcagcgctctcaggacatctccaccattgcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgaccccgaaactcttaaatttatgtaggttctttcgtcggcccttcgtaggggtttctaggtcgcttctccggctccaagtctggccaacgtacggccctcccgtgaccatcctctagacctccaggcctggacggacgaggctagacttattatgcagtctacattactactagaatcaatggtatccagtgctggtcggnggaggccagttcgaccgtcgtaggtcacgcccgaaggtcccg

SEQ ID NO: 83644 - DNA, 513 bp, Homo sapiens
  misc_feature: GYAE6OF01B28LA.36.23.C01.1.454.CMB.1.raw
  modified_base (419)..(419): a, c, t, g, unknown or other
  misc_feature (419)..(419): n is a, c, g, or t
tcagtacgctgtctcacgaccggtgctcgattagtacacgtgattagggattgggggggtctcaggaggcaccgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgcccgaaactcttaatttatgaggtctttcgcggccctcagggtttctagtcgctctccggctcaagtctggcacgacgcctccctgaccatctctagactccaggctgacggacgaggctgactattatgcagctnatatactgtaagtcaatggtactcactggctcgttcggcggtagggtacccaaggttcgaccgttccgtaggtcacgcccaaggccgtacccgg

SEQ ID NO: 83645 - DNA, 731 bp, Homo sapiens
  misc_feature: GYAE6OF01AEC7S.36.23.C01.1.454.CMB.1.raw
  modified_base (228)..(228): a, c, t, g, unknown or other
  misc_feature (228)..(228): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctctggttccaacagcattcaggcacgccgcccgaaactctttaatttatgtacggttctttcgtcggtccctcgtacgggtttctagtcgtctttcgtcccggtctccgaacgttcgtcggaccaaccgtaccggtccccttaccccgtcgaacccgtacttccgttaccttaacggtacccttacccgaagggtccgttagggaacgggtaaccggacggggtccttacggtaacctttaagtttacgtttcgacctacggtaccttacgtaacttaacgttaaccgttaaggtaaacgttacgtaaacgttacggttaaccttacccgtaacggttcgggttaccgtttcggggtttacccggggaccggggtaacggggtaacccgttaaacgggtttaccgggtaaccccggttccccggttaacgggtacccggtaacccggtacccccggtaaacggggttcccccgg

SEQ ID NO: 83646 - DNA, 515 bp, Homo sapiens
  misc_feature: GYAE6OF01A0FYB.36.23.C01.1.454.CMB.1.raw
  modified_base (472)..(472): a, c, t, g, unknown or other
  misc_feature (472)..(472): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagccctgcctccgtgtctgagactcctggacagtcgatcaccatctcctgcactggaaccagcagtgacgttggtgcttataattatgtctcctggttccaacagcattcaggcagcgcccgaaactcttaatttatgtagtctttcgtcggccctcaggggtttctagtcgcttctccggctccaagtctggcacacggcctccctgaccatctctacgacctccaggctggacggacgaggctgactattattcgcagctcatatactgaagtacaagtgtactccacgtggctggttcggnggaggacctagttgaccgtcgtaggtcacgcccgaaggtcccg

SEQ ID NO: 83647 - DNA, 554 bp, Homo sapiens
  misc_feature: GYAE6OF01DSU0M.36.23.C01.1.454.CMB.1.raw
  modified_base (518)..(518): a, c, t, g, unknown or other
  misc_feature (518)..(518): n is a, c, g, or t
  modified_base (527)..(527): a, c, t, g, unknown or other
  misc_feature (527)..(527): n is a, c, g, or t
  modified_base (541)..(541): a, c, t, g, unknown or other
  misc_feature (541)..(541): n is a, c, g, or t
tcagtacgctgtctcacgaccggtgctcgatttagtacacgtgattagggattgggggggaaatactttctgagactcatggacctcctgcacaagaacatgaaacacctgtggttcttcctcctcctggtggcagctcccagatgggtcctgtctcaggtgcagctgcagcagtcgggcccaggagtggtgaagccttcggagaccctgtccctcacctgcgctgtgtctggagccctccctcggcggagatgaatggtggagttgggtccgccagccccagggaaggggctgagttggattggtagaaataatgagaccgggggcaccaactacaatgccgtccctcgaggggtcgagtcaccatatctgcagacaagtccaaagaacccacttctccctgaggctcgacctctgtcgaccgcccgcgactccggccatatattattgtgcgtagtagtttttgcgtaggtagttcgttggggcggttagtccgacggttcgtggggtcaagggtntcgacggtnacgtcgtctcctcncgtccctaccccg

SEQ ID NO: 83648 - DNA, 526 bp, Homo sapiens
  misc_feature: GYAE6OF01B7VYG.36.23.C01.1.454.CMB.1.raw
  modified_base (481)..(481): a, c, t, g, unknown or other
  misc_feature (481)..(481): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgccccgaaactctttaatttatgtaggtctttcgtcggtccctcgtaggggtttctagttcgcttcgtccgtctccaagtctggcaacacggccctccctgacctatctctacgacctccagctaggaggacgaggctgactattattgcagctcgatactactgaagtacaatgtatccatcggtcttggtcggnggaacggactaaggttcgaccgtctaggtcacgcccgaggtcccg

SEQ ID NO: 83649 - DNA, 773 bp, Homo sapiens
  misc_feature: GYAE6OF01DV1ZG.36.23.C01.1.454.CMB.1.raw
tcagtacgctgtctcacgaccggtgctcgatttagtacacgtgattagggattgggggggaaatactttctgagactcatggacctcctgcacaagaacatgaaacacctgtggttcttcctcctcctggtggcagctcccagatgggtcctgtctcaggtgcagctgcagcagtcgggcccaggagtggtgaagccttcggagaccctgtccctcacctgcgctgtgtctggacgtccctccgtcggcggagatggaagtggtggaggttcgggtccgccgacggccccgagggggaacgggcgtggtaggttggagtttggtagaaaagtaaagtcggaacgggaccggggacaaccgaaacttaacgaatcggccgttacccgtcggacggggtcgagtcaaccagtactcgtacgacgaacgaccaaacgtaccgaaaacgaaccctaccttaccgtaccctaggacggacctacgtacccttacgtcggtacggacccggccggtaccgggacctccgggacctaagtttaactttaagttttacgttgggttacggtaacggttaggtttacggtttttaggaccggttaagggttacgtttacggggtttacgggggtaccgttaacggttaccgggtacggttaccgggtttacggggggtaaccggtaaaggggttaaccgttacccgggtaaccgggttacccgtaacgtttcccggttcccgttaccccgtaccggtacccggtcccccgtaaacccccggg

SEQ ID NO: 83650 - DNA, 535 bp, Homo sapiens
  misc_feature: GYAE6OF01BPLRH.36.23.C01.1.454.CMB.1.raw
  modified_base (440)..(440): a, c, t, g, unknown or other
  misc_feature (440)..(440): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagacctcctggacagtccgatcaccatcctcctgcactggaaccagcagtgacgttgtgcttataattatgtctcctggttccaacagcattcaggcagccgccccgaaatcttaatttatgagttctttcgtcggtcctcgtagggtttctagtcgtcttctccggctcagtctgcaacacggcctcctcgacctatctactacgactccgaggtctggacggaccgaggtctagacttattagtcgcagctntaatatactagaacgtacaagtggtaactccacttggcttggtcggcggtacgggcctaagttcgaccgtctagggtaccacggcccaggtcccg

SEQ ID NO: 83651 - DNA, 534 bp, Homo sapiens
  misc_feature: GYAE6OF01DQD0H.36.23.C01.1.454.CMB.1.raw
  modified_base (227)..(227): a, c, t, g, unknown or other
  misc_feature (227)..(227): n is a, c, g, or t
  modified_base (263)..(263): a, c, t, g, unknown or other
  misc_feature (263)..(263): n is a, c, g, or t
  modified_base (269)..(269): a, c, t, g, unknown or other
  misc_feature (269)..(269): n is a, c, g, or t
  modified_base (348)..(348): a, c, t, g, unknown or other
  misc_feature (348)..(348): n is a, c, g, or t
  modified_base (362)..(362): a, c, t, g, unknown or other
  misc_feature (362)..(362): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttgtgcttatattatgtctctgtcaangcattnagcagcgcccgaatcttaattatgagttctttcgtcgcctgagggtttctagtcgcttctccggctcaagtctggcacncggcctcctgaccntctctagactcaggctgaggacgaggctgactattattgcagtctcaattatacgtgaagttcaagttggtaactcccgtatcgggtcttgggttccgggacgggtaagggaccctaaagggttccgaacccggttccgtaacggtccgaacggccccgtaaagggtccccg

SEQ ID NO: 83652 - DNA, 571 bp, Homo sapiens
  misc_feature: GYAE6OF01BIBYR.36.23.C01.1.454.CMB.1.raw
  modified_base (265)..(265): a, c, t, g, unknown or other
  misc_feature (265)..(265): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcacatctctgcactggaaccagcagtgacgttggtgtcttataattatgtctctgtcaangcattcagcacgccgaccccgaactcttaattatgtagttctttcgtcgtccctgtagggttctagttcgtcttcgtccgctccgaagtcctggacctaacgaccggcccttccctcgacctactctctacgtacctcaggtcctggacggacgaggctagtactattagtgctagctctaatagtactagtaagtactagttacggtactccgagttcggtcgttggttaccgggcgggaacgggtacctaacggtttcggacccgttaccggttacggaccgaacggtacccgaacggtccccg

SEQ ID NO: 83653 - DNA, 791 bp, Homo sapiens
  misc_feature: GYAE6OF01CGU0N.36.23.C01.1.454.CMB.1.raw
  modified_base (151)..(151): a, c, t, g, unknown or other
  misc_feature (151)..(151): n is a, c, g, or t
  modified_base (157)..(157): a, c, t, g, unknown or other
  misc_feature (157)..(157): n is a, c, g, or t
  modified_base (308)..(308): a, c, t, g, unknown or other
  misc_feature (308)..(308): n is a, c, g, or t
tcagtacgctgtctcacgaccggtgctcgatttagtacacgtgattagggattgggggggtctcaggaggcagcgctctcaggacatctccaccatggcctgggctctgctgctcctcaccctcctcactcagggcacagggtccgcgacntgcgcnacagctcgcgtcccgtcgtctcgagactccttcggacgagtcggtacacaccaactcttcctcgcgactacggaaccgaacgcgacgtaggtacgttaggttggcttaattaaattaacttgtctccttcggttacaaccaaagcacttanacggacgacgaccgtacccgaaaccccttaatttattttaaagtttgaacgggttaccgtttttccgttacccgggggtcccctccgtttaacgggggttttacggttttacgaccggttcctttcctttcccggggaaccgttccctaaaacggtcgtttcgggtacgaaaaccaacccggggtccccgttccccttaccggaccgaaccttaaccttccgttaacggtaaccgtcccctaacggggtacgtacgggttaacgggaaaccgggtaacggacggttcccgtaagttaaaccttttaagttttcgacggactacgttacctaaggttaacttacgtaacgtaaaggttaacctaattaacgggttactacctcgtacgggtcggttcgtttacgggggccggaaggggtaccgtaacgttaggttacccgtacccgttacggtacgacccgaccgtaaccgggagttcccccgg

SEQ ID NO: 83654 - DNA, 559 bp, Homo sapiens
  misc_feature: GYAE6OF01DAVPJ.36.23.C01.1.454.CMB.1.raw
  modified_base (228)..(228): a, c, t, g, unknown or other
  misc_feature (228)..(228): n is a, c, g, or t
  modified_base (267)..(267): a, c, t, g, unknown or other
  misc_feature (267)..(267): n is a, c, g, or t
  modified_base (432)..(432): a, c, t, g, unknown or other
  misc_feature (432)..(432): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctctgttccanagcattcagcagccgacccgtaaacttcttaatttatgtaggttctttcgtccggtccctcgtagggtttctagtcgtcttctccggctcagtctgcacacggcctcctgaccatctctacgactccgagctagaggacgaggctagacttattacttgcagctntatatacgtgaactcaatggtactccgtacgtggtacgttgggtaccgggacgggaacgggtacctaaacgggttccgtaacccggttccgttaacggtacccgaacggtccccgaagggtccccgg

SEQ ID NO: 83655 - DNA, 708 bp, Homo sapiens
  misc_feature: GYAE6OF01C12LW.36.23.C01.1.454.CMB.1.raw
  modified_base (286)..(286): a, c, t, g, unknown or other
  misc_feature (286)..(286): n is a, c, g, or t
tcagtacgctgtctcacgaccggtgctcgatttagtacacgtgattagggagttggggggggtctcaggaggcagcgctctcaggacatctccaccatggcctgggctctgctgcctcctcaccctcctcactcagggcacagggtcctgggcccagtctggcctagacacagcctgcctccgtgtctgagactccgtggacagtcgatcaccatcctcctgcactacggaaccagcagtgtacgttgtgtcttaataattattgtccttccgtggttaccaaacngtcattcaggccacggcccgaccccgtaaattactttaatttagtgtaacggtttcctttccggtccggtccccgttaggtacggggttttactacggttccgtctttccgtcccggtccttaacgtaacggtcctacgggaccctaaacggaccccggtcccttaccccgtagaccctacgttcctaccgtacgtacccgttccgaaggtcgtaggaacggacggtacggtcgttacgtaacttagtttacgttcgacgtacgtaccttactaacttacttacgtaagtaacgttactaaaggttcgttaactacccgtaacgttcgggtacgttcggggttacggggacgggtaacgggtaacgttaacggttccggtacccgttaccgtacggtaccgaaccggcccgtaacggtcccg

SEQ ID NO: 83656 - DNA, 597 bp, Homo sapiens
  misc_feature: GYAE6OF01EKXIR.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctcgtgtctgagactcctggacagtcgatcaccatcctctgcactggaaccagcagtgacgttggtgtcttataatttatgtcttcctggttaccaacagctattcgaggcacgccgaccccgaaacttcttaatttatgtaggttcctttcgtccgtcctcgtacgggtttctagtcgtcttcgtccgctcaagtctgccaacgccgtcctcctgacctatctctacactcaggctggagacgagctagtactattatgcagtctactatatacgtagtaacgtctaagttcggtaactccgtaacttcgggtacgtttcgggttaccgggtaccggggaacgggtacccgtaaacggtttccggaaccccggtttaccggttaacgggtacccgtacggaacccccgtaagggtcccccg

SEQ ID NO: 83657 - DNA, 508 bp, Homo sapiens
  misc_feature: GYAE6OF01EKE9Q.36.23.C01.1.454.CMB.1.raw
  modified_base (228)..(228): a, c, t, g, unknown or other
  misc_feature (228)..(228): n is a, c, g, or t
  modified_base (464)..(464): a, c, t, g, unknown or other
  misc_feature (464)..(464): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcatttcaggcagcgcccgaaactcttaatttatgtaggttctttcgtcggccctcgtagggtttctagtcgtcttctccggctccaagtctgcaacacggcctcctgaccatctctagactcaggctgaggacgaggctgtactattatgcagctcatatactagaatcaatggtatcactgcttggtcggnggaggactaagtgacccgtctaggtacacgtcccgaaggtcccg

SEQ ID NO: 83658 - DNA, 632 bp, Homo sapiens
  misc_feature: GYAE6OF01CKPTU.36.23.C01.1.454.CMB.1.raw
  modified_base (612)..(612): a, c, t, g, unknown or other
  misc_feature (612)..(612): n is a, c, g, or t
tcagtacgctgtctcacgaccggtgctcgatttagtacacgtgattagggagttggggggggaaatactttctgagactcatggacctcctgcacaagaacatgaaacacctgtggttcttcctcctcctggtggcagctcccagatgggtcctgtctcaggtgcagctgcagcagtcgggcccagggagtggtgaagccttcggagaccctgtccctcacctgcgctggtgtctggacgcctcccgtcgggcggagatgaagtgggtggaggttgggtcccgcacggccccgaggggaacgggctggagttggagttggtagaaataaagtggaggaccgggggacaaccaactacaagtcgccgtccctcggacggggtcgagtccacatactctgacagacaacgtaccaacgaccctacttcctcccgtagacgcctacgacctcgtcgtcgacccgccggcggacctccggacctatattacgttagttgtcgtcgtaaggttggtttttcgacggtagtacgttcggttggggtacggtagtccggtacggttccgggtagggggtcgaaggggtactcggaccggtctacgttccgtacttcccnccgtcgtccccgtaacccgg

SEQ ID NO: 83659 - DNA, 494 bp, Homo sapiens
  misc_feature: GYAE6OF01AIIT1.36.23.C01.1.454.CMB.1.raw
  modified_base (461)..(461): a, c, t, g, unknown or other
  misc_feature (461)..(461): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaatttatgaggtctttcgtcggccctcaggggtttctagtcgcttctccggctccaagtctggcacacggcctccctgaccatctctagacctccaggctgaggacgaggctgactattattgcagctcatatactgaagtcaatgtatccatggctgtcggnggaggcagtgaccgtctaggcagccgaggtccg

SEQ ID NO: 83660 - DNA, 520 bp, Homo sapiens
  misc_feature: GYAE6OF01CFN9Y.36.23.C01.1.454.CMB.1.raw
  modified_base (271)..(271): a, c, t, g, unknown or other
  misc_feature (271)..(271): n is a, c, g, or t
  modified_base (373)..(373): a, c, t, g, unknown or other
  misc_feature (373)..(373): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacngcattcaggcagcgaccccgaaatctttaatttatgaggttctttcgtcggtccctcgtaggggtttctagtcgtcttctcccggctccaagtctggcaacncggcctcctgaccatctctagcctccgaggctggaggacgaggctagacttattattgcagctcattatactgaatcaagttggtactccacgtggcttggtcggaggacggaccagttcgaccgtctaggcacggccaaggtcccg

SEQ ID NO: 83661 - DNA, 546 bp, Homo sapiens
  misc_feature: GYAE6OF01CL0LH.36.23.C01.1.454.CMB.1.raw
  modified_base (167)..(167): a, c, t, g, unknown or other
  misc_feature (167)..(167): n is a, c, g, or t
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
  modified_base (266)..(266): a, c, t, g, unknown or other
  misc_feature (266)..(266): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacncagcctgcctccgtgtctgagactcctggacagtcgatcacatctcctgcactggaaccngcagtgacgttggngcttatattatgtctcctgtccaangcatcagcagccgacccgaactcttaattatgtagttctttcgtccgcctcgtagggttctagtcgtcttcgtccgctccaagtctggcaacgccgtcctcctgtaccatctctacgctccgagtctaggaggacgagtctagacttagttatcggacacgtctactaattatacgtagaagttcaagttgtactccgtagtcggcttcggttacgggacgggtacggtaaccgtaggttcgtacccgtcgtaggtaccaacggtcccgaaagggtcccg

SEQ ID NO: 83662 - DNA, 578 bp, Homo sapiens
  misc_feature: GYAE6OF01COLZP.36.23.C01.1.454.CMB.1.raw
  modified_base (272)..(272): a, c, t, g, unknown or other
  misc_feature (272)..(272): n is a, c, g, or t
  modified_base (392)..(392): a, c, t, g, unknown or other
  misc_feature (392)..(392): n is a, c, g, or t
  modified_base (423)..(423): a, c, t, g, unknown or other
  misc_feature (423)..(423): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtcttcctggttccaacngcattcaggcagccgaccccgaaacttcttaatttatgtagttctttcgtccggtccctcgtagggtttctagtcgtcttctccggctcaagtctggacaacgcggtccctcctgacctntctctacgactccgaggtctaggacggacgnggctgtactattatgcagtctacaattacgtactagtaacgttctaattcggtacttccgacgttgggtccttgggttccggacggggtacggtacccgtaagggttccgtacccggttccgtaaggttcccgaacggtccccgaagggtccccg

SEQ ID NO: 83663 - DNA, 666 bp, Homo sapiens
  misc_feature: GYAE6OF01C7IBD.36.23.C01.1.454.CMB.1.raw
  modified_base (143)..(143): a, c, t, g, unknown or other
  misc_feature (143)..(143): n is a, c, g, or t
  modified_base (236)..(236): a, c, t, g, unknown or other
  misc_feature (236)..(236): n is a, c, g, or t
  modified_base (250)..(250): a, c, t, g, unknown or other
  misc_feature (250)..(250): n is a, c, g, or t
  modified_base (263)..(263): a, c, t, g, unknown or other
  misc_feature (263)..(263): n is a, c, g, or t
  modified_base (275)..(275): a, c, t, g, unknown or other
  misc_feature (275)..(275): n is a, c, g, or t
  modified_base (278)..(278): a, c, t, g, unknown or other
  misc_feature (278)..(278): n is a, c, g, or t
  modified_base (309)..(309): a, c, t, g, unknown or other
  misc_feature (309)..(309): n is a, c, g, or t
tcagtacgctgtctcacgaccggtgctcgatttagtacacgtgattagggagttggggggggtctcaggaggccagcgtcctctcaggacatctccaccatggcctgggctctgctgctcctcaccctctcactcgaggcacngggtcctgggcccagtctggtcctgacacagcctgcctccgtgtctgagactcctgggacagtcgatcaccagtcctcctgccactggaaccngcagtgtacgtgtntcttataattatntctctgtccaangcntcaggcagcccgacccgaaatcttaatttangtagttcttcgcgcctagtagggtttctagtctacttcgccgtcttaccaagtctacggaccaaacgtccggtcccttcccgacgacctaattcccgtacctaagtacctaccgaggtacctaggaaccggacgacggcctagtaaccttatttacttggacctaggtccttactaacgttagttaaccgtaggttaactacgttaaagttcgggtaaccttcccgtaacggttcggtacccggtttacgggtaccgggggtaccgggaaacgggggttaacccttaaacggggttacccggtaacccgtttaccggtaagggttcccgaaaccgggccccggtaaaccgggtcccg

SEQ ID NO: 83664 - DNA, 557 bp, Homo sapiens
  misc_feature: GYAE6OF01DJP1E.36.23.C01.1.454.CMB.1.raw
  modified_base (228)..(228): a, c, t, g, unknown or other
  misc_feature (228)..(228): n is a, c, g, or t
  modified_base (438)..(438): a, c, t, g, unknown or other
  misc_feature (438)..(438): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggcagccgaccccgaaactcttaatttatgtagttctttcgtcggccctgtagggtttctagtcgcttctccggctccaagtctggcaacgacggcctccctcgacctatcctctaacgacctccgaggtctagacggacgaggctgactattattgacngctcatatactgaagttcaagttggtactcccgtagtcggtcttggttccgggacgggtacgggtaaccctaaggtttcggacccgttccgtaggtaccaacggtcccgaaggtccccg

SEQ ID NO: 83665 - DNA, 846 bp, Homo sapiens
  misc_feature: GYAE6OF01ES2W9.36.23.C01.1.454.CMB.1.raw
  modified_base (253)..(253): a, c, t, g, unknown or other
  misc_feature (253)..(253): n is a, c, g, or t
tcagtacgctgtctcacgaccggtgctcgatttagtacacgtgattagggattgggggggaaatactttctgagactcatggacctcctgcacaagaacatgaaacacctgtggttcttcctcctcctggtgcagctcccagatgggtcctgtctcaggtgcagctgcagcagtcgggcccaggagtggtgaagccttcggagaccctgtccctcacctgccgctgtgtctggacgccctcccgtcggcgganatgaagtggtggtagttcgggtccgcgacgccccgaggggaacgggctggaggttggagttgggtagtaaaagtaaagtggtaacgggacccgggggaccaaccgtaaactaacgaaacgttcggaccgttcccgtaccggagggggttaccgaacggtaccaaacctaacttaacgtacgttcggaccgaacgaaaccgtaaaccggtaacccgaaaaccggtaaaccccttaaccgtttacccgttaccccgtacgggtacggtacccgttacggtaaccccgtttcgtacggtacccggacccggtccccggtacccgggacccgttacccgggaccgttaacgttaacgtttaagttttaacgtttcggttacgggtaccggtaagggttttacggttttttacggacggttaaggggttacgtttaccggggtttcggggggtaaccggtttacggttacccgggtacgggttacccgggtttacggggggtaacggtaaacggggtacgttacccggtaaccgggttcgtaacgtttcccggtttacccgttaccccgtccggtaccgtcccccgttaaacccccgg

SEQ ID NO: 83666 - DNA, 499 bp, Homo sapiens
  misc_feature: GYAE6OF01AVSDV.36.23.C01.1.454.CMB.1.raw
  modified_base (227)..(227): a, c, t, g, unknown or other
  misc_feature (227)..(227): n is a, c, g, or t
  modified_base (305)..(305): a, c, t, g, unknown or other
  misc_feature (305)..(305): n is a, c, g, or t
  modified_base (365)..(365): a, c, t, g, unknown or other
  misc_feature (365)..(365): n is a, c, g, or t
  modified_base (460)..(460): a, c, t, g, unknown or other
  misc_feature (460)..(460): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgtttggtgcttataattatgtctcctggttccaacagcattcaggcagcgccccgaaactcttaatttangagtctttcgtcggccctcaggggtttctagtcgcttctccggctccaagtctggcaacncggcctcctgaccatctctagctccaggctgaggacgaggctgactattatgcagctcatatactgaagtcaagtgtatccatggctggttcggngagggaccaggttcgaccgtctaggtcacgcccaggtcc

SEQ ID NO: 83667 - DNA, 495 bp, Homo sapiens
  misc_feature: GYAE6OF01A0AG6.36.23.C01.1.454.CMB.1.raw
  modified_base (367)..(367): a, c, t, g, unknown or other
  misc_feature (367)..(367): n is a, c, g, or t
  modified_base (425)..(425): a, c, t, g, unknown or other
  misc_feature (425)..(425): n is a, c, g, or t
  modified_base (428)..(428): a, c, t, g, unknown or other
  misc_feature (428)..(428): n is a, c, g, or t
  modified_base (458)..(458): a, c, t, g, unknown or other
  misc_feature (458)..(458): n is a, c, g, or t
  modified_base (482)..(482): a, c, t, g, unknown or other
  misc_feature (482)..(482): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaatttatgaggtctttcgtcggcctctaggggtttctagtcgcttctccggctccaagtctggcaacncggcctcctgaccatcctctagactccagtctgagacgagctgactattatgcagctnatntactgaatcaatgtatcatgactggtcggnggaggacagttcgacgtcgtagtnacgccgagtcccg

SEQ ID NO: 83668 - DNA, 770 bp, Homo sapiens
  misc_feature: GYAE6OF01BDWQ2.36.23.C01.1.454.CMB.1.raw
  modified_base (547)..(547): a, c, t, g, unknown or other
  misc_feature (547)..(547): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacggggtcctgggcccagtctggcctgacacagcctgcctccgtgtctgagactcctggacagtcgatcacatctcctgcacgtgaaccagcagtgacgttggtgtcttaataattatcgtctccgttcggttaccaacgtagcctattccgaaggtccaacggcccgaccccgtaaacttctttaaatttagtggtaacggtttccttttcggtccggtcccttacggttacggggttttactacggttaccgtccgtttaccgtcccggtaccttaccgaagttccgtacggacctaaaccgcccggtccccttcccgtacgaccctaacttcctacgtacgacctcccgaaggtcgtaggaacggtacggaacggtcttaggtaccttagtttactcgaccgtacnccgtttacaaagttaacttaaccgtagggtaaaaccgttacgtaaacgttacgggttacctacccggttaacggttcgggttaccggttacgggggtttacccggggaaccgggggttaaacccgggaacccgtttaaaggggttccccggttaacccggttaccggttaccgggttaccgtaaccggacccccgtaaacggggtcccgtaaccccccccggg

SEQ ID NO: 83669 - DNA, 527 bp, Homo sapiens
  misc_feature: GYAE6OF01AW9O8.36.23.C01.1.454.CMB.1.raw
  modified_base (269)..(269): a, c, t, g, unknown or other
  misc_feature (269)..(269): n is a, c, g, or t
  modified_base (429)..(430): a, c, t, g, unknown or other
  misc_feature (429)..(430): n is a, c, g, or t
  modified_base (476)..(476): a, c, t, g, unknown or other
  misc_feature (476)..(476): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttatattatgtctcctgttccaacngcattcaggcagcgccccgaaactctttaatttatgagtctttcgtcggccccttcgtaggggtttctagtcgtcttctccggctccaagtctggcaacgaccggcctccctgaccatctctacgacctccaggctgaggacgagctgactattattgcnnctcatactacgtagaattcaagtgtactccactggtctggtccggngggacgggtaccaaggttcgaccgtccgtaggtaccacgcccgaggtcccg

SEQ ID NO: 83670 - DNA, 645 bp, Homo sapiens
  misc_feature: GYAE6OF01DA3S6.36.23.C01.1.454.CMB.1.raw
  modified_base (227)..(227): a, c, t, g, unknown or other
  misc_feature (227)..(227): n is a, c, g, or t
tcagtacgctgtctcacgaccggtgctcgattagtacacgtgattagggattggggggggtctcaggaggcaccgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgtacttataattatgtctcctggttccaacagctattcaggcacgccgaccccgtaaattcttaatttagtgtacggttctttcgtccggtccctagtacgggtttctacgtcgtcttccgtccggtctccgaagtctcggacctaacgaccggtcctcctacgacctactctacctacgacctcgacggtctaggacggacgacggctcggtaacttagttacttcgactacgtcttacgtaattacgttaacgtaggtaacgtactaacgttggttaactcccgtaacgttggtccgtttagggttccgggacgggtaacgggtaaccgtaaacgggtttccggaacccgttaccggtacggtaacccgtacggaacccgaacgggtcccgttacccccggg

SEQ ID NO: 83671 - DNA, 833 bp, Homo sapiens
  misc_feature: GYAE6OF01E3KLA.36.23.C01.1.454.CMB.1.raw
  modified_base (227)..(227): a, c, t, g, unknown or other
  misc_feature (227)..(227): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctctgcactggaaccngcagtgacgttggtgcttataattatgtctcctggttccaacagcattcaggcagccgacccgtaaacttctttaatttatgtacggttctttccggtccggtcccttcgtaggggttttcctacggttccgtcctttccgtcccggtacttacccgaagttccgtcgggacctaaacccgtaccggtccccttaccccgtacgtaccctaagttccctacgttaaccggtacccttacccggaagggtacccgttagggaacgggtaaccggaacgggtaccgttacggtaaaccttttaacgtttaacgtttcggacccgtaacggtaccctttaccgtaaacgtttaacgttaaccgttaaacggttaaaacgttaccgtaaaacggttttacggggttaaaaccctttccccggtaaccggtttacggggtaacccggttttaccgggggtttaacccgggggtaccggggtaaaacccgggggttaaaccccgttaaacgggttttaaccccgggtaaacccccgggtttaccccggtttaaacgggggttaccccgaaccccggggttaaaccccccggtaaagggggttccccccccgg

SEQ ID NO: 83672 - DNA, 544 bp, Homo sapiens
  misc_feature: GYAE6OF01CEL4T.36.23.C01.1.454.CMB.1.raw
  modified_base (270)..(270): a, c, t, g, unknown or other
  misc_feature (270)..(270): n is a, c, g, or t
tcagtacgctgtctcacgaccggtgctcgattagtacacgtgattagggattgggggggggtctcaggaggcagcgctctcaggacatctccaccatggcctgggctctgctgctcctcaccctctcactcagggcacagggtcctgggcccagtctggcctgacacagcctgccctccgtgtctgagactcctggacagtcgatcaccatctcctgcactggaaccagcagtgacgttggtgcttataattatgtctcctggttccaangcattcaggcagccgccccgaaactcttaatttatgtagtctttcgtcggccctgtagggtttctagtcgcttctccggctccagtctggcaacacggcctcctcgaccatctctagacctcaggctaggaggacgaggctgacttattattgactgctacatatactgaagttcaagttggtactcctacgtcggtctacggttcgggacgggtagggtacccgtaaaggttcgacccgttcctaagggtccaacggtcccgtaaggtccccg

SEQ ID NO: 83673 - DNA, 601 bp, Homo sapiens
  misc_feature: GYAE6OF01D1QG4.36.23.C01.1.454.CMB.1.raw
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactcggaaccagcagtgacgttggtgcttataattatgtctcctggttaccaacagcattcaggcacgccgacccgaaacttcttaatttactgtacgttctttcgtccggtcctcgtaggggtttctagtcgtcttcgtccggctcaagtctggaccaacgccggccctccctacgacctattcctctacgacctccgaggctaggaggacgaggtctgtacttattattgactagctacattactacgtgtaagttactaagttggtaactccgtaacgtcggtacgttcgggttcgggaccgggtaacgggtaacctaaggtttcggaaccccggttaccgttaacgggtaccaaccggtccccgtaaacgggtccccg

SEQ ID NO: 83674 - DNA, 665 bp, Homo sapiens
  misc_feature: GYAE6OF01DSAUA.36.23.C01.1.454.CMB.1.raw
  modified_base (234)..(234): a, c, t, g, unknown or other
  misc_feature (234)..(234): n is a, c, g, or t
  modified_base (279)..(279): a, c, t, g, unknown or other
  misc_feature (279)..(279): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgacgacctcctggacagtcgatcaccatcctcctgcacgtcggaaccngcagtgacgttggtgcttaataattatgtccttccgtgttccaanagctattcaggccgacgccgaccccgtaaacttctttaatttagtgtacgtttctttccggtccggtcccgttacgtacgggtttctacgtcgtcttcgtccggctacctaagtctacggccaaacgcccggtccctcccgtacgacctacttccctaccttaacgtaccttccgaacggtcgttacgggaacggacggtaggcttacgtacttagtttagttcgactagtcttactaattactacgttagaaacgttctaaaggttcgttaactccgtacgtcgggtcgttcgggttccgggacgggtaacgggtacccgttaaaggttcccggaacccggttccgttaacggaccgtaaccggtccccggaacgggttccccgg

SEQ ID NO: 83675 - DNA, 649 bp, Homo sapiens
  misc_feature: GYAE6OF01BLB3O.36.23.C01.1.454.CMB.1.raw
tcagtacgctgtctcacgaccggtgctcgatttagtacacgtgattagggattggggggaagaggaagactgacggtcctgtctcaggtgcagctgcagcagtcgggcccaggagtggtgaagccttcggagaccctgtccctcacctgcgctgtgtctggagcctccctcggcggagatgaatggtggagttgggtccgccagcccccagggaaggggctgagttggattggtgaaataaatgagaccggggcaccaactacaatgcgtccctcaggggtcgagtcaccatatctgcagacaagtaccaagaaccacttctccctgagctgacctctgtgaccgccgcggactcggccatatattattgtgcgtagtagtttttgacgtaggtatcgttggggcggttagtcggtaacggttcgtgggggttacgaaggggtactcgtacgggtctacgttccgtcctccctcacgccctcccaacccgaacgggcccctaacgtcccggttcccttcccccgtcggacccgccccgttcgtcccgtcccgacggtaccggcccgtaacccgtacccggtaacgaccggacccaacccgacgggccccgggtacccccggttcgggggtccccgttcgggtccccggg

SEQ ID NO: 83676 - DNA, 538 bp, Homo sapiens
  misc_feature: GYAE6OF01E2J3A.36.23.C01.1.454.CMB.1.raw
  modified_base (228)..(228): a, c, t, g, unknown or other
  misc_feature (228)..(228): n is a, c, g, or t
  modified_base (479)..(479): a, c, t, g, unknown or other
  misc_feature (479)..(479): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttgtgcttataattatgtctcctggttccaacagcattcaggcagccgccccgaaactcttaatttatgtagtctttcgtcggccctgtagggtttctagtcgtcttctccgctccaagtctggcaacaccggcctccctgacctatcctctagacctccaggtctggaggacgaggctgactattattgctagctcattatactagaatactaagtggtatccatcggcttggttccgggnggaacgggtacctaaggttgaacccggttccgtacggtcgacggaccccgaggtccccg

SEQ ID NO: 83677 - DNA, 584 bp, Homo sapiens
  misc_feature: GYAE6OF01ANNMK.36.23.C01.1.454.CMB.1.raw
tcagtacgctgtctcacgaccggtgctcgatttagtacacgtgattagggattggggggaagaggaagactgacggtcctgtctcaggtgcagctgcagcagtcgggcccaggagtggtgaagccttcggagaccctgtccctcacctgcgctgtgtctggagcctccctcggcggagatgaatggtggagttgggtccgccagcccccagggaaggggctgagttggattggtgaaataaatgagaccgggggcaccaactacaatgcgtccctcgaggggtcgagtcaccatatctgcagacaagtccaagaaccacttctccctgaggctgacctctgtgaccgccgcggactcggccatatattattgtgcgtagtagtttttgcaggtatcgttggggcgtagtcggacgttcgtggggtcgaagggactcgacggtctagttccgtctccctcacgtccctaccgacccaacgggcccctacgttccggtcccttccccgtcggccgccctcgcctcccgacggcgccacccgtccggacgacgccacgacggccggcccgtcgggccgtcgtcccgg

SEQ ID NO: 83678 - DNA, 616 bp, Homo sapiens
  misc_feature: GYAE6OF01BJ2BZ.36.23.C01.1.454.CMB.1.raw
  modified_base (226)..(226): a, c, t, g, unknown or other
  misc_feature (226)..(226): n is a, c, g, or t
tcagtacgctgtctcacgaccggtgctcgattagtacacgtgattagggattggggggggtctcaggaggcaccgctctcaggacatctccaccatggcctgggctctgctgctcctcaccctcctcactcagggcacagggtcctgggcccagtctggcctgacacagcctgcctccgtgtctgagctcctggacagtcgatcaccatctcctgcactggaaccngcagtgacgttggtgcttataattatgtctcctggttccaacagctattcaggcacgccgaccccgaaactctttaatttatgtaggttctttcgtcggcccttcgtagggtttcaggtcgtcttcctccggcctccaagtctggccaacgaccggtccctccctcgacccattcctctacgacctccgaggtctaggacggacgtaggctgaacttattagttcgactagtcctacaattaatacgtagtaaagttacaagttcggtactcccgtaagtcggtacgttcggttccggggacgggtaaggggaaccctaaggtttccggaaccggttacccgttaacgggtacccgaacggacccccgtaaagggtcccgttaccccggg

SEQ ID NO: 83679 - DNA, 813 bp, Homo sapiens
  misc_feature: GYAE6OF01ADJYD.36.23.C01.1.454.CMB.1.raw
  modified_base (231)..(231): a, c, t, g, unknown or other
  misc_feature (231)..(231): n is a, c, g, or t
  modified_base (273)..(273): a, c, t, g, unknown or other
  misc_feature (273)..(273): n is a, c, g, or t
tcagtacgctgtctcacgaccggtgctcgattagtacacgtgattagggagttggggggggtctcaggaggcagcgctctcaggacatctccaccatggcctgggctctgctgctcctcaccctcctcactcagggcacagggtcctgggcccagtctggcctgacacagcctgcctcgtgtctgagactccgtggacagtcgatccaccatcctcctgccactggaaccngcaggtcgacgttggtgcttataattatgtctcctggtccanagcattcaggcacgccgaccccgaaacgttctttaaatttagtcggtaggttccgtttccggtcccgggtcccctttacggtacgggggttttcctaacggttcccggtccgttttcccgtcccggtcctttaccccgtaaaggttcccgtcggggtaccctaaaacccgtaacccggggtcccctttacccccgttacggtaacccctaacgttacccgtaccgttaacgtaccccttaccccggtaacgggtaccgttacgggaacgggaacccggtaacgggttccgtacggtaaccttacgtttaacgttcgaccgtacgttcctaccgtaacttaacgttaaccgttaggtaaacgttcgtaaaggttacgggttaaccttacccgaacggtttcgggtccggtttacggggttacccggggtaccgggggttaaacgggtacccggttaaacgggtttacccgggtaccccgggtttacccgttaaaccggggttcccgtaaaccgggtcccccgtaaaagggggttccccccg

SEQ ID NO: 83680 - DNA, 579 bp, Homo sapiens
  misc_feature: GYAE6OF01DYEZL.36.23.C01.1.454.CMB.1.raw
  modified_base (212)..(212): a, c, t, g, unknown or other
  misc_feature (212)..(212): n is a, c, g, or t
  modified_base (227)..(227): a, c, t, g, unknown or other
  misc_feature (227)..(227): n is a, c, g, or t
  modified_base (264)..(264): a, c, t, g, unknown or other
  misc_feature (264)..(264): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctcgtgtctgagactcctggacagtcgatcaccatcncctgcactggaaccngcagtgacgttgtgcttatattatgtctctgttccanagcattcaggcagccgacccgaattcttaattatgtaggttctttcggtcgtcctcgtagggtttctacgtcgtcttcctccggtctccgaagttcctagggtaccaaacgtaccggtccctcccgtacgaccctactcctactacgacctccgaggctggacggacgagctagtactattatcgctagtctatatatacgtagtaatactaagtaggtactccgtacgtcggtacgttcggttccgggagggtaacgggtacctacggttacgacccggttacgttacggaccgtacgtacccgaaggtccccg

SEQ ID NO: 83681 - DNA, 704 bp, Homo sapiens
  misc_feature: GYAE6OF01DM3VB.36.23.C01.1.454.CMB.1.raw
  modified_base (268)..(268): a, c, t, g, unknown or other
  misc_feature (268)..(268): n is a, c, g, or t
tcagtacgctgtctcacgaccggtgctcgatttagtacacgtgattagggattgggggggtctcaggaggcagcgctctcaggacatctccaccatggcctgggctctgctgctcctcaccctctcactcagggcacgagggtcctgggcccagtctggcctgacacagcctgcctccgtgtctgagactccgtggacagtcgatcaccatctcctgcactggaaccagcagtgacgttgtgacttataattatgtctcctgtccaangctatcaggcagccgacccgaaatcttaatttatgtagttctttcgtcgcctcgtagggttctacgtcgtctttcgcccggtctaccgaagttctggaccaaccgaccggtccctccctgaaccctagtcctacgtagaccttccgaaggtcctagggacggtaacggacggtcttaggtaacctttaagtttacttcggactacggtaccttactaaacgttacttaaccttaggtaaacttttacgtaaacgtttcgggtaacctttacccgtaacgttcgggttacccggttacggggttttccgggggaaccggggttaaccgggggtaaaccccgtttaaacggggtttacccggtaaacccccggtttacccgggttaaacggggttaccccctaaccgggttaacccccggtaaaggggttccccccgg

SEQ ID NO: 83682 - DNA, 578 bp, Homo sapiens
  misc_feature: GYAE6OF01A12EA.36.23.C01.1.454.CMB.1.raw
  modified_base (228)..(228): a, c, t, g, unknown or other
  misc_feature (228)..(228): n is a, c, g, or t
  modified_base (368)..(368): a, c, t, g, unknown or other
  misc_feature (368)..(368): n is a, c, g, or t
  modified_base (377)..(377): a, c, t, g, unknown or other
  misc_feature (377)..(377): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggcagccgaccccgaaatcttaattatgtagtctttcgtcgtccctcgtagggtttcagtcgtcttcgtccggctccaagtctggcaacncggcctccngaccatctctacgactcgaggtctggacggacgagctagacttattatgcagctcattactactagtaacttcgtaagtcggtactcccgtaacgttcgggtacctttgggttccgggaggggtaacgggtaccctaaaggggtttcccgtaacccggttccgttacgggtaccaccgggtaccccgtaaagggtcccccg

SEQ ID NO: 83683 - DNA, 557 bp, Homo sapiens
  misc_feature: GYAE6OF01CQZW3.36.23.C01.1.454.CMB.1.raw
  modified_base (445)..(445): a, c, t, g, unknown or other
  misc_feature (445)..(445): n is a, c, g, or t
  modified_base (499)..(499): a, c, t, g, unknown or other
  misc_feature (499)..(499): n is a, c, g, or t
tcagtacgctgtctcacgaccggtgctcgatttagtacacgtgattagggattggggggaagaggaagactgacggtcctgtctcaggtgcagctgcagcagtcgggccccaggagtggtgaagccttcggagaccctgtccctcacctgcgctgtgtctggagcctccctcggcggagatgaatggtggagttgggtccgccagcccccagggaaggggctgagttggattggtgaaataaatgagaccgggggcaccaactacaatgcgtccctcaggggtcgagtcaccatatctgcagacaagtaccaagaaccacttctccctgaggctgacctctgtgaccgccgcgactcgcatatattatgtgcgagtagttttgctaggatcgttgggcgtatcgtacgtcgtgggtcgaaggatcacggtcagtcgtctcctcanccctcaccgaacggcccagttccggtccttccccgtggccgccctcgcctccgnggacgccacctccggacgacgccacgtacggacccggcccgtcgggcgtcgtacccgg

SEQ ID NO: 83684 - DNA, 543 bp, Homo sapiens
  misc_feature: GYAE6OF01B1TRF.36.23.C01.1.454.CMB.1.raw
  modified_base (227)..(227): a, c, t, g, unknown or other
  misc_feature (227)..(227): n is a, c, g, or t
  modified_base (433)..(433): a, c, t, g, unknown or other
  misc_feature (433)..(433): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagctcctggacagtcgatcaccatctcctgcactggaaccngcagtgacgttggtgcttataattatgtctcctggttccaacagcattcaggcagccgccccgtaaactcttaatttatgagttctttcgtcgcctcgtagggtttcagtcgcttctccgctcagtctggcacgacggcctccctgaccatcctctacgacctccgaggctggagacggagctggacttattacgttgcacgtctnaattatacgtagtaagttctaagtcggtactcctacgttggcttggttccgggacgggaacggtacctaaggttcgaccgttcgtacggtacacgtccccgaaggtcccg

SEQ ID NO: 83685 - DNA, 562 bp, Homo sapiens
  misc_feature: GYAE6OF01ATRD2.36.23.C01.1.454.CMB.1.raw
tcagtacgctgtctcacgaccggtgctcgattagtacacgtgattagggattgggggggtctcaggaggcaccgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgcccgaaactcttaatttatgaggttctttcgtcggcccttgaggggtttctagtcgctttctccggctcaagtctggcaacacggtcctccctgaccctatctactacgactccaggctgacggacgaggtacctgtacctattattcgctagctcaatactacgtagtaagtctaagtcggttactccgtaactcggtctggttcgggcgggtaagggtacccgaaggttccgaccgttaccgttacggtacacggacccgaagggtcctacccggg

SEQ ID NO: 83686 - DNA, 630 bp, Homo sapiens
  misc_feature: GYAE6OF01BV5S0.36.23.C01.1.454.CMB.1.raw
  modified_base (226)..(226): a, c, t, g, unknown or other
  misc_feature (226)..(226): n is a, c, g, or t
  modified_base (267)..(267): a, c, t, g, unknown or other
  misc_feature (267)..(267): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctcgtgtctgagactcctggacagtcgatcacatctcctgcactggaaccngcagtgacgttggtgcttataattatgtctcctgtccaacngcattcaggcacgccgaccccgtaaacttctttaaatttatagtaggttcctttcgtccgcccttcgtagggtttcctaggtccgtctttccgtccggctacccgtaagtcgtcggtaccaacgaccggtccctcccgtcgacctatccttacgtacgacctccgaggtccgtaggaacgggacgaacggtcttaggtacttaagtttacgttcgactaacgtccttacaattacgtaccgtaggtaaacgttacaagttcggtaactccgtagttcgggtacttcgggttaccgggacgggtacgggtaaccctaaggttacggacccgttacgtacggtaccgacgtacccgaggtccccg

SEQ ID NO: 83687 - DNA, 700 bp, Homo sapiens
  misc_feature: GYAE6OF01AF36L.36.23.C01.1.454.CMB.1.raw
  modified_base (241)..(241): a, c, t, g, unknown or other
  misc_feature (241)..(241): n is a, c, g, or t
  modified_base (253)..(253): a, c, t, g, unknown or other
  misc_feature (253)..(253): n is a, c, g, or t
  modified_base (267)..(267): a, c, t, g, unknown or other
  misc_feature (267)..(267): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggngtcttataattntgtctctgtccaangcatcaggcacgccgacccgtaaatctttaattagtgtacggttcctttcgtccggtccttcggtagggtttcctacggtcgtcctttccgtcccggtccttaccgaagttccgtcggaccaaacccgtaccgggtccccttaccccgtcgtaaccctacttcccgttaccgtacgaccttcccggacggtccgtacgggaacgggaccggtacgggtaccttaggtacctttaagtttacgtttcggacctaacgtccttacgaactttaacgttaacgtaacggtaaacgttacctaaagttaccggttaacttacccgtacggttcgggtaccgttacggggttccggggaccggggtaaacgggtacccgtaaggttaccggtaacccgttacggtacggtaccgaccggtaccccgtaagggtccccg

SEQ ID NO: 83688 - DNA, 535 bp, Homo sapiens
  misc_feature: GYAE6OF01AN0YA.36.23.C01.1.454.CMB.1.raw
  modified_base (232)..(232): a, c, t, g, unknown or other
  misc_feature (232)..(232): n is a, c, g, or t
  modified_base (369)..(369): a, c, t, g, unknown or other
  misc_feature (369)..(369): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgccctccgtgtctgacgactccgtggacagtcgatcaccatcctcctgcactggaaccngcagtgacgttggtgcttataattatgtctcctggttccaacagcattcaggcagccgccccgaaactcttaatttactgagttcttcgtcgccctcgagggtttctagtcgcttctccggctcaagtctggcaacncggtccctccctgacctatctctagactccaggctgagacgagctgactattatgcagctcatatacgtgtaacgttcaagttggtatccgaacttggtactggtttcgggcggaacgggaccgtaagtcggtacccgtcgtaggttccacgtcccgaaggtcccg

SEQ ID NO: 83689 - DNA, 632 bp, Homo sapiens
  misc_feature: GYAE6OF01DRT7B.36.23.C01.1.454.CMB.1.raw
  modified_base (205)..(205): a, c, t, g, unknown or other
  misc_feature (205)..(205): n is a, c, g, or t
  modified_base (252)..(252): a, c, t, g, unknown or other
  misc_feature (252)..(252): n is a, c, g, or t
  modified_base (273)..(273): a, c, t, g, unknown or other
  misc_feature (273)..(273): n is a, c, g, or t
  modified_base (280)..(280): a, c, t, g, unknown or other
  misc_feature (280)..(280): n is a, c, g, or t
  modified_base (306)..(306): a, c, t, g, unknown or other
  misc_feature (306)..(306): n is a, c, g, or t
tcagtacgctgtctcacgaccggtgctcgatttagtacacgtgattagggagttgggggggggtctcaggaggcagcgctctcaggacatctccaccatggcctgggctctgctgctcctcaccctcctcactcgagggcacgagggtcctgggcccagtctggcctgacacatcctgcctccgtgtctgacgactccgtggacngtcgatcaccatcctcctgcacgtggaaccagcagtgtacgttggtntactatatatgtctctgtcangcatcgngcacgccgaccgtaacttcttaattntgtacgtcttcgtacgcctggtaggttctacgtcgtcttcgccgtctaccgtaacgtcgacgacaccgcggtccctacctcgacctactcctacgtacgactccgaggtcgtacggacggtacggtaggtaccgttacgtaacgttagttacgttacgacgtacgtcgtaactaacttacgttaacgtacgtaaacgtagtaacgttacggttaactaccgtacggtcgggttaccgttcgggttacggggacgggtagggtaacccgtaagggttacccgtacccggttaccgtacggacgaacccgtaaccggtacgggtcccg

SEQ ID NO: 83690 - DNA, 802 bp, Homo sapiens
  misc_feature: GYAE6OF01CS56A.36.23.C01.1.454.CMB.1.raw
tcagtacgctgtctcacgaccggtgctcgatttagtacacgtgattagggattggggggaagaggaagactgacggtcctgtctcaggtgcagctgcagcagtcgggcccaggagtggtgaagccttcggagacctgtccctcacctgcgctgtgtctggagcctccctcggcggagatgaagtgggtggaggttcgggtccgccgacggccccccgaagggggaacggggcgtggtaggttgggtagttgggtaagaaaagtaaagtggaacgggaccgggggaccaaccgaaactacaaagtcggaccgtcccgtacggacggggtcgacggtaccaacctaattacgtacctacggacaagaacctaacggtaaccaaacggaaccctacctttaccctccccgtaggaacggtccgttacgtaacccgttcgtacggtccggaaccccggtccggaccggtaccgtccggaccctaagttaactttaactttaacggttggtacggtaccggttaaggttttacggttttttcggaacggtaacgggttacgtttccggggtttacgggggtaccggttaacgttccgggtaaccgggtttcggggtacggggttaacgtaaagggggtactacggtaacgtcgtaacgtccggttcctccggtaccacgtccctaccgaaccggtaaccggccccttagtcccgtacccttccccggtcgcccgccctggccctcgacgtacgccctaccgcgacgaccgacgacgaccggccggcccgtacgggcctcggtcccgg

SEQ ID NO: 83691 - DNA, 663 bp, Homo sapiens
  misc_feature: GYAE6OF01BNND7.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctcctgccacgtggaaccagcagtcgacggttggtgtcttaataattatgtcttcctggttaccaacagtctagttcaggcacggccgaccccgaaattacttaaatttagtgtaggttctttacggtccggtcccgttcggggtttctacggtcgtcttctccgtcgtctacgtagtcgtacgacaaccgaccgtccctacctcgacctctctactacgtaccgtacgacgtcgtaggacggacggtacggtctacggtacttagttagttcgatacggtctaagtaacttacgtacgttaagtaacgttaacgtaacgttagtaccttaccgttacgtacggttacggttcgggtaccggggtagggtaaccgggtaacgttaaccgggttacggtaaccccggttccggttacggtaacccgtaacgaccccgtaagggttacccccg

SEQ ID NO: 83692 - DNA, 689 bp, Homo sapiens
  misc_feature: GYAE6OF01ETOJP.36.23.C01.1.454.CMB.1.raw
  modified_base (278)..(278): a, c, t, g, unknown or other
  misc_feature (278)..(278): n is a, c, g, or t
tcagtacgctgtctcacgaccggtgctcgatttagtacacgtgattagggattggggggggtctcaggaggcagcgctctcaggacatctccaccatggcctggctctgctgctcctcaccctcctcactcagggcacagggtcctgggcccagtctggcctgacactagcctgccctccgtgtctgagacctcctggacagtcgatcaccatcctcctgcacgtggaaccagcagtgacggttgtgtcttaataattatgtcctctcggttaccaanacgtctattcaggcacgccgacccgaattcttaattgtgtacgtcttcgtccgtccctcgtagggttctagtccgcgttctccggtctaccgtaagtccgaggtaccaaccgtaccggtcccctaccccgtacggaacccctagtcccgttaccgtaacgtaccccgtccgtaacggtcgtacgggaacgggtacggtaacggttcctacggttaactttagtttaacgttcgtaccgtacgttactaccgtaataacgttacgtaagtaacgttaactaggttaccggtacttaccgtacggtcggtccgtttacggggttccgggaccgggtacgggtaaccgtaacggttccgggtaacccgttccggttaacgggttaccaacccggtaccgtaacggtacccccgg

SEQ ID NO: 83693 - DNA, 954 bp, Homo sapiens
  misc_feature: GYAE6OF01EZXT1.36.23.C01.1.454.CMB.1.raw
  modified_base (240)..(240): a, c, t, g, unknown or other
  misc_feature (240)..(240): n is a, c, g, or t
tcagtacgctgtctcacgaccggtgctcgatttagtacacgtgattagggattggggggggtctcaggaggcagcgctctcaggacatcctccaccatggcctggctctgctgctcctcaccctcctcactcaggtcacgagggtcctgggcccagtctcggcctgacacagcctgccctccgtgtctgacgacctccgtggacagtcgatccaaccattcctcctgcacgtcggaaccngctagtgtacggtttggtcgtacttttaataaatttatcgttccttccgttcggtttacccaaacacggtcctaatttaccgacggtccgacggtccccggtaaaccccccggtaaaacttttaccgttttaaaatttttacggttacggggttaacgggttttcccgttttttccggggttaccccgggttcccccgtttacgggtttaacggggggttttttccttaaccgggtttcccggtttccgttttccccgggttccccgggttacccgtttaaccccggtaaacggtttccgttacggggtaaccccgtaaaacccggtacccccggggttaccccctttacccccggttaaccggtaacccctttaacttaccccgtttaacccgttaacccgggtaacccctttaccccgggaacgggttcccgttaacgggggaaaccgggtaacccgggaacgggttacccgttacggttaaccttttaagttttacgtcggtaccgtacgtccttaccgtaattaacgttaacgtacggtaaacgttacctaaggttaccggttacttacccgtacggttaccggtccgtttacggggttaccggggtaccggggaaccggggttaacccgttaagggtttacccgggtaaccccggtttaccgggttaacgggttacccgaaccgggtaccccggtaaagggttcccccg

SEQ ID NO: 83694 - DNA, 682 bp, Homo sapiens
  misc_feature: GYAE6OF01C43M3.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacgagggtcctgggcccagtctggcctgacacagcctgcctccgtgtctgagactcctggacagtcgatcaccatctcctgcacgtggaaccagcaggtgtacggttggtgtacttaataattattcgtcttccgttcggttaccaacagtctagttcgaaggccacggcccgaccccgtaaacttctttaaatttagtaggtaacggtttccgtttccggtcccggtccgttacggtacggggttttctacggttccgtccgtttccgtccggtctaccgtaaggtccgtagggacctaaccgaccggtccctaccgtacgtaaccctatccttactaacgtacctaccgaggtctagggaacggtacgtacggtcgtacgtaacctttaattacgttacgctacgtcttaactaatacgttaacgtagtaaacgttacgtaagttacggtactccgtagtcggtccgttacgggtacgggacggaacggtacctaaacggttcgaacccgttcggtacgtaccgaccgtccgtaacggtcccg

SEQ ID NO: 83695 - DNA, 770 bp, Homo sapiens
  misc_feature: GYAE6OF01EVMU0.36.23.C01.1.454.CMB.1.raw
  modified_base (241)..(241): a, c, t, g, unknown or other
  misc_feature (241)..(241): n is a, c, g, or t
tcagtacgctgtctcacgaccggtgctcgatttagtacacgtgattagggagttgggggggggtctcaggacggcagcgctctcaggacatctccaccagtcggcctgggctctgcgtgtcctcctcaccctccttcacgtcacgggcacagggtcctgggcccagtctggcctgacacagcctgccctccgtgtctgagactccgtggacagtcatcaccatctcctgcacgtggaaccngctagtgtaacgttggtgtcttataattatcgtctcctaggttaccaacgacgctatttcgaggtcacgcccgaccccgtaaacgttcctttaaatttagtaggtaacgggtttccgttttacccggtaccggttacccccttaggttacggggttttccgtaacggttccgtaccgtttccgtaccggtccgttaccgaaacgttccgtagggtaccaaaccgtacccggtccccttaccccgttacgaaccctaacgttccgttaccgtacgtacctacccggagggtacctaggtaacggggtaaccgtaacgggtccttaacggttaaccttaacgtttacgttacgtaccgtacgtacttacttaacgtacgttaacgtacggtaacgttaaccgtaaagttacggttaacctccgtaacgttacggtacgttacgggttaccgggtacgggtacggggtaacccttaaggttaccgaacccggttcgttaacgggtacctaccggtacccgaacggttccccg

SEQ ID NO: 83696 - DNA, 759 bp, Homo sapiens
  misc_feature: GYAE6OF01DWE4I.36.23.C01.1.454.CMB.1.raw
tcagtacgctgtctcacgaccggtgctcgattagtacacgtgattagggattgggggggggtctcaggaggcagcgctctcaggacatctccaccatggcctgggctctgctgctcctcaccctcctcactcagggcacgagggtcctgggcccagtctggcctgacacagcctgccctccgtgtctgacgtacctcctgggaccaggtcaatccaacctattcctcctgcctacgtcggaaccagcgtaggtggtacgttggtgtactttataattatcgtccttccgttcggttaccaacagtactaattcgaggcgacgccgtaccccgtaaattcttaaagtttctgtacggtttcttccggtccggtcctcggttagggtttcctagtccgtcttccgtccggtactaccgtaacgttccgtacgtaccgaaccgtaccggtacccttcccgtcgtaacctacttcctacgtacgtacctccgaacggtcgtaggacgggacgtacggtcttacggtaactttagttacgttcgaaccgacgtacttacgtaacttacgttaaccgttaaggtaaaccgttagtaacgtttacggtaacccttaccggtaacgttgggtacccggttacggggtttacccgggaaccgggggtaacggttaaacccggtaccggggtttacccgaaaccccgggttttaccggtaacgggtaaccctaacccgggtacccgggtaaaccggtttcccccccggg

SEQ ID NO: 83697 - DNA, 575 bp, Homo sapiens
  misc_feature: GYAE6OF01EZVKA.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgtttggtgcttataattatgtctcctggttccaacagcattcaggcacgccgaccccgaaacttcttaatttagtgtagttctttcgtcggtccctcgtagggtttctagtcgtcttctccggtctaccgtaagtctggccaaacgaccggtccctccctacgaacctatcctactacgacctccgaggctagacggacgaggctgaacttattatgacagtctactaatatactagtaagtcaatcggtaatccagttggacttgggttcggacggtaacgggtacctaaacggtttcgacccggttacgtacgggtaccacggacccgaagggtccc

SEQ ID NO: 83698 - DNA, 579 bp, Homo sapiens
  misc_feature: GYAE6OF01BRD1R.36.23.C01.1.454.CMB.1.raw
  modified_base (270)..(270): a, c, t, g, unknown or other
  misc_feature (270)..(270): n is a, c, g, or t
  modified_base (371)..(371): a, c, t, g, unknown or other
  misc_feature (371)..(371): n is a, c, g, or t
  modified_base (385)..(385): a, c, t, g, unknown or other
  misc_feature (385)..(385): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaanagcattcaggcagccgccccgaaactcttaatttatgtaggttctttcgtcggtcctcgtagggtttctagtcgtcttctccggctccaagtctggcaacncggcctcctgaccntctctacgactccaggtctggacggacgagctgacttattattgactagctacaattactactagaagttacaagtggtaactccgtagttcggcgttcgggttccgggagggtaacgggtaacccgtaaaggttaccggtaccccggttaccggttaacgggtaccgaaccggtccccgtaaaggggtccccg

SEQ ID NO: 83699 - DNA, 593 bp, Homo sapiens
  misc_feature: GYAE6OF01BHHFO.36.23.C01.1.454.CMB.1.raw
  modified_base (396)..(396): a, c, t, g, unknown or other
  misc_feature (396)..(396): n is a, c, g, or t
tcagtacgctgtctcacgaccggtgctcgattagtacacgtgattagggattggggggggtctcaggaggcaccgctctcaggacatctccaccatggcctgggctctgctgctcctcaccctctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcagttcggcagcgccccgaaactcttaatttatgtagtctttcgtcggcctcgtagggtttctagtccgtcttcgtccggctacctaagtctggcaaaccgaccggtcctccctgaccatctctanactccaggctgaggacgagctagtactattagttcgcacgtctactaagtacttaacgtgtaaaggttacaaagttgtaactccgtacgttggtcgttcggttaccgggtacggggacgggtaaccctaaggttccggaacccgttacccgtacggttccgacggtaaccccgaaggtccgtcccggtaccccccgg

SEQ ID NO: 83700 - DNA, 628 bp, Homo sapiens
  misc_feature: GYAE6OF01AQRAB.36.23.C01.1.454.CMB.1.raw
  modified_base (227)..(227): a, c, t, g, unknown or other
  misc_feature (227)..(227): n is a, c, g, or t
  modified_base (270)..(270): a, c, t, g, unknown or other
  misc_feature (270)..(270): n is a, c, g, or t
tcagtacgctgtctcacgaccggtgctcgatttagtacacgtgattagggattgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacngcattcaggcagccgccccgaaactctttaatttatgtaggttctttcgttcggccctgtagggtttctagtcgcttctccggctccagtctggcaacacggcctcctgacctatcctctacgtacctccgaggtcctaggacggacgacgggtctaggaccttatttacttgactagtctacattactacgtagtaacgttctaagttcggtaactcccgaacgttcgggtactttgggtttacccggggacggggtaacggggtaaccccttaaaaggggtttcccggtaaacccccggttacccggttaacgggttaccccgaaccgggtacccccgtaaaggggttccccccgg

SEQ ID NO: 83701 - DNA, 628 bp, Homo sapiens
  misc_feature: GYAE6OF01AHECQ.36.23.C01.1.454.CMB.1.raw
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgcctcgtgtctgagactcctggacagtcgatcaccatctcctgcactggaaccagcagtgacgttggtgcttataattatgtctcctggttccaacagcattcaggcagccgccccgaaactcttaatttatgtacggtctttcggtccggccctcgtacgggtttctacgtcgtcttctccggctccaagtctgcaacgccggtcctccctcgaccatctacgtacgacctcgaggtctacggaggaccgagggtctaggtacttagttattcgacgtacgtctctaagttactacgttagaacgttacgaagttgggtaacttacccgtacgttcgggtaccgtttgggttacccgggtacggggtaacgggtaacccgttaaagggtttacccgtaacccgggtttccccgtaaacggggttaccaacccggtaccccggtaacggtacccgg

SEQ ID NO: 83702 - DNA, 559 bp, Homo sapiens
  misc_feature: GYAE6OF01ENUHZ.36.23.C01.1.454.CMB.1.raw
  modified_base (364)..(364): a, c, t, g, unknown or other
  misc_feature (364)..(364): n is a, c, g, or t
  modified_base (370)..(370): a, c, t, g, unknown or other
  misc_feature (370)..(370): n is a, c, g, or t
  modified_base (412)..(412): a, c, t, g, unknown or other
  misc_feature (412)..(412): n is a, c, g, or t
tcagtacgctgtctcacgaccggtgctcgattagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcaggccgaccccgaaacttcttaatttatgtagttctttcgtccggtccctgtagggtttctagtcgtcttctccgctcagtcngcaacncggcctcctgaccatctctagacctccaggtctggaggacgnggctagacttattagttgcagtctcaatatacgtagtaagtacaagttaggtactccgacgttggtcttcgggttcgggagggaacgggtacctaagggttcgaacccggttccgtaacggtaccgacggtcccgaagggtccccgg

SEQ ID NO: 83703 - DNA, 730 bp, Homo sapiens
  misc_feature: GYAE6OF01ADZPR.36.23.C01.1.454.CMB.1.raw
  modified_base (229)..(229): a, c, t, g, unknown or other
  misc_feature (229)..(229): n is a, c, g, or t
  modified_base (317)..(317): a, c, t, g, unknown or other
  misc_feature (317)..(317): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctcgtgtctgagactcctggacagtcgatcaccatcctcctgcacgtggaaccngcagtgacgtttggtgcttatattatgtctcctggtaccaacagctattcgaggcacgcccgaccccgtaaattcgtttaatttacgngtacggttcctttcggtccggcccgttcgtacggggttttctacgttccgtccgtttctcccgggtcctaccgtaacgttcgtcgggaccaaaccgtccgggtcccttaccccgtcgtaacccattcctacgttaacgcctacccgtacggtccgttagggacgggaccgagggttctacggtaacttatttacgttcggactcggtccttacaacgttataccgtaggttaacgtccgttaaagttccgggttaacttacccgtacggtttacgggtacgtttccgggggtttaccgggaaccggggttaacgggtaacccggttaaacgggtttacccggtaacccccgggtttcccggttaacgggttaacccggccgggttaaacccccggtaagggttcccccccggg

SEQ ID NO: 83704 - DNA, 584 bp, Homo sapiens
  misc_feature: GYAE6OF01C2BJA.36.23.C01.1.454.CMB.1.raw
  modified_base (270)..(270): a, c, t, g, unknown or other
  misc_feature (270)..(270): n is a, c, g, or t
  modified_base (308)..(308): a, c, t, g, unknown or other
  misc_feature (308)..(308): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacngcattcaggcacgccgacccgtaaacttcttaatttangtacgttctttcgtcgcctgtagggtttctagtcgtctttcgtccggtctaccgaagtctcggactaacgaccggcccttcccgagacctacttcctacgtacgaccttccgaggtctaggaacggacgaggctagacttattagttgctagtctactatactacgtagaacgttacaagttcggtaactcctaacgtcggtcgttcgggttacggacgggtaacggtacctaaggttcgacccgttcgtacggtcaaccggcccgagggtccccg

SEQ ID NO: 83705 - DNA, 675 bp, Homo sapiens
  misc_feature: GYAE6OF01D0S1W.36.23.C01.1.454.CMB.1.raw
  modified_base (231)..(231): a, c, t, g, unknown or other
  misc_feature (231)..(231): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacgagggtcctgggcccagtctggcctgacacagcctgcctccgtgtctgagacctcctggacagtcgatcaccatcctcctgcactggaaccngcaggtgacgttggtgtacttaataattatcgtacttcctcggttaccaactgctattcaggtcacggccaccccgtaatacttaatttagtgtacgttctttcgtccgtccgttgtacggttctacgtcgtcttcgtccggctccgaacgtctcggtaccaaccgccgtccctccgtcgaacctactctaccgtacgtacctaccgacggtactaggaacgggacgacgggtcgttacgtaacgtttaattacgttacgactacgtaccttactaacgttacgtaacgttagtaaacgttactaaaggttaccgtaaccttaccgtaacgttcgggtacgttccgggttacgggaccgggtaacgggtaccgttaaccggttaccgttaacccgggttaccggttaacggtaccgtaacccgggtcccgtaacgggtcccccg

SEQ ID NO: 83706 - DNA, 656 bp, Homo sapiens
  misc_feature: GYAE6OF01EBIC4.36.23.C01.1.454.CMB.1.raw
  modified_base (228)..(228): a, c, t, g, unknown or other
  misc_feature (228)..(228): n is a, c, g, or t
  modified_base (270)..(270): a, c, t, g, unknown or other
  misc_feature (270)..(270): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgtacttataattatgtctcctgtaccangctattcagcacgccgtacccgaaattcttaattagtgtacggttctttcggtcgtcccgttcgtacgggttctagtccgtcttccgtccggtctaccgtaaggttctcggacctaaccgtaccggtccccttaccgtcgtaaccctactaccttacgtaacgtcctacccgtaggtccgtacgggtaacggaccggtacggtctacgtaccgtttaagtttaccgttagtacctaagtccttaacgtaattactaacgtagtaacggttactaagttcggtactccgtacgttggtcgttgggttaccgggacggggtaacggtaccgtaaacggttcggtacccggttccgtaagggtacccacggtcccccgtaagggtcccc

SEQ ID NO: 83707 - DNA, 518 bp, Homo sapiens
  misc_feature: GYAE6OF01ECUR0.36.23.C01.1.454.CMB.1.raw
  modified_base (228)..(228): a, c, t, g, unknown or other
  misc_feature (228)..(228): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctctgcactggaaccngcagtgacgttgtgctataattatgtctcctggttccaacagcattcaggcagccgcccgaaactcttaatttatgtaggtctttcgtcggtcccgtcgtagggtttctagtcgtcttctccggtctccaagtctgcaacgacgcctccctcgaccatctctacgactccaggctaggacggacgaggtctcgaattattattcgcagctcatatactgaatcaatggtactccagtggcttggtcggacgggaggactagtcgaccgtcgtagtcacgccgaaggtccg

SEQ ID NO: 83708 - DNA, 492 bp, Homo sapiens
  misc_feature: GYAE6OF01AIYCU.36.23.C01.1.454.CMB.1.raw
  modified_base (227)..(227): a, c, t, g, unknown or other
  misc_feature (227)..(227): n is a, c, g, or t
  modified_base (269)..(269): a, c, t, g, unknown or other
  misc_feature (269)..(269): n is a, c, g, or t
  modified_base (281)..(281): a, c, t, g, unknown or other
  misc_feature (281)..(281): n is a, c, g, or t
  modified_base (377)..(377): a, c, t, g, unknown or other
  misc_feature (377)..(377): n is a, c, g, or t
  modified_base (415)..(415): a, c, t, g, unknown or other
  misc_feature (415)..(415): n is a, c, g, or t
  modified_base (422)..(422): a, c, t, g, unknown or other
  misc_feature (422)..(422): n is a, c, g, or t
  modified_base (478)..(478): a, c, t, g, unknown or other
  misc_feature (478)..(478): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctctgcactggaaccngcagtgacgttggtgcttataattatgtctctggttccaacngcattcaggtcngcgccccgaaactcttaaattatgtacggtctttcgtcgtccctcgagggtttctagtcgcttcgccggctccagtctggcacacgcctcctgacntctctagactccagctgaggcgaggctgactatatgcngctgatntactgaatcaatgactcagtgctgtcggaggaggacctagtcgaccgtcgtacgtncgcccgaggtcccg

SEQ ID NO: 83709 - DNA, 669 bp, Homo sapiens
  misc_feature: GYAE6OF01DEAOM.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgtacgttgtgcttataattatgtctcctggttaccaacagcattcaggcagccgacccgaaacttcttaatttatgtagttctttcgtccggtccctcgtagggtttctagtcgtcctttcgtcccggtcctaccgtaacgtcgtacggacctaaacgcccggtcccttcccctacgtaccctacttccttaccgtaaccgtaccctacccggaggtccgtagggaacgggaccggtacgggtaccttacggttaacctttaagtttacgtttcggaccgtacgtaccttactaacttaacgttaaccgtaggtaacgttaactaaggttcgtaacctaccgtacgtcggtcgttcggggttcggacgggtacgggtaaccgttaaggttccgaacccgttccgtaacggtcaaccggtacccgtaacggtccccg

SEQ ID NO: 83710 - DNA, 672 bp, Homo sapiens
  misc_feature: GYAE6OF01DCUKV.36.23.C01.1.454.CMB.1.raw
  modified_base (234)..(234): a, c, t, g, unknown or other
  misc_feature (234)..(234): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacgagggtcctgggcccagtctggccctgacacagcctgcctccgtgtctgagactcctggacagtcgatccaccatcctcctgccacgtgaaccngcagtgacgttgtgcttaatattatcgtcttctggttaccaactagctattcgaggcacggacccgtaccccgtaaacttctttaatttagtcggtaggtttcctttccggtccggtaccccgttacggttacggggttttctacggttccgtctttcccgtcccggtccttacccgtaacgttccgttacgggaccctaaaccgtaccccggttccccttacccctcggtaaccctaacttccctacgttaaccgtcccgttaccgtaacggtcgtaggaacgggtaccgacgggtcttacgtaacttagtttatcgactagtctactaattactacgttgaaattctaagttcggtaactcctagtcgtcgttaggtccgggagggaacggtacctaaggttccgaccgttcgtaggtaccacgccgtacgtcccg

SEQ ID NO: 83711 - DNA, 771 bp, Homo sapiens
  misc_feature: GYAE6OF01CO0KJ.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctgttccaacagctattcaggcacgccgaccccgtaaacttctttaaatttatgtacggtttcctttcggtccggtccccttacggtacggggttttcctacggttccgtccgttttcccgtccccggtcctttaccccgtaaacggttccgttacggggaccctaaaacccggtaccccggggtccccctttcccccgttacggtaacccctaacgtttcccttaccgttaaccggaccccttccccgaacggggttcccgttaaggggaaccggggtaaccgggaacggggtacctttacggtaaaccgtttagttttaacgttcggacctaacggtacctttacgtaaattaacgttaaccgttaaggtaaacgttactaaaggttcgggttaacttcccgtagttcgggtccgtttcggggttaccggggacggggtaacgggtaacccgttaagggttccggtacccggttaccgtacggtaccgacccgacccgtagggtcccccg

SEQ ID NO: 83712 - DNA, 891 bp, Homo sapiens
  misc_feature: GYAE6OF01CW1UJ.36.23.C01.1.454.CMB.1.raw
  modified_base (229)..(229): a, c, t, g, unknown or other
  misc_feature (229)..(229): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctcctgccactggaaccngcagtgacgttggtgtcttaataattatcgttcttccttcggttccaacagacattcgaggcacggcccgaccccgtaaacttctttaaatttagtggtacggttcttttccggtccggtccccttacggtacgggtttctacggttccgtcctttccgtcccggtcttaccgtaacgtcgtacggacctaaccgtaccccggtcccttacccgtacgtaaccctacgttccctaccgttaaccgtacccgtacccggtaacggtaccgttagggaaacgggtaccgggtacgggtaccttacgggttaaacctttaacgttttaacgtttcggaacccgtacgtacccgtttaactaaacgttttaaccttaaccggttaacggtaaaacgtttaaccgttaaacggtttaccggggtttaaaccctttacccccgttaaaccggggtttcgggttaccccgggttttacggggggttttaacccccggggggtaacggggggttaaaccccgggggttaaaaccccggtttaaaaacgggggttttttcccccgggaaaacccccgggtttttcccccgggtttaaaaaccgggggttccccgggtaaaaccccgggttaaccccccccggggttaaaacgggggtttcccccccccggg

SEQ ID NO: 83713 - DNA, 545 bp, Homo sapiens
  misc_feature: GYAE6OF01A4PWV.36.23.C01.1.454.CMB.1.raw
  modified_base (242)..(242): a, c, t, g, unknown or other
  misc_feature (242)..(242): n is a, c, g, or t
  modified_base (268)..(268): a, c, t, g, unknown or other
  misc_feature (268)..(268): n is a, c, g, or t
  modified_base (283)..(283): a, c, t, g, unknown or other
  misc_feature (283)..(283): n is a, c, g, or t
  modified_base (407)..(407): a, c, t, g, unknown or other
  misc_feature (407)..(407): n is a, c, g, or t
tcagtacgctgtctcacgaccggtgctcgattagtacacgtgattagggattggggggggtctcaggaggcaccgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtncttataattatgtctctggttccaangcattcaggcagccncccgaaatcttaattatgagttctttcgcggtcctgtagggtttctagtcgtcttcctccggctcaagtctggacaacgccggcctcctgacctatcctctagcctcaggcctaggacggacgngctgtacttattattgcagctacaatactacgtagtaagttcaagttcggtactccgtactggtcttgggttaccggcgggaacggaccgtaggttcgaacccgttcgtaggtaccaggcccaaggtccgtaccccgg

SEQ ID NO: 83714 - DNA, 636 bp, Homo sapiens
  misc_feature: GYAE6OF01A5B9L.36.23.C01.1.454.CMB.1.raw
  modified_base (243)..(243): a, c, t, g, unknown or other
  misc_feature (243)..(243): n is a, c, g, or t
  modified_base (271)..(271): a, c, t, g, unknown or other
  misc_feature (271)..(271): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgccctccgtgtctgagactcctggacagtcgatcaccatctcctgcactggaaccagcagtgacgttggntcttataattatgtctcctggttccaangcattcaggcacgccgacccgtaaacttactttaattagtgtaggttctttccggtccggtcccttggtacggggtttcctaggttccgtctttccgtccggtctaccgaagttctcgggaccaaaccgaccggtcccttcccgtacgtaccctacttcctacgtacgtaccgtaccgtacggcgtacggaacgggaccggaggtctacggtaacttaagtttacttagccgtagtctactaattaacttacgtagtaagttacgaagttcggtactaccgtactcggtcgttcggttcgggacgggacggtaccgtacggttacgtacccggttacgtacggtaccacggtcccgaaggtcccg

SEQ ID NO: 83715 - DNA, 685 bp, Homo sapiens
  misc_feature: GYAE6OF01BCZ8K.36.23.C01.1.454.CMB.1.raw
  modified_base (243)..(243): a, c, t, g, unknown or other
  misc_feature (243)..(243): n is a, c, g, or t
  modified_base (268)..(268): a, c, t, g, unknown or other
  misc_feature (268)..(268): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgccctcgtgtctgagactcctggacagtcgatcaccatctcctgcactggaaccagcagtgacgttggtncttataattatgtctcctgtccaanagcattcaggcacgccgaccccgaaattctttaaatttagtggtacggtttctttccggtccggtcccttcgtacggggtttctacgtcgtcttcgtccggctccaagttcgtacggacctaaaccaccggtccctcccgtacgaaccctattcctcgtaacgtaccctaccgaggcctagggacggacggtacggacttacggtaactttaagtttacgttgaccgtacgtacttactaattacttaacgtagtaaacgttactaagttacggtaacttcccgtacgttacgggtaccgtttcgggtaccgggtaccggggtaacgggtaaccccgtaaagggtttacccgtaaccccgggtttaccgtaacgggttacccaacccgggttaacccccgaaacggggttccccccg

SEQ ID NO: 83716 - DNA, 717 bp, Homo sapiens
  misc_feature: GYAE6OF01CJCL6.36.23.C01.1.454.CMB.1.raw
  modified_base (477)..(477): a, c, t, g, unknown or other
  misc_feature (477)..(477): n is a, c, g, or t
tcagtacgctgtctcacgaccggtgctcgatttagtacacgtgattagggattggggggaagaggaagactgacggtcctgtctcaggtgcagctgcagcagtcggggcccaggagtggtgaagccttcggagaccctgtccctcacctgcgctgtgtctggacgcctccctcggcgagatgaatgggtggagttgggccgccagcccccgaggggaaggggctggagttggattggtagaaataagtgaacggaccgggggcaccaactacaagtgccgtccctcgacggggtcgagtccaccatatctgcagtacaagtaccaaacgaacctactcctcccgtagagctcgacctcgtcggtcgacccgccgcggacgtccggaccattatactttattgtgtcgtagttgttttagacgtaggtattcggttggggtcggtacgtccggtacggttcggtgggtacgaagggtntacggtacgtcgtacgttccgtaccttccctacgaccgtcccgtacccgaacccgaaccgggtcccctaacggttcccggttccccgtttccccccgtcgggtccccgtacccccgttcggtaccctaccccggtacggaccgtcccgaaccccggttacccggaacggaccgacccggaaccgtacccggggtaccccgggtcccggttaccggggtcccgttccgggtaacccccggg

SEQ ID NO: 83717 - DNA, 652 bp, Homo sapiens
  misc_feature: GYAE6OF01DB81N.36.23.C01.1.454.CMB.1.raw
  modified_base (228)..(228): a, c, t, g, unknown or other
  misc_feature (228)..(228): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgacgctcctggacagtcgatcaccatctcctgcactggaaccngcagtgacgttggtgcttataattatgtctctgttcacagcattcaggcagccgcccgaaacttcttaatttatgtaggttctttccgtcggcctcgtagggtttctagtccgtctttcctccggtctaccaagtctcggactaacgacggtcctccctcgaccacgttcctctaacgaccttccgaggtctaggaacggaccgagggtctaggaccttagtttacgtttcgactacgtcttacctaattaacgttacgtaggtaaacgttaccgtaaagttcgggttaactacccgtaacgttgggtccttacgggtttccgggaacggggtacggggtaaccccgtaaagggtttcccggtaaaccccggttaccggtttaacgggtaccgtaaacccgggtccccgtaaaggggtcccccg

SEQ ID NO: 83718 - DNA, 611 bp, Homo sapiens
  misc_feature: GYAE6OF01DK1D5.36.23.C01.1.454.CMB.1.raw
  modified_base (398)..(398): a, c, t, g, unknown or other
  misc_feature (398)..(398): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgtcttaataattatgtctcctgttcaactagctattcgaggcagccgacccgaaactactttaatttagtgtagttctttcgtcgtccctgtacgggtttctagtcgtcttccgtccggctccgaagtcgtcggcaacgacggtcctccctgaccntctctacgacctacgagtctaggacggacgagctagtactattattcgctagtctactattaactacgtagtaacgttactaagttcggtaacttaccgtacgttcgggtacgttcgggttaccgggtacgggacggggtaaacccgtaacgggtttaccgacccggtttaccgttaacggtccgtaaccggcccggtaaacgggtcccccgg

SEQ ID NO: 83719 - DNA, 671 bp, Homo sapiens
  misc_feature: GYAE6OF01CCXPU.36.23.C01.1.454.CMB.1.raw
  modified_base (246)..(246): a, c, t, g, unknown or other
  misc_feature (246)..(246): n is a, c, g, or t
  modified_base (275)..(275): a, c, t, g, unknown or other
  misc_feature (275)..(275): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctctcactcagggcacgagggtcctgggcccagtctggcctgacacagcctgcctcgtgtctgacgactccgtggacaggtcatccaccatcctcctgcacgtggaaccagcagtgacgttgtncttataattatgtcttcctgttaccaacngcattcagcagccgacccgtaatcttaatttatgtaggttcttcgtcgcctgtacgggttctacgtcgtcttcgccggtctccgtaagtctggaccaacgccggtcctcccgtacgaacctatccttacgtacgacctccgaggtcctaggaacggtaccgaggtaccgttagtaacctttattacgtttcggaccttaacggtccttaactaactttaacgttaacccgtaggttaaaacgttccgtaaaacgtttcgggttaacctacccgtaacggttccgggtaacgtttccggggttacgggacccggggtaaacggggtaacccttaagggtttacccggaacccgtttcgtaacgggttccccaaacggtccccgaaacgggttccccg

SEQ ID NO: 83720 - DNA, 542 bp, Homo sapiens
  misc_feature: GYAE6OF01EMME3.36.23.C01.1.454.CMB.1.raw
  modified_base (365)..(365): a, c, t, g, unknown or other
  misc_feature (365)..(365): n is a, c, g, or t
  modified_base (427)..(427): a, c, t, g, unknown or other
  misc_feature (427)..(427): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctcctgcactggaaccagcagtgacgttggtgcttatattatgtctcctgttccacagcattcaggcacgccgcccgaaactcttaattatgtagtctttcgtcggtcctcgtacgggttctagtcgtcttctccggctccaagtctgacacncggcctcctgacctatctctacgacctcagcgtgaggacgagctagtacttattattcgacngtctactaatagtactagtaacgtacaagttacgtactcctacgtcggtactcggttcgggacggacgggtaccaaggttcgaccgttccgtaggtaccacgtccgaaggtcccg

SEQ ID NO: 83721 - DNA, 592 bp, Homo sapiens
  misc_feature: GYAE6OF01E0Z8O.36.23.C01.1.454.CMB.1.raw
  modified_base (333)..(333): a, c, t, g, unknown or other
  misc_feature (333)..(333): n is a, c, g, or t
tcagtacgctgtctcacgaccggtgctcgatttagtacacgtgattagggattggggggaagaggaagactgacggtcctgtctcaggtgcagctgcagcagtcgggcccaggagtggtgaagccttcggagaccctgtccctcacctgcgctgtgtctggagcctccctcggcggagatgaatggtggagttgggtccgccagcccccaggggaaggggctgagttggattggtgaaataaatgagaccgggggcaccaactacaatgcgtccctcaggggtcgagtcaccatatctgcagacaagtccaagaaccacttctccctgagctnacctctgtgaccgccgcggactcggccatatattattgtgcgtagtagtttttgcaggtattcgttggggcggttatcgacgttcgtggggtcgaagggatcacgggtcatcgtctcctcacgcctccaccgaacgggccccaagttcccggttccctttccccccgtcggcccgtcccctcggtccctcccgagggacgcccacccgtccggacgacgccaaccgacggcccggtcccgtcggggtcctcggtcccgg

SEQ ID NO: 83722 - DNA, 582 bp, Homo sapiens
  misc_feature: GYAE6OF01BM187.36.23.C01.1.454.CMB.1.raw
  modified_base (227)..(227): a, c, t, g, unknown or other
  misc_feature (227)..(227): n is a, c, g, or t
  modified_base (357)..(357): a, c, t, g, unknown or other
  misc_feature (357)..(357): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctcgtgtctgagactcctggacagtcgatcaccatctcctgcactggaaccngcagtgacgttggtgcttataattatgtctctgttccaacagcattcaggcagcgcccgaaactcttaattatgtagttcttcgtcgcctgtagggttctagtcgtcttctccgctccaagtctgcaacncgtcctcctgaccatctctagactccgaggctgacggacgaggctagtacttagttattcgcgacgtctcaattataccgtgtaagttccaaagttcgggtaactcccgtacgtggtccgttcgggttcggggacggggtaaccggggaacccgtaaaggttcccggtaaacccggttcccgttaacgggttaccgaaccggtcccccgaaagggggttcccccg

SEQ ID NO: 83723 - DNA, 747 bp, Homo sapiens
  misc_feature: GYAE6OF01DN6B3.36.23.C01.1.454.CMB.1.raw
  modified_base (230)..(230): a, c, t, g, unknown or other
  misc_feature (230)..(230): n is a, c, g, or t
  modified_base (275)..(275): a, c, t, g, unknown or other
  misc_feature (275)..(275): n is a, c, g, or t
  modified_base (313)..(313): a, c, t, g, unknown or other
  misc_feature (313)..(313): n is a, c, g, or t
tcagtacgctgtctcacgaccggtgctcgattagtacacgtgattagggagttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctcctgcacgtggaaccngcagtgtacgttgtgactttaataattatgtctcctggttccaangctatcgaggcaggccgaccccgaaattcttaatttangtagtttctttcggtcgtcccgtgtacgggtttctagtcgtctttcgccggtcttaccgagtccgtaggacccaacgaccggtcccttccctcgaccctattcctactacgtacctccgaggtcgtaggaacgggaccgagggtcttaggtaactttaagtttacgttcggacctaaggtcctttacgtaaagtttaaccttaacgttacggtaaacgtttacctaaaggttttaccgggtaacctttaccccgtaagggttccgggttaccggttttacgggggttacccggggtaacccggggggtaaaaccgggttaaacccggtttaaaccggggtttacccgggttaaccccccgggtttaccggtttaaaacccgggttaccggaaaccccggggtaccccccggttaaacgggggttcccccccggg

SEQ ID NO: 83724 - DNA, 654 bp, Homo sapiens
  misc_feature: GYAE6OF01BLI0Q.36.23.C01.1.454.CMB.1.raw
  modified_base (227)..(227): a, c, t, g, unknown or other
  misc_feature (227)..(227): n is a, c, g, or t
  modified_base (269)..(269): a, c, t, g, unknown or other
  misc_feature (269)..(269): n is a, c, g, or t
  modified_base (306)..(306): a, c, t, g, unknown or other
  misc_feature (306)..(306): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacgagggtcctgggcccagtctggcctgacacagcctgcctccgtgtctgagctcctggccagtcgatcaccatctctgcactggaaccngcagtgacgttgtgcttataattatgtctcctggttccaacngctattcaggcagccgaccccgaaattcgttaatttntgtacgttctttcgtcgccttgtacgggttctagtcgtcttcgtccggtctccgaagtctggaccaacgaccggtcctcccgtagaccctagttcctactaagtaccctaccgacggtccgtaggaacggtacgacgggtccttacgaaccgtttaatttacgttacgctaacggtcttaccgtaattacgtaacgttacgtaaacgttcgtaaagttcggtaactaccgtacgttggtaccgttcggttaccggggagggtaaccggggtaacccttaacgggttccggaaccccggtttaccgtaaaggttacccggaaccggtaccccgtaacgggttacccccg

SEQ ID NO: 83725 - DNA, 801 bp, Homo sapiens
  misc_feature: GYAE6OF01C754M.36.23.C01.1.454.CMB.1.raw
tcagtacgctgtctcacgaccggtgctcgatttagtacacgtgattagggattggggggaagaggaagactgacggtcctgtctcaggtgcagctgcagcagtcgggcccaggagtggtgaagccttcggagacctcgtccctcacctgcgctgtgtctggacgccctccctcgggcggagatgaagtgggtggaggttcgggtccgccacggcccccgaggggaaggggctggagttggattggtagaaaataaagtggacgggaccgggggacaaccgaaactacaagtcgaccgtcccgtacggaggggtcacggtacaccatactcgtgcaagaacaacgtaccaacgaacctaccttcctcccgtgacgctcgacctcgtcgtcgccgccgcggacctccggacctattattactttagttggtcgtagtaagtttgttttcggacgtaggtacgttccggggttgggggtaccgttaggtccggtagggttcgggttagggggtaccgaaagggggtccttacggtaccgggtcgtacgttcccggttccttacccgtcgaaccggtccccaacccgtaacccgggtaaacccggggccccttaacccgggtttccccggttcccccgttccccgggttacccgggccccgttcccccggttacggtcccccgtaacccgggaagggaccccgtaccccgttaaccccggtaacccggggacccgtaaccggacccacccgggtaccccggggtccccgggcccggttcggggtcccgtcccgggtaacccgggg

SEQ ID NO: 83726 - DNA, 570 bp, Homo sapiens
  misc_feature: GYAE6OF01D6ZRR.36.23.C01.1.454.CMB.1.raw
  modified_base (228)..(228): a, c, t, g, unknown or other
  misc_feature (228)..(228): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggcagccgaccccgaaacttcttaatttatgagttctttcgtcggtccctctagggtttctagtcgtcttctccggctccgaagtctggcacacgccctccctagcatctctagacctcaggctgagacgaggcttgacttagttatcgcagctcatactactagtaagtactaagttcggtaactcctacgttggacctttgggttccgggtcgggaacggggtaccctaaaggtttccggtaaccccggttcccgttaagggtccctaacggccccggtaacggtccccg

SEQ ID NO: 83727 - DNA, 727 bp, Homo sapiens
  misc_feature: GYAE6OF01CTQ2U.36.23.C01.1.454.CMB.1.raw
  modified_base (228)..(228): a, c, t, g, unknown or other
  misc_feature (228)..(228): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagactctggacagtcgatcaccatctcctgcactggaaccngcagtgacgttggtgcttataattatgtctcctggttccaacagcattcaggcagccgacccgaaactcttaaatttatgtaggttctttcgtccggccctcgtagggtttctacgtcgtctttccgtccggtcctacctaaacggtccgttacgggaccgaaaccgtaaccgggtccccttacccccgtacggtaccctaacttccttacgtaacgtaccttaccccgtaaggtccgtaggaacgggtaaccggagggtccgttagggtaaccttaagttttaacgttcgacgtaacggtcctaaccgtaattaacttaaccgtagttaaacggtacgttaaagttcgggttaactccccgtacgtacgggtacgttccggggtttccgggtaccggggtaacggggtaacccggttaaacgggttttccggaaccccggttacccgttaacgggttacccgaaccggtaacccccggtaaagggttacccccccggg

SEQ ID NO: 83728 - DNA, 773 bp, Homo sapiens
  misc_feature: GYAE6OF01DPNUN.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacgagggtcctgggcccagtctggcctgacacagcctgcctccgtgtctgacgtactcctggacagtccgactccaacctattcctcctgacctacgtacggaaccagcgagtcgtacggtttggtcgtactttaataatttagtcgttccttccgttacggttaccaacgtagacctacgttacgaggtaccgacgaccccggtaaccccgtaaaacttttaccttttaaagttttacgtacggttaaccggttttccctttacccggtacccggtaccccgtttacgggtttaacggggttttacctaccggtttccggttcctttcccgtacccggtacctacccgtaagttccgtacgggacctaaacccgtacccggtcccttacccgtacgacccttacttacctacgtaccgtacccgttcgaacggtcgtacggaacggtacggtacggtactagttaacttaggtttactcgacgtacgtaccttagtaacttactaacgttacgaaagttacgtaaggttcggtaacctccggtacgtcggttcggttacggtaccggggacggtacggttaaccgttaggtacccgtacccgttacgttacggacgcccgtagaccggtccccgg

SEQ ID NO: 83729 - DNA, 567 bp, Homo sapiens
  misc_feature: GYAE6OF01DMN4M.36.23.C01.1.454.CMB.1.raw
  modified_base (270)..(270): a, c, t, g, unknown or other
  misc_feature (270)..(270): n is a, c, g, or t
  modified_base (305)..(305): a, c, t, g, unknown or other
  misc_feature (305)..(305): n is a, c, g, or t
  modified_base (375)..(375): a, c, t, g, unknown or other
  misc_feature (375)..(375): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacngcattcaggcaggccgacccgaaatcttaatttangtagttctttcgtcgcctcgagggtttctagtcgctttcgccggctcgagtctggcaacacggcctcccngaccactctactacgactccgaggctagacggacgacggtctagtacttattacttgctagctcaatatacgtagaacgttcaagttcggtactccgtacgtcggtacgttcggttacgggcgggtaacgggtaccgtaaggttccggtaacccgttccgttacggtaccgaccggtcccgtaacggtcccg

SEQ ID NO: 83730 - DNA, 586 bp, Homo sapiens
  misc_feature: GYAE6OF01BADOX.36.23.C01.1.454.CMB.1.raw
  modified_base (211)..(211): a, c, t, g, unknown or other
  misc_feature (211)..(211): n is a, c, g, or t
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
  modified_base (262)..(262): a, c, t, g, unknown or other
  misc_feature (262)..(262): n is a, c, g, or t
  modified_base (272)..(272): a, c, t, g, unknown or other
  misc_feature (272)..(272): n is a, c, g, or t
  modified_base (292)..(292): a, c, t, g, unknown or other
  misc_feature (292)..(292): n is a, c, g, or t
  modified_base (452)..(452): a, c, t, g, unknown or other
  misc_feature (452)..(452): n is a, c, g, or t
tcagtacgctgtctcacgaccggtgctcgatttagtacacgtgattagggagttggggggggtctcaggaggcagcgctctcaggacatctccaccatggcctgggctctgctgctcctcaccctcctcactcagggcacgagggtcctgggcccagtctggcctgacacagcctgcctccgtgtctgagactcctggacagtcgatcacntctctgcactggaacngcagtgacgttgtncttatatatgtctctgtcacngctatcagcngccgacccgaatcttaattntgtagtcttcgtcgcctcgtaggtttcagtctcttcgcgtctcaagtctcgctaacgcgtcctcgtgacctactctactacgactccgaggtctcggaacggactacggctaggtacttagttctcgacagtctactaacttactacgtagtaacggttntaacgttcggtaacttccgtaacgttcggtaccgtttgggtaccgggtacgggaacggtaacccgtaacgggtttaccgaaccccgtttcggttaacggtcccgtaaccggtaccccggtaaaggttcccccgg

SEQ ID NO: 83731 - DNA, 576 bp, Homo sapiens
  misc_feature: GYAE6OF01B28LL.36.23.C01.1.454.CMB.1.raw
  modified_base (388)..(388): a, c, t, g, unknown or other
  misc_feature (388)..(388): n is a, c, g, or t
  modified_base (448)..(448): a, c, t, g, unknown or other
  misc_feature (448)..(448): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctcctgcactggaaccagcagtgacgttggtgcttataattatgtctcctggttccaacagcattcaggcagccgccccgaaactcttaatttatgtagttctttcgtcgccctcgtagggtttctagtcgcttcgtccggctccaagtctggacacgacggccctccctgacccntctctacgactccgaggcctggaggacggacgggctcgaacttagtttattgctagctanattataccgttagaagttacaagttggtaacttccgacgttaggccgtttagggttccgggacgggtacgggtaaccgtaaggttcggaaccccgttcgtaggtaccacggtaccccgaggtccccgg

SEQ ID NO: 83732 - DNA, 622 bp, Homo sapiens
  misc_feature: GYAE6OF01BEZ4O.36.23.C01.1.454.CMB.1.raw
  modified_base (225)..(225): a, c, t, g, unknown or other
  misc_feature (225)..(225): n is a, c, g, or t
  modified_base (294)..(294): a, c, t, g, unknown or other
  misc_feature (294)..(294): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctcgtgtctgagactctggacagtcgatcaccatctctgcactggaaccngcagtgacgttggtgttataattgtctctgtacactgcaccggcatcgaccccaaaatcatgtatttangagtcactcactcggcctgtacgggttctaactcgtcttctctgctactcaagtctgcaaccgaccggtccctaccgtgaccctactcctcgtacgggtcctaccgacgccgtaggacggacggacggtctagtaagtttacttacgttcgtttaccctactaacctagttaccgaacggttccggtaagtttacgttcggttaccgttttccggggaccgggtacccggtacccgtaaccgtccggtacccgttaccggttacggtacccgtaacggtaccccgtaaacgggtccttacccggtacccccgttcggttcctacccgg

SEQ ID NO: 83733 - DNA, 512 bp, Homo sapiens
  misc_feature: GYAE6OF01CGKPJ.36.23.C01.1.454.CMB.1.raw
  modified_base (270)..(270): a, c, t, g, unknown or other
  misc_feature (270)..(270): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcatcaccatctcctgcactggaaccagcagtgacgttggtgcttataattatgtctcctggttccaacngcattcaggcagcgccccgaaactcttaatttatgagttctttcgtcggcctcgtagggtttctagtcgcttctccgctcaagtctgcacacggcctcctgaccatctctagactccgaggctggaggacgagctgacttattatgcagctcatatactgaatcaatggtatccgatcggctggttcgggacggacgggacctaggttcgaccgttacgtaggtccacgcccgaaggtcccg

SEQ ID NO: 83734 - DNA, 621 bp, Homo sapiens
  misc_feature: GYAE6OF01CE58R.36.23.C01.1.454.CMB.1.raw
  modified_base (229)..(229): a, c, t, g, unknown or other
  misc_feature (229)..(229): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggcagccgacccccgtaaattctttaaatttatggtacggttccttttcggtccggtccccttcggtaggggtttcctacggtccgtcctttccgtcccggccttccgtaaggttccgtcggaccaaaccgaccggtccctacccgtacgaccctaacttcctactacgacctccgaaggtctaggacggacggaggtctagtaccttagtttatcgcacgtctctaatatactgaagttcaagttcggtaatcccgagtcggtacgttcgggttcgggacggaacgggtacctaaggttccgaccgttccgtaggtccgaaccggtcccgaagggtccccg

SEQ ID NO: 83735 - DNA, 569 bp, Homo sapiens
  misc_feature: GYAE6OF01DHH7Z.36.23.C01.1.454.CMB.1.raw
  modified_base (266)..(266): a, c, t, g, unknown or other
  misc_feature (266)..(266): n is a, c, g, or t
  modified_base (558)..(558): a, c, t, g, unknown or other
  misc_feature (558)..(558): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcacatctcctgcactggaaccagcagtgacgttggtgcttatattatgtctctgtccaangcatcagcagcgacccgaaatcttaattatgtagttcttcgtcgcctcgtagggtttctacgtcgtcttccgtccggtctaccgtaagtcgtaggaccaaccgaccggtcccttcccagtacctacttcctactacgacctcgaggtctaggacggacgacggctagtactagtttactgacacgtctactaattaactacgtagtaacgttctaagtcgtactacccgtagtcggtacgttcggttacgggacgggaggtaacctaggttcgaaccgttcgtaagccgacnccgacggtccg

SEQ ID NO: 83736 - DNA, 604 bp, Homo sapiens
  misc_feature: GYAE6OF01DYNHD.36.23.C01.1.454.CMB.1.raw
  modified_base (231)..(231): a, c, t, g, unknown or other
  misc_feature (231)..(231): n is a, c, g, or t
  modified_base (244)..(244): a, c, t, g, unknown or other
  misc_feature (244)..(244): n is a, c, g, or t
  modified_base (266)..(266): a, c, t, g, unknown or other
  misc_feature (266)..(266): n is a, c, g, or t
  modified_base (380)..(380): a, c, t, g, unknown or other
  misc_feature (380)..(380): n is a, c, g, or t
  modified_base (416)..(416): a, c, t, g, unknown or other
  misc_feature (416)..(416): n is a, c, g, or t
  modified_base (439)..(439): a, c, t, g, unknown or other
  misc_feature (439)..(439): n is a, c, g, or t
tcagtacgctgtctcacgaccggtgctcgatttagtacacgtgattagggagttgggggggttctcaggaggcaccgctctcaggactatctccaccatggcctggctctgctgctcctcaccctctcactcgagggcactgggttcctgggcccagttctggctgacacagcctgcctcgtgtctgagctcgtggacagtcgatccacgagtcctctgcactcggaaccngcagtgacgttgngtcttatatatgtctctgtcangcatcagacacgcgacccgaatcttaagtgtggtagttctttcgtcgtcctgtgggttctacgtcgtcgttctccggctacgaattcgtcggacaaccgcggtccctacccgtnacctagtctactacgacctcgagtctagaacgacgnggtctagtaacttagttactcgnaacgtctacgtaattacgtacgtaggtaacgtacgtaaacgttcgtactaccgtacggtcgggtaccggtgggttaccgggacgggtacgggtaacccttacggttaaccggttccctacgggttaccggtaccgacggaccccggtaacggtcccgtaccccgg

SEQ ID NO: 83737 - DNA, 744 bp, Homo sapiens
  misc_feature: GYAE6OF01AW1VX.36.23.C01.1.454.CMB.1.raw
  modified_base (190)..(190): a, c, t, g, unknown or other
  misc_feature (190)..(190): n is a, c, g, or t
tcagtacgctgtctcacgaccggtgctcgatttagtacacgtgattagggagttggggggggtctcaggaggcaccgctctcaggacatctccaccatggcctgggctctgctgctcctcaccctcctcactcagggcacgagggtcctgggcccagtctggcctgacacagcctgcctccgtgtctganactcctggacagtcgatcaccatctcctgcacgtacggaaccagcagtcggtacgttggtactacttaataatttactcgttccttccgttcggttaccaacgtagtcctagttcgaggactacggacccgtaccccgtaaactttacgtttaagtttacgacggttacggtttcccgttttccggtcccggtcccgttggtttacgggtttacctacggttccgttccgtttcccgtccgggtaccttacgtaacggttcgtaccggcctaaaccgtacccggtccccttcctacggtaacccttacgttaccttaccgtaacggtaccgttacccgacgggtaccgttaggaacgggtacggtacggtaccttacgttaacttaatttacggtaccggactacgtaccttactaagttacgttacgtacggtaacgtacgtagttacggtacctaccggtagtcggttacgttgggtaccggaggtaacggtacgtacgttccgtaaccggttccgtaacgggccaccggtacccgtggttcccgtccccgg

SEQ ID NO: 83738 - DNA, 583 bp, Homo sapiens
  misc_feature: GYAE6OF01AD4CT.36.23.C01.1.454.CMB.1.raw
  modified_base (454)..(454): a, c, t, g, unknown or other
  misc_feature (454)..(454): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactccgtggacagtcgatccaccatcctcctgcactggaaccagcagtgacgttggtgcttataattatgtctcctggttccaacagcattcaggcagccgaccccgaaacttctttaatttatgtaggttctttcggtccgccctcgtagggtttctagtcgtcttctccggctccaagtctggccaacgccggccctccctgaccacttctctagacctccgagtcgtaggaggacgaggtcctgacttatttatcgctagctnaattatactagaactcaagttgtactccacgttcggcttcgggtttccgggcgggaacggggtacccgttaaggtttcggaaccccggttaccggttaaggtccgaccggtacccggaagggtcccccg

SEQ ID NO: 83739 - DNA, 532 bp, Homo sapiens
  misc_feature: GYAE6OF01AKPQZ.36.23.C01.1.454.CMB.1.raw
  modified_base (228)..(228): a, c, t, g, unknown or other
  misc_feature (228)..(228): n is a, c, g, or t
  modified_base (370)..(370): a, c, t, g, unknown or other
  misc_feature (370)..(370): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggcagccgccccgaaactcttaatttatgtaggttctttcgtcggccctcgtaggggtttctagtcgctttctccggctcagtctggcaacncggcctccctgaccatctctacgactccgaggctgaacggacgaggctgacttattatgcagctcatatactgaatctaatggtactcctactggcgttggttcggacgggtacgggaccgtaaggttcgacccgtccgtaggtccacggcccgaggtcccg

SEQ ID NO: 83740 - DNA, 651 bp, Homo sapiens
  misc_feature: GYAE6OF01EEUDN.36.23.C01.1.454.CMB.1.raw
  modified_base (230)..(230): a, c, t, g, unknown or other
  misc_feature (230)..(230): n is a, c, g, or t
  modified_base (274)..(274): a, c, t, g, unknown or other
  misc_feature (274)..(274): n is a, c, g, or t
  modified_base (508)..(508): a, c, t, g, unknown or other
  misc_feature (508)..(508): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctctgcacgtcggaaccngctagtgacgttggtgcttataattatgtcttcctgttccaacngcattcaggcagccgaccccgtaaacttcttaatttagtgtacgttcgtttcgtcgtcccttcgtagggtttctacgtcgtcttccgtccggctacctaagttcgtcggactaacgaccggtcccttcccgtacgtaacctacttaccttacgttaacgtccttacccgacggtcgtacgggaaacgggtaccggacgggtacttcggtaaacctttaagtttacgtttgaccncgttctaccgtaattacgttaacttagaacgttactaagttcggtaacctccgtacgttgggtccgttggttcgggaccgggtagggaaacccttaggttaccgacccggttctaacgggtccaaccgcccggtagtccccgg

SEQ ID NO: 83741 - DNA, 884 bp, Homo sapiens
  misc_feature: GYAE6OF01DG7A6.36.23.C01.1.454.CMB.1.raw
  modified_base (571)..(571): a, c, t, g, unknown or other
  misc_feature (571)..(571): n is a, c, g, or t
tcagtacgctgtctcacgaccggtgctcgatttagtacacgtgattaggggattgggggggggtctcagggaggcagcgctctcaggacatcctccaccagtcggcctgggctctcgctcgctcctccacctcctcactcgagggcaacgggtcggtcgtcggacctgtcggcgtccgtacgacacgcgtccgtcgtccgttcgtcgtacgtacgacgtcctcggtacgacgacgtactactacctaactctcctacgtcgacctacggtaccggaacgtacgtacggttaggtacgttacgggttacgtactttaatttaaacgtttcgtttcggtaacctttccgttaacggggttaccaaaactacgggtctaacttacggggtaccggaccggtaacgtacccggttaaaaccgtttaccgttaaatttttacggttaagtcgggttacgtcccgttttccggtacgggtacccgttccgtaaggggtttccgactttaccggtccttccgtaaaccggggttccgtaaccgttaacgggaccttaccgggacccgtttaaaacccnccgggtttcccgtaaccctttacgggaacccttaacgttccttacggttaccgtacggtaccgtacgggtaccgtacgggacggtacgtaacggtacccgttagtacgttacgtttacgtacgtactaacgtacgttacgtaaacttaacggttaaccgtagttaacggttaccttaacggtcgttaccgttccgtacggttcgggtcgtaacggggtcggaaccggggttaacgggtaaccggttacggtaaccgggtacccgttaccggtaacggtacgtaacccggtcccggtaacggtccggttcccgg

SEQ ID NO: 83742 - DNA, 663 bp, Homo sapiens
  misc_feature: GYAE6OF01A7FIO.36.23.C01.1.454.CMB.1.raw
  modified_base (240)..(240): a, c, t, g, unknown or other
  misc_feature (240)..(240): n is a, c, g, or t
tcagtacgctgtctcacgaccggtgctcgattagtacacgtgattagggattggggggggtctcaggaggcaccgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttgngcttataattatgtctctgtcaacagcattcagcagccgaccccgaaacttcttaatttagtgtaggttctttcgtccggtcccttagtagggtttctagtcgtcttcgtccggctcaagtctggcaaccgacggtcctccctcgacctagtcctctacgacctccgtacggctaggaacggacgtacggccttaggtaacttaagtttacgttcgactacgccttacgtaacttaataaccgttaagtaaacgttactaaagttcggttaactacccgtacgttacgggtccgtttaggggttacccggggacgggtaaaccggggtaacccgttaaacggtttacccgggtaacccggtttaccggttaaccgggttacggaacccggtacccggtaaaccgggtccgttacccccccggg

SEQ ID NO: 83743 - DNA, 656 bp, Homo sapiens
  misc_feature: GYAE6OF01C12RT.36.23.C01.1.454.CMB.1.raw
  modified_base (274)..(274): a, c, t, g, unknown or other
  misc_feature (274)..(274): n is a, c, g, or t
tcagtacgctgtctcacgaccggtgctcgattagtacacgtgattagggattggggggggtctcaggaggcaccgctctcaggacatctccaccatggcctgggctctgctgctcctcaccctcctcactcagggcacagggtcctgggcccagtctggcctgacacagcctgcctcgtgtctgagactcctggacagtcgatcaccatctcctgcactggaaccagcagtgacgttggagtacttataattatgttctccgttggttaccaanagctattcaggcacgaccgacccgtaaattcttaatttatgtacgttctttcggtccgtccctcgtagggtttctacgtcgtcttcgtccggtctaccgaagttctcggacacgaccggtccctaccgtcgacctatccgtactacgacctccgaggtcgtaggacggtacgaggctacggtaactttagttacttacgactacgtcttactaacttaacgtaacgtagtaacttaccgtaaagttacggttacttacccgtacgttcgggtccgtttgggtaccggggacgggtaacgggtaccgttaaacgggttaccggtacccggttaccgtaacgggttaccaccggtaaccccggaaggtccccgttacccccggg

SEQ ID NO: 83744 - DNA, 616 bp, Homo sapiens
  misc_feature: GYAE6OF01AQ92P.36.23.C01.1.454.CMB.1.raw
  modified_base (268)..(268): a, c, t, g, unknown or other
  misc_feature (268)..(268): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacgagggtcctgggcccagtctggcctgacacagcctgcctccgtgtctgagactcctggacagtcgatcaccatctcctgcactggaaccagcagtgacgttggtgcttataattatgtctctgtccaanagcatcaggcacgccgaccccgaaacttcttaatttatgtaggttctttcggtccggtcccttcgtacgggtttctagtcgtcttcgtccggctaccgaagtcgtggaccaagtaccggtcccttcccgtcgtaccctctaccttactagtaccctccaggctaggacggacggacggtcttagacgttattagtgactagtctcaattactaagttacgtaattactaagttcgtaactccgacgttcgggtcgttcgggttaccgggcgggtaacgggtacccgtaacggttacggacccggttaccggtacggtaccgacccggacccgtaccggttaccccccg

SEQ ID NO: 83745 - DNA, 776 bp, Homo sapiens
  misc_feature: GYAE6OF01DGSAG.36.23.C01.1.454.CMB.1.raw
tcagtacgctgtctcacgaccggtgctcgatttagtacacgtgattagggattggggggggtctcaggaggcagcgctctcaggacatcctccaccatggcctgggctctgctgctcctcaccctcctcactcgagggcacgacgggtcctcgggcccagtctggcctagacacacgcctgccttccgtgtctgacgtacctccgtaggactacgtacgactccaaccgtacttcctccgtcgacctaaccggtacgggaaaccacggtacgtacgggttacggttaaccgggtttgggttacgttaacttttaaagtttaacttttacgttcgtttaccttccgttacggttacccaaacgtcggtacttaacgttccgaacgggaccgaccggtaccccgtaaacccgttaaatttacttttaaaggtttacgtcggtttacggtttccgtttccgggtacccggtaccgttagggttaacgggtttcctacggttccgtacctttccggtccggtacttaccgtagttcgtaccggactaaccgccggtccctaccgtacacctcttccgtacgtaccgtaccgtccggaggtacgtaggtaacgggaccgtagggtctaagttaactttgtacgtcgactacgttctaactattacgtacgtagtaacgtctaagttcgacttccgtagtcggttacgtcgggtcggaacgggtagtaccgtacggttaccgacccggttacgtacggaccgaccgtaaccggtcgtccccg

SEQ ID NO: 83746 - DNA, 523 bp, Homo sapiens
  misc_feature: GYAE6OF01AT925.36.23.C01.1.454.CMB.1.raw
  modified_base (228)..(228): a, c, t, g, unknown or other
  misc_feature (228)..(228): n is a, c, g, or t
  modified_base (270)..(270): a, c, t, g, unknown or other
  misc_feature (270)..(270): n is a, c, g, or t
  modified_base (324)..(324): a, c, t, g, unknown or other
  misc_feature (324)..(324): n is a, c, g, or t
tcagtacgctgtctcacgaccggtgctcgatttagtacacgtgattagggagttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcatcaccatctcctgcactggaaccngcagtgacgttgtgcttataattatgtctcctggttccaacngcattcaggcagcgccccgaaactcttaatttatgagttctttcgtcggccctnagggtttctagtcgtcttctccggctcaagtctgcaacacggcctccctgaccactctcagaccttcgaggtctgtacggacgagctagacttattattgcagtctccatactactgaagtcaagttgaactccatggtcgtgttcgggaggacgggtaccaagttgacccgtcgtacggacacgacccgaaggtcccg

SEQ ID NO: 83747 - DNA, 796 bp, Homo sapiens
  misc_feature: GYAE6OF01D6TYE.36.23.C01.1.454.CMB.1.raw
  modified_base (307)..(307): a, c, t, g, unknown or other
  misc_feature (307)..(307): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgccctccgtgtccgagactccgtggactagtcgactaccacctactcctcctgacctacgtacggaaccagcgtaggttcggtacggttggtacttactttaattaattagtcttccttcgttacgtaccaagngtactattcggacggcaccggcccggtaacccgtaaactttattttaattacgtggttacgttttccgtttccggaccgtcccctgggttacgggtttcacgttcgttcctttccggcccgttctaaccgtagttccgacggtaaccctaccggtacccggtcccctacccgtacgtaaaccctctttaccgtaacgttaccgaaccgttaccggacgggtaccgtaagggaaccgggttaacgggtaaccgtcgttaaccgttaaacgtttagttttacgtaccggtacgtaccgtcttaaacggtaattttaaccgtaacggttaaacgggttaacgttaacgttaacggtttacggtacttaccccggaggttccggttaccggttacggggtaccgggggtaccgggaaacggtttaccgtacggttacccggtacccggttagttacggtaccgacccggtaacggcggttcccccgtacccgg

SEQ ID NO: 83748 - DNA, 833 bp, Homo sapiens
  misc_feature: GYAE6OF01DK9YZ.36.23.C01.1.454.CMB.1.raw
  modified_base (228)..(228): a, c, t, g, unknown or other
  misc_feature (228)..(228): n is a, c, g, or t
tcagtacgctgtctcacgaccggtgctcgattagtacacgtgattagggattggggggggtctcaggaggcagcgctctcaggacatctccaccatggcctgggctctgctgctcctcaccctctcactcagggcacagggtcctgggcccagtctggcctgacacagcctgcctcgtgtctgacgactccgtggacagtcgatcaccatcctctgcacgtggaaccngcagtgtacgttgtgtacttagtaacttatcgtacttccgttaggttaccaaacgtacgtactaagtttcgaacggtccgacggacccgtaaccccccgttaaaactttaccgttttaaaagttttacgtacggttaacggttttcccgttttaccgggtcccggtaccccgtttacggttaacggggttttccttaacggttccgttaccttttccccgtaccgggtaccttaaccccgtaaacggttcccgttacggggaaccctaaacccggtaccccgggtaccccttcccccgtaacgtaacccttacgttacccgttaccgtaacccgtacctaccccgggtaaggtccgtaacgggtaaaccgggaaccgggtaacggtccgtttaacggttaacgtttaagttttaacggttcgaaccgttacggtacccttaacggtaatttaacgttacgttaacggtaaacgttacgtaaagttcgggttaacctaccgttagtaccggttcgtttacgggttaccggggacgggtaacggtaacccgttaaggtaccgtaaccccggttcgtaacggtccaaccggcccgtaacggttccccg

SEQ ID NO: 83749 - DNA, 502 bp, Homo sapiens
  misc_feature: GYAE6OF01CX8L6.36.23.C01.1.454.CMB.1.raw
  modified_base (230)..(230): a, c, t, g, unknown or other
  misc_feature (230)..(230): n is a, c, g, or t
  modified_base (328)..(328): a, c, t, g, unknown or other
  misc_feature (328)..(328): n is a, c, g, or t
  modified_base (362)..(362): a, c, t, g, unknown or other
  misc_feature (362)..(362): n is a, c, g, or t
  modified_base (461)..(461): a, c, t, g, unknown or other
  misc_feature (461)..(461): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtccgatcaccatcctcctgccactggaaccngcagtgacgttggtgcttataattatgtcttcctggttccaacagcatttcaggcagcgccccgaaactcttaatttatgagttcttcgtcgccctcngggtttctagtcgcttctccgctcagtctgcacncgcctcctgccatctctagacctccaggctgaggacgaggctagactatttattgcagctcatatactgaagtctaatgtactcacgtgtctggtcggnggaggacctaggtcgaccgtctaggcacgccgaaggtcccg

SEQ ID NO: 83750 - DNA, 551 bp, Homo sapiens
  misc_feature: GYAE6OF01E5A63.36.23.C01.1.454.CMB.1.raw
  modified_base (227)..(227): a, c, t, g, unknown or other
  misc_feature (227)..(227): n is a, c, g, or t
  modified_base (454)..(454): a, c, t, g, unknown or other
  misc_feature (454)..(454): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggcagccgccccgaaattctttaatttatgtaggttcctttcggtcggtccctcgaggggttttctagtcgcttcgtccggctccagtctggcaacacggcctcctgaccatcctctagcctcgaggctaggacggacgaggctgactattactgcacgctacatatactgaacgtnaagttggtactccacgtgcgttggttccgggagggacgggtacccaaggtttcccgaccggtcccgtagggtacccgacggaccccgaaggtccccg

SEQ ID NO: 83751 - DNA, 527 bp, Homo sapiens
  misc_feature: GYAE6OF01BTTU7.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaatcttaatttatgaggtctttcgtcggccctcaggggtttctagtcgcttctccggctccaagtctggcaacacggcctccctgaccatctctagactccaggctgaggacgaggctgacttattattgcagctcatatactgaagtcaatggtaatccgaacttggcttggttcggcgggagggaccctaagttcggaacccgttccgtagggtcacggccccaagggtccccg

SEQ ID NO: 83752 - DNA, 807 bp, Homo sapiens
  misc_feature: GYAE6OF01EAMRN.36.23.C01.1.454.CMB.1.raw
tcagtacgctgtctcacgaccggtgctcgatttagtacacgtgattagggattgggggggaaatactttctgagactcatggacctcctgcacaagaacatgaaacacctgtggttcttcctcctcctggtggcagctcccagatgggtcctgtctcaggtgcagctgcagcagtcgggcccaggagtggtgaagccttcggacgaccctcgtccctcacctgcgctgtcgtctggacgcctcccgtcgggcggagataggaagtgggtggtaggttcgggtcccgccgaccggccccggaaggggaacggggcgtaggacggttggtagtttaggtagtaaaagtaaagtggaacgggacccggggacaaccgaactacgaacgtcgccgtacccgtcggacggggtacgacgtaccgaccctaagtactcgtacggactaacggaaaccgtaaacggtaacccaaaaccggtaaacccctacccgttttacccgtaccccgttacgggtaaccgggtaccgttaccgtaaccccgttccggtacggttacccgggacccccgggtacccggaccgggtaacccgtacccgggtacccttaagttaacgtttacgttttaacgttcgggttcggtaacggttaaggtttacggtttttacggaccgttagggttacgtttacgggttacgggggtaccggtttacgtccgggtaccggttcgggtacgggggtaccgtaaaggggtcgttaccggacgggttcaccgttccgttaccctacccgttacgcccgtcccctaacccgg

SEQ ID NO: 83753 - DNA, 720 bp, Homo sapiens
  misc_feature: GYAE6OF01DS5NI.36.23.C01.1.454.CMB.1.raw
  modified_base (238)..(238): a, c, t, g, unknown or other
  misc_feature (238)..(238): n is a, c, g, or t
  modified_base (285)..(285): a, c, t, g, unknown or other
  misc_feature (285)..(285): n is a, c, g, or t
tcagtacgctgtctcacgaccggtgctcgatttagtacacgtgattagggagttgggggggggtctcaggaggcagcgctctcaggacatctccaccatggcctgggctctgctgctcctcaccctcctcactcgagggcacgagggtcctggggcccagtctgggcctgacacagcctgccctccgtgtctgacgctccgtggacagtcgatccaccatctcctgcacgtggaaccngcaggtgacgttggtgtacttataattatgtctcctggttaccaacncgcattcgaggcagccgacccgaacttcttaattatgtagttctttcgcggtcctgtaggtttctagtcgtcttcgtccgtctactaagtcgtacggacaccgaccggtccctccctcggacctcttacctacgtacgtaacctccgaacggtccgtagggtaacgggacggacgggtacgttacgtaactttaacggttttaacgttcggtacgtacggtaccctttacgtaaacgttaactttaaccggttaagttaaacggtacttaaggttacggttaaccttaacccggtacgttacgggttacccgttacggggttccggggtaacgggtacggggtaaaccccgttaacgggttacccggttaaccccggttaccgggttacggttaacccggtaaccggtaaccccggtaaccgggtaccccccggg

SEQ ID NO: 83754 - DNA, 868 bp, Homo sapiens
  misc_feature: GYAE6OF01CN8TV.36.23.C01.1.454.CMB.1.raw
tcagtacgctgtctcacgaccggtgctcgatttagtacacgtgattagggagttgggggggggtctcaggaggcagcgctctcaggacatcctccaccatggcctgggctctgctgcctcctcaccctcctcactcgacgggcacgacggggtcctcgggcccaggtccgtcgggccctgaccacgacgtcctcgcccttccggtgtcgtagacgtccttccgtaggaaccaggtaccgactacccgacctacttccgtccctagccgaacgtacgggaaacctaggaccgtaagggttcggtacggggtttaggtacgttaacgttttaatttaaagtttacgttcgttaccgtttcccgttaggttaacccaaacgtacgcttaacgttcgaacgggccaaccggaccccgtaaccccgttaaaattttcctttaaaaggttttacgacgggttacggttttcccgtttaccgggtacccggtcccggtttaacgggtttacgggttttaccttacggttcccgttaccgtttcccggtaccggtacccgtacccggtaaagttccgttaaccgggaaccctaacccggtacccggtcccttacccgacgtacccttactacccgtacgttaaccggtacccctcggaacgggtaccgtacgggaacggtaccggtacgggtaccttaaggtacttaagtttacgacgtaccgtactctaacgtaattacgttaaccgaggtaacttcgtaagttccgtaactcgtaccggtgttacgggtgggtaccgggtaaggggaaccctaagggttaacctccggggttacccttaccgggtagtacccggaacggcccttcgggtccccg

SEQ ID NO: 83755 - DNA, 692 bp, Homo sapiens
  misc_feature: GYAE6OF01C3AKC.36.23.C01.1.454.CMB.1.raw
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgacgactcctggacagtcgatcaccatcctcctgcactcggaaccagcagtgtacggttggtctcttaattaattatgttccttccgttggttacccaaactagctattcgaaggcacgcccgaccccgtaaacttctttaatttagtcgtagtttccgtttaccggtccgcccgttcggtagggtttcctacggttccgtcctttcgtcccggtccttaccgaagttccgtacgggacctaaaccgcccggtccctaccccgtagtaccctaacttcctactaacgccttaccgaggtcgtaggaacggtacgacgggttacttaaactttcgtacgtgtactagttactaagttaactaaccgtaaaccacgtaccaacgttaccttcgtacgtacgttacggttaccgggacgggtacgggaacgtaacggtccggtaaccggtacccgttacgtaaccgtcgaacccggaaccgaccggcccgtcccgtacccccgtcccgg

SEQ ID NO: 83756 - DNA, 672 bp, Homo sapiens
  misc_feature: GYAE6OF01B5OCA.36.23.C01.1.454.CMB.1.raw
tcagtacgctgtctcacgaccggtgctcgatttagtacacgtgattagggattgggggggaaatactttctgagactcatggacctcctgcacaagaacatgaaacacctgtggttcttcctcctcctggtggcagctcccagatgggtcctgtctcaggtgcagctgcagcagtcgggcccaggagtggtgaagccttcggagaccctgtccctcacctgcgctgtgtctggacgccctcccgtcgggcggagagtgaagtgggtggtaggttcgggtcccgccgacggcccccgaggggaacggggctggagttggagttggtagaaataagtggacggaccggggacaaccaaactaacgaagtcggccgtacccgtcgacggggtcgacgtaccaacgatacgtctgacagacaacgtaccaaagaaaccctcttacctccctgacgctacgtaccctcgtcgtcgacccgccgaccgacgtccgacctattacttattacgttgtgacgtagttacgttttcgacgtaggttacgttcggttggggtacgttacgttaccggtacggttaccggttagggggtaccgaaaggggtacgttaccggtacccggttcgtaacgttcccggttaccctacccgtccgtacccgtccccgtaaacccccgg

SEQ ID NO: 83757 - DNA, 757 bp, Homo sapiens
  misc_feature: GYAE6OF01B5RD5.36.23.C01.1.454.CMB.1.raw
  modified_base (275)..(275): a, c, t, g, unknown or other
  misc_feature (275)..(275): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcatcaccatcctctgccactggaaccagcagtcgtacgttggtgtcttataattatgtctcctggttccaacngcattcaggtcacggccgaccccgtaaacttctttaaatttatggtaggttcctttacggtccggtcccttcgtacggggtttactaggtccgtcctttccgtcccggtctacccgtaagttccgtacggaccaaaccgtcccgggtacccttccccgttacggaaccctattacccttcgttaaccggtacccctaccgtaacgggtccgttacgggaacgggaaccgggtaggtacccgttaggtaacctttaagtttagtttccggacctaacggtacttaccgaagttaaacttaccgtaaggtaacgttaacgttaagttacgggttaacctacccggttacgttcgggtcgttttaccggggtccggggtaccggggaaacggggttaacccgtaaacgggttttcccgggaaccccggtttaccggtaacggttaaccccggaaccggtaacccccgtaagggggttcccccccg

SEQ ID NO: 83758 - DNA, 715 bp, Homo sapiens
  misc_feature: GYAE6OF01CAWX4.36.23.C01.1.454.CMB.1.raw
  modified_base (242)..(242): a, c, t, g, unknown or other
  misc_feature (242)..(242): n is a, c, g, or t
tcagtacgctgtctcacgaccggtgctcgatttagtacacgtgattagggagttggggggggtctcaggaggcagcgctctcaggacatctccaccatggcctgggctctgctgctcctcaccctcctcactcgagggcacgagggtcctgggcccagtctggcctgacacagcctgcctcgtgtctgacgacctccgtggacacggtcgatccacctattcctcctgccacgtcggaaccngcagtgtacgtttggagtaacaatcatgtctccgtacgtaccaacacgtaccaggaccaaaccgccccaaaatcatcttattttcgacggtcggtacgtccggcctacgaaggttaactttctaagttcgtactttctacgtcggtactaccgagttctcgacccaacgcccggtccctcccgtacgaacctacttccgtaccgtcggccctccgacgtccgtaagggacgggacggacggtacgtagttaactttactttaccttcgttaccctactaaccgttagttaaccgaaccggtccggttaagtttccggttacggttccggttttccggggccgggtaaccccgtacccgtaccgttaccggtacccggttaccggttacgggtacccgtaccggtacccgtaaccggtcccggtccccgttacccccggttaccggtacccgtccgttccccggtttaccccgg

SEQ ID NO: 83759 - DNA, 791 bp, Homo sapiens
  misc_feature: GYAE6OF01CDNTE.36.23.C01.1.454.CMB.1.raw
  modified_base (230)..(230): a, c, t, g, unknown or other
  misc_feature (230)..(230): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatccaccatctcctgcactggaaccngcaggtgacgttggtgtacttaataattatgtccttctcggttaccaacagctatcgaggcacgccgacccgtaaacttctttaaatttacgtgtacgttcgtttccggtccgtacccgttacgtacggggtttctacggtccgtccgttccgtcccggtactcctaacggtcgtacgaccaaccgtacccggtccctacccgtacgaaccctattccgttaccgtaacgtacccttccggtaaggtccgttagggaaaccgggaccggtacgggtaccttacggtaaactttacgtttaagttacggtaccgtacgtaccgttaacttaaacgttacgttaacccgttaaggtaaaccgttaacgttaaacggtttagggttaacccttaccccggttaacggttccggggttacccgtttacgggggttacccgggggtaccggggtaaacgggggttaaaccccgttaaaggggtttacccgggttaaaccccgggtttacccgggttaaacgggttacccgtaaaccgggaccccccggtaaacggggttccccccg

SEQ ID NO: 83760 - DNA, 688 bp, Homo sapiens
  misc_feature: GYAE6OF01D7YTS.36.23.C01.1.454.CMB.1.raw
  modified_base (226)..(226): a, c, t, g, unknown or other
  misc_feature (226)..(226): n is a, c, g, or t
  modified_base (240)..(240): a, c, t, g, unknown or other
  misc_feature (240)..(240): n is a, c, g, or t
  modified_base (250)..(250): a, c, t, g, unknown or other
  misc_feature (250)..(250): n is a, c, g, or t
  modified_base (310)..(310): a, c, t, g, unknown or other
  misc_feature (310)..(310): n is a, c, g, or t
tcagtacgctgtctcacgaccggtgctcgattagtacacgtgattagggattggggggggtctcaggaggcaccgctctcaggacatctccaccatggcctgggctctgctgctcctcaccctcctcactcagggcacagggtcctgggcccagtctggcctgacacagcctgcctccgtgtctgagctcctggacagtcgatcaccatctcctgcactggaaccngcagtgacgttggncttataattntgtctccgtggttaccaacagctagttcaggcacgccgaccccgtaaattctttaaattntggtacgtttctttcggtcggtcccttcggtagggttttcagtcgtctttcgccgctaccaagttctcggaccaacgaccggtccctacccgtgaaccctacgttcctacgtacgtaccctcgaaggtcgtaggaacggtacgacggtcttacggtaacttaacgtttagttcggactacggtccttactaactttaacgtaaccgttaggtaacgtttacgtaaagtttcgggtaactccgtaacgttcgggtaccgttcgggttaccgggacgggtaaaccgggtaccgttaaacgggtttcccggaaccccggtttaccgttacggggtaaccctaccgggtaaccccgtaacgggtccccttaaccccccgggg

SEQ ID NO: 83761 - DNA, 585 bp, Homo sapiens
  misc_feature: GYAE6OF01DX0TQ.36.23.C01.1.454.CMB.1.raw
  modified_base (209)..(209): a, c, t, g, unknown or other
  misc_feature (209)..(209): n is a, c, g, or t
  modified_base (268)..(269): a, c, t, g, unknown or other
  misc_feature (268)..(269): n is a, c, g, or t
  modified_base (573)..(573): a, c, t, g, unknown or other
  misc_feature (573)..(573): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctctcactcagggcacagggtcctgggcccagtctggcctgacacagcctgcctccgtgtctgagactcctggacagtcgatcaccntctcctgcactggaaccagcagtgacgttggtgcttataattatgtctctgttccaacnncattcaggcgacgacccgacccgtaacttactttaatttatggtagtttcgttcgtccgtctcggtggttctacgtcgtctcgtccgtcctacgtagtcgtcgacaaccgacccggtccctccgtacgacctacttcctacgtacgcctaccgacgtcgtaggacggacggagtctacgtacttattacgtgcacgtcgtataattacttacgtagtaacgttacgtaagtagtaccctctaacgtcgttacgttcggtcgggacgggacggtaactacggtcgtaccgttccgagtacgaccncggtacctcccg

SEQ ID NO: 83762 - DNA, 763 bp, Homo sapiens
  misc_feature: GYAE6OF01B5KVQ.36.23.C01.1.454.CMB.1.raw
  modified_base (242)..(242): a, c, t, g, unknown or other
  misc_feature (242)..(242): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacgagggtcctgggcccagtctggcctgacacagcctgcctccgtgtactgacgactccgtggacaggtcgactccacctatcctcctgaccacgtacggaaccngcaggtgtacggttggtctactttaagtaatttacgtcgttccttaccgttaggttacccaagtacgcctaattccgaaggcctaccggaccctaaccccgttaaaactttacttttaaagtttacgtacgggtaccgggttttccttttccccgggtacccggtaccccttttacggttaaggggtttaccttaggttcccgttctttacccggtcccgtacttacccgaacgttccgtacggaccaaaccgtcccggtccctccgtacgacctacgttcctactacgtaccgtaccgtacggtcgtacggacggtacggacgtcgttaacgtacttacgtttagttcgtacgacgtactactaactacgttacgtaacgtaacgttacgtaagttacgtaccgtaccgttacggtacgttcggttacgggttaccggggacgggtaaccgggtaaccgtacggttaccggtaccggttacccgttacggttacccgacggtaaccccgtaggtaccccg

SEQ ID NO: 83763 - DNA, 623 bp, Homo sapiens
  misc_feature: GYAE6OF01BPV2M.36.23.C01.1.454.CMB.1.raw
  modified_base (227)..(227): a, c, t, g, unknown or other
  misc_feature (227)..(227): n is a, c, g, or t
  modified_base (265)..(265): a, c, t, g, unknown or other
  misc_feature (265)..(265): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctctgtccanagcatcagcagccgacccgtaattcttaattatgtagttctttcgcggtccctgtacgggtttctagtcgtcttcgtccgctccgaagtctcggaccaacgccggtccctccgtacgacctatcctctacgacctccgaggcgtaggacggacgacggtcgttacgtaactttagtttagtggacctagtccttactaattaactacgtagtaaacttacgtaagtaggttacctccgacggttggaccgtttcgggttccggggaccgggtaacgggtaacccgttaaggtttacccgggaaccccggtttccggtaacgggttacccgaaccgggtaccccggtaagggtcccccg

SEQ ID NO: 83764 - DNA, 783 bp, Homo sapiens
  misc_feature: GYAE6OF01D2R1Y.36.23.C01.1.454.CMB.1.raw
  modified_base (230)..(230): a, c, t, g, unknown or other
  misc_feature (230)..(230): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgccctccgtgtctgagactcctggacagtcgatcaccatcctcctgcactggaaccngcagtgacgttggtgcttataattatgtctcctggttccaacagcattcaggcagccgacccgaaactcttaatttatgtacggttctttcggtccggtccccttcgtacggggttttcctaggtccgtacctttccgtcccgggtcttaccgtaaacgttccgttacgggaccaaacgtacccggtcccttccccgtagacccctattcccttacctaacgtacccttacccgagggtccttacgggaacgggtaacccggtagggtcccttacgggtaaaccttttaagtttaacgttttacggacccgtaacggtcctttaacccgtaagtttaaaccttaaccggttaacggtaaacgtttaccttaaacggtttcgggttaaacttacccccgttaacgttcgggttacccgtttaccggggtttacccggggaaccgggggtaaaccgggtaaacccgttaaacggggtttacccggtaacccccgggtttacccggttaaagggttacccccgaaaccgggtcccccgtaaacgggttccccccgg

SEQ ID NO: 83765 - DNA, 726 bp, Homo sapiens
  misc_feature: GYAE6OF01B50Z5.36.23.C01.1.454.CMB.1.raw
  modified_base (232)..(232): a, c, t, g, unknown or other
  misc_feature (232)..(232): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacgagggtcctgggcccagtctggcctgacacagcctgccctccgtgtctgacgactccgtggacaggtcatcaccatctcctgcactggaaccngcagtgacgttggtgacttataatttatgtctccttaggttacccaacagctattcgaaggccacgccgaccccgtaaacttcttaaatttagtggtacggtttcctttcggtccggtccccgttcggtaggggttttcctaggttccgtcctttccgtcccggtctacccgtaacgttccgtcgggaccaaaccgtacccgggtccccttcccgtacggaacccttacgttcccttaccgtaacgtacccgttacccgtaacgggtcgttacgggaacggggaaccgacgggtacccttaggtaaccgtttagtttaacgttcggacctacgtcttaccgtaattaccgttaacgtacggtaaagttacgaacgtttacggtaccttacgtaccggtacggtcgttacgggttcggggtacggacggggtaacccgtaagttcccgggaaccgttcccggttaggacccgacggtaacccgtacgggtccccg

SEQ ID NO: 83766 - DNA, 702 bp, Homo sapiens
  misc_feature: GYAE6OF01B83B3.36.23.C01.1.454.CMB.1.raw
  modified_base (350)..(350): a, c, t, g, unknown or other
  misc_feature (350)..(350): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacgagggtcctgggcccagtctggcctgacacagcctgcctccgtgtctgagacctccgtggacagtcgatcaccatcctccgtgcacgtacggaaccagcgagtgacggtttggtgtactttaattaaatttattgttccttccgttaggttacccaaacgtgtacctattcgacggccgacgcccgaaccccgtaaaattctttaaatttncggtagtttcctttccggccgtcccgtacggttacgggtttctacgtccgtctttccgtccggacttaccgtaagtcgtacggaccctaaaccggcccggtcccctaccgtacgaccctacgttcctacctacgtaccttccgagggtctaggacgggaccgacgtcgttataacctttagttatccggctacgtactactaagttactaacgttagtaaacgttacgtaaagttcgtaaccgttccgacgttcggtaccgtttgggtaccgggtaccgggtaaacgggtacccttaaggttaccgaacccggttcggtaacggtaccgaccggacccgtacgggtcccccg

SEQ ID NO: 83767 - DNA, 693 bp, Homo sapiens
  misc_feature: GYAE6OF01A5HJ4.36.23.C01.1.454.CMB.1.raw
  modified_base (272)..(272): a, c, t, g, unknown or other
  misc_feature (272)..(272): n is a, c, g, or t
tcagtacgctgtctcacgaccggtgctcgatttagtacacgtgattagggattggggggggtctcaggaggcagcgctctcaggacatctccacaatggcctgggctctgctgctcctcaccctcctcactcagggcacagggtcctgggcccagtctggcctgacacagcctgccctccgtgtctgacgctcctggacagtcatcaccatctcctgcacgtgaaccagcagtgacgttgtgcttataattatgtcttccgtgttaccaacngctattcaggcacggccgaccccgtaaattcttaatttagtggtacgttctttcggccggtcctagtacgggtttcagtcgtcttcgtcccgtctaccgaagttcgtcggaccaacgtccggtacccttcccgtagaccccttatccctttaccgtacgtacccgttccgtaaggtccgttacggaacgggaaccggtacggttccgttaagtaaccgtttaattttacggtcgtaccggtaagtccgttaacttaagttaacgtaccgttaaagtaacggttaacctaaggttcggttaactccgtaacggttggtaccgttgggttccggggaacgggttaacggacccgttaaaggggtttccgaaccccggttccggtaacgggtaacccgacgggtaccccgtaagggttccccgg

SEQ ID NO: 83768 - DNA, 622 bp, Homo sapiens
  misc_feature: GYAE6OF01D7ULR.36.23.C01.1.454.CMB.1.raw
  modified_base (229)..(229): a, c, t, g, unknown or other
  misc_feature (229)..(229): n is a, c, g, or t
  modified_base (603)..(603): a, c, t, g, unknown or other
  misc_feature (603)..(603): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatctcctgcactggaaccngcagtgtactttggtagtaacaatcatgtctcctacggtaccaacacgtacccaggaccaaaccgacccccaaatcacttctattttgacgtcggtacgtcgccctagagtatttctaatcgtcttctctgcctacaacgtctacgaccaaccaccggtccctccctacgaccctactcctcgtcgggcctaccgacgtcccgtaggaacggacggacggtacttgttaactttacgtttaccttcgtttccctactactacttaccgaacgtccggtaagttacgtttcggtcgtttccgggccggtccgaaccctccgtcgacccgttcgtacggtcgacggcccgacggtcctcccgtccccgtcgtaccnccttccgttccgtcccccg

SEQ ID NO: 83769 - DNA, 539 bp, Homo sapiens
  misc_feature: GYAE6OF01BLR0D.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgccccgaaactctttaatttatgtaggttctttcgtcggcctcgtaggggtttctagtcgcttctccggctccaagtctggcaacgacggccctccctgaccatctctacgacctccacggtctggacggacgagggctgacttattattgcagctcatatacgtgaatcaagtgtatccgactggcttggttcgggacgggacgggaccgaaggttcggaccgttccgtaggtaccacgccccgaaggtcccg

SEQ ID NO: 83770 - DNA, 538 bp, Homo sapiens
  misc_feature: GYAE6OF01AWWWS.36.23.C01.1.454.CMB.1.raw
  modified_base (228)..(228): a, c, t, g, unknown or other
  misc_feature (228)..(228): n is a, c, g, or t
  modified_base (269)..(269): a, c, t, g, unknown or other
  misc_feature (269)..(269): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctctggttccaangcattcaggcagccgaccccgaaatcttaattatgtagttctttcgtcggtccctgtagggtttctagtcgcttcgccggctccgaagtctggacaacgcggtccctcctgaccatcctctagacctcgaggctaggacgacgagctagacttattatgcagtctacaattatacgtagaacgtactaagtgtactccgtagtggtactggtcgggcggtacggacctaaggttcgaccgttcctagggtaccacgcccgaaggtcccg

SEQ ID NO: 83771 - DNA, 769 bp, Homo sapiens
  misc_feature: GYAE6OF01BGR91.36.23.C01.1.454.CMB.1.raw
  modified_base (238)..(238): a, c, t, g, unknown or other
  misc_feature (238)..(238): n is a, c, g, or t
  modified_base (271)..(271): a, c, t, g, unknown or other
  misc_feature (271)..(271): n is a, c, g, or t
tcagtacgctgtctcacgaccggtgctcgatttagtacacgtgattagggagttggggggggtctcaggaggcagcgctctcaggacatctccaccatggcctgggctctgctgctcctcaccctcctcactcagggcacgagggtccgtgggcccagtcgtggcctgacacgacgcctgcctccgtgtctgacgactccgtggacagtcgactcaccatctctgacacgtggaaccngcgtagtgtacgttggtctactttaattaattntgttccttccgttaggttacccaatacgctattcgacggcacggtacccgtaacccgtaaattacttttaagttacgtaggttaacggtttccgtttaccgggtccgtaccgttacgggttacggggttttcctacggttcccgtctttcccggacccggttacctaaccggtacggttaccgtacggggtaaccctaaaccgggcccggttccccttacccgtacggttaaccctcgttaccgttaaccgtaccgtacccggttaaccggtcgggtacgtacgggaaccgggtaacgtaggggtacccttaaggttaacctttagttaacttcgggactacgttctaacgtaattacgtaacgttaggaaacttgtaacggttcgtaacctcgtaccgttgggttacctcggggttacgggacgggtacggtaaaccgttaacggttccggacccgttacgggttacggaccgaacggtaccccggcggtaccccgg

SEQ ID NO: 83772 - DNA, 585 bp, Homo sapiens
  misc_feature: GYAE6OF01CUR2O.36.23.C01.1.454.CMB.1.raw
  modified_base (270)..(270): a, c, t, g, unknown or other
  misc_feature (270)..(270): n is a, c, g, or t
  modified_base (419)..(419): a, c, t, g, unknown or other
  misc_feature (419)..(419): n is a, c, g, or t
  modified_base (430)..(430): a, c, t, g, unknown or other
  misc_feature (430)..(430): n is a, c, g, or t
tcagtacgctgtctcacgaccggtgctcgattagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctcctgcactggaaccagcagtgacgttggtgcttataattatgtctcctgttccaanagctatcaggcagccgaccccgaaactctttaatttatgtacggttctttcgtccggcctcgtagggttttctagtcgtcttcgtccgctcagtctggcaacgccggtcctccgcacctatctctacgactcgagtctaggacggacgngctgactattntgctagcttacattatactgtaacgtctaagtcggtaactaccgtacgtggtccgttgggttaccggggcgggtaacgggtacccgtaagggtttcccggaacccggttacccggtttaacgggcctaaccggaccccgtaaggggttacccccg

SEQ ID NO: 83773 - DNA, 720 bp, Homo sapiens
  misc_feature: GYAE6OF01E0XGL.36.23.C01.1.454.CMB.1.raw
  modified_base (230)..(230): a, c, t, g, unknown or other
  misc_feature (230)..(230): n is a, c, g, or t
  modified_base (271)..(271): a, c, t, g, unknown or other
  misc_feature (271)..(271): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatccaccatcctcctgcactggaaccngcagtgacgttggtgcttataattatgtctctggttccaangctattcaggcacgccgaccccgtaaacttcttaatttatgtagttcgtttcgtcgtcccgtcgtagggtttctacgtcgtcttcgtccgtctccgtaagtccgtggaccaaccgaccggtcccctcccgtacgaccctactccttacgtacgaccctccgaggtcctaggacgggaccggacggtcttaggtacctttagtttacgttcgaccgtacgtctaccgtaattaacgttaacgttaacggtaaaccgttaccgttaaaggtttacggggtttaaccttaccccggtaaaccggtttcgggtaccggttttacggggttacccgggggtaaccgggggtaaccggggttaaaccccgttaaacgggttttaccggtaaacccccgggtttccgttaacgggtacccggaacccggtacccccggaaacggggttccccccgg

SEQ ID NO: 83774 - DNA, 688 bp, Homo sapiens
  misc_feature: GYAE6OF01CZLSG.36.23.C01.1.454.CMB.1.raw
tcagtacgctgtctcacgaccggtgctcgatttagtacacgtgattagggattggggggggtctcaggaggcagcgctctcaggacatctccaccataggcctgggctctgctgctcctcaccctcctcactcagggcacagggtcctgggcccagtctggcctgacacagcctgcctccgtgtctgagactcctggacagtcgatcaccatcctcctgccactggaaccagcagtgacgttgtgcttaataatatgtctcctgttccaacagcattcaggcagccgaccccgtaaactactttaatttagtgtagttctttcgtccgcccgttcgtaggggtttctagttcgtcctttcgtcccggtctaccgtaagtcctcggacctaaaccgaccggtccccttacccgtacgaccctacttcctcgtaacgtacctacccgaggtcctagggaacggacggacggtacgttacgtaacttaagtttactttgacctagtccttactaattaactaacgtagtaaacgttactaagttcggttaactcccgtaacgttcgggtaccgtttacgggttaccggggaccgggtaacggggtaaacccttaaacgggtttcccggtaaacccggtttcccgttaaacgggtcccgtaaaccggtcccccgtaaacggggttacccccg

SEQ ID NO: 83775 - DNA, 663 bp, Homo sapiens
  misc_feature: GYAE6OF01B62WK.36.23.C01.1.454.CMB.1.raw
  modified_base (232)..(232): a, c, t, g, unknown or other
  misc_feature (232)..(232): n is a, c, g, or t
  modified_base (247)..(247): a, c, t, g, unknown or other
  misc_feature (247)..(247): n is a, c, g, or t
  modified_base (281)..(281): a, c, t, g, unknown or other
  misc_feature (281)..(281): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgacgactcctggacagtcgatcaccatcctcctgcacgtcggaaccngcagtgacgttggtntcttataattatgtccttccgtcggttaccaacngctattcgaggccacggcccgaccccgtaaacttctttaaatttagtacggtacggtttcctttccggtccggtccccttcgtacggggtttctacggtccgtctttccgtccggtctaccgtaacggttccgtcggaccaaaccgtccggtcccctcccgtacgaccctacgttcctaccgtacgacctaccgaggtccgtaggacggtaccgaggtccttagtaacttaacttgtcgctaacgtctactaattactacgtagtaacgttacaagttcggtactccgtaggtcgtacgttggtacccgggacgggtaacgggtccttaacgggttccgtacccgttcggtaacggtaccaccggtcccggtacggtccccg

SEQ ID NO: 83776 - DNA, 693 bp, Homo sapiens
  misc_feature: GYAE6OF01D5HO5.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcacatctcctgcactggaaccagcagtgacgttggtgcttataattatgtctcctggttccaacagcattcaggcacgccgaccccgtaaacttcctttaatttatgtaggttctttcgtccggtccctcgtaggggtttctagttccgtcttcgtcccggtcttaccgaagtctgggaccaaccgtaccggtccctccctagaccctatcctactacgacctaccgaggtccgtaggaacgggacgacgggtcttacggtaacctttagtttacgttcgtacgtacggttacctactaagttaacttaccggttaagtaaacgttacgtaaacgtttcgggttaacttcccgtaacggttcgggtaccgtttcggggttaccggggaccggggtaaaccgggtaaacccggtaaagggtttcccggaaccccggtttaccggttaacgggttaccgaacccgggtacccgaaacggggttcccccgg

SEQ ID NO: 83777 - DNA, 794 bp, Homo sapiens
  misc_feature: GYAE6OF01DD6V0.36.23.C01.1.454.CMB.1.raw
  modified_base (235)..(235): a, c, t, g, unknown or other
  misc_feature (235)..(235): n is a, c, g, or t
tcagtacgctgtctcacgaccggtgctcgattagtacacgtgattagggagttggggggggtctcaggaggcaccgctctcaggacatctccaccatggcctgggctctgctgctcctcaccctcctcactcagggcacgagggtcctgggcccagtctggcctgacacagcctgcctccgtgtctgagtactcctggacagtcactcaccatcctctgaccacgtacggaaccngcgtagtgtacgttggtctactttaataatttatcgttaccttccgttaggttacccaaagtacgtctacgttaccgacgggtaccaaccggacccggaaaccccgttaaaatttacctttaaaagttttacggtaacggttacggttttccgttttcccgggtaccccggtccccgttacgggtttaacggggtttttctacggtttccgttcccgtttcccgtacccggtcctttaacccggtaagtttcccggtacggaaacccgtaacccggtcccgggtacccccttacccggtacgaaccccttacgttacccttaaccgtaccggtaacccgttaccggaacggtcggtaacgggaacgggtaacggtacgggtaccttaggttaaaccgtttacgttttacgtacggtactaccgtacttaacgtaactttaactacgtacgtaacgtactaagtttacgtacctccgtaacgtggtaccgttcgggtaccggacgggacgtacgtaagtccgtacgtacgtacgaccgacgtaccgacgtccgtaccccg

SEQ ID NO: 83778 - DNA, 752 bp, Homo sapiens
  misc_feature: GYAE6OF01DWI5F.36.23.C01.1.454.CMB.1.raw
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
tcagtacgctgtctcacgaccggtgctcgattagtacacgtgattagggattgggggggggtctcaggaggcaccgctctcaggacatctccaccatggcctgggctctgctgctcctcaccctcctcactcagggcacagggtcctgggcccagtctggcctgacacagcctgcctccgtgtctgagactcctggacagtcgatcacatctcctgcactggaaccngcagtgacgttggngtcttataattatgtctccgtgtcaacagcattcaggcacggccgaccccgtaaacttcgtttaatttagtggtacggtttcttttccggtccggtcccttcggtacggggttttctacggttccgtcctttccgtcccggtcctaccgtaagttcgtacgggacctaaaccgacccggtcccgtcccctacggaaccctacgttccttaccgtaacgtacccgttcccgaacggggtccttacgggaacgggaccgggtagggtacccgttaggttaaacctttaacgttttaacggtttcgaccgtaacggtccttaacgtaattaacgttaaccgttagggtaaacgtttaccgtaagtttacgggttaacttacccgtaacgttcgggtaccgttcgggttaccgggggaccggggtaaacggggtacccgttaagggtttacccggtaacccggttaccgttacgggtacccgtacggtaccccgaacggttccgtaccccccggg

SEQ ID NO: 83779 - DNA, 669 bp, Homo sapiens
  misc_feature: GYAE6OF01ASFXM.36.23.C01.1.454.CMB.1.raw
  modified_base (228)..(228): a, c, t, g, unknown or other
  misc_feature (228)..(228): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacggttggtgcttataattatgtctcctggttccaacagcattcaggtcagccgaccccgtaaactcttaaatttatcgtacggttctttcgtccggtcccttcgtaggggtttcctaggtccgtccttcgtccggtctccgtaacgttcgtggaccaaccgtaccggtccctacccgtcgtaccctagtccttacctacgtaccgttcccgacgggtcgtacggaacggaccgtagggtcctagtaacttacgtttacgttcgactaccgtctacctaattacgtaacgtgtaaacgtactaagttcggtaacttaccgtacgttcgttacgttcgggttccgggacgggtaccggggtaaccttaaccgggttacgggtaaccccgttacccggtacggttaccgaacccggtcccggtaaacggtcccccgg

SEQ ID NO: 83780 - DNA, 749 bp, Homo sapiens
  misc_feature: GYAE6OF01DJ7FF.36.23.C01.1.454.CMB.1.raw
  modified_base (205)..(205): a, c, t, g, unknown or other
  misc_feature (205)..(205): n is a, c, g, or t
  modified_base (236)..(236): a, c, t, g, unknown or other
  misc_feature (236)..(236): n is a, c, g, or t
  modified_base (253)..(253): a, c, t, g, unknown or other
  misc_feature (253)..(253): n is a, c, g, or t
  modified_base (286)..(286): a, c, t, g, unknown or other
  misc_feature (286)..(286): n is a, c, g, or t
  modified_base (585)..(585): a, c, t, g, unknown or other
  misc_feature (585)..(585): n is a, c, g, or t
tcagtacgctgtctcacgaccggtgctcgatttagtacacgtgattagggattgggggggggtctcaggaggcagcgctctcaggacatctccaccatggcctgggctctgctgcctcctcaccctcctcactcgagggcacgagggtcctgggcccagtctggcctgacacagcctgcctccgtgtctgacgtctccgtggacngtcgactcacctatcctctgcacgtgaaccngcgagtgtacgttggtntacttataattatgtccttcgtacgttaccaangtacctattcgacggccacggccgaaccccgtaacttacttttaaagtttcagggttacgtttccgtttccggtcccggtacccgttcgggttacgggtttacctacggttccgttccgtttccgtcccggtacctaccgtaacggttccgtacgggaccctaaccgtaccggtccccttacccgtacgtaaccctcgttacctaaccgtaccggtacccttacccggaggtaccgggtacggaaccggggtaacgacggtccgtacgttaacctttagttcgacgactacgtaccttntaagttactacgttaagaacgttcttaacggttacgtaccttccggtagtacggttcggttcgggttaaccggggagggaaacggttcccgttaacgggttcccgtaaccggttaacccggtacgggaaccaaccccgggtaaccgtcccggggttacccccgg

SEQ ID NO: 83781 - DNA, 538 bp, Homo sapiens
  misc_feature: GYAE6OF01CGHPT.36.23.C01.1.454.CMB.1.raw
  modified_base (230)..(230): a, c, t, g, unknown or other
  misc_feature (230)..(230): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacgagggtcctgggcccagtctggcctgacacagcctgcctccgtgtctgagacctcctggacagtcgatcaccatctcctgcactggaaccngcagtgacgttggtgcttataattatgtctcctggttccaacagcattcaggcagccgaccccgaaactctttaatttatgtagttctttcgtccgccctcgtagggtttctagtcgtcttcgccggctccaagtctgcaacacgccctccctgacctatctactacgacctccgagcgtagacgggacgaggctagacttagttattgcagctcaatatactgaatctaagtaggtactccgtacgtgtctggttcggcggtacggaccaaggttcgacccgtacgtacggcacgccgtaggtcccg

SEQ ID NO: 83782 - DNA, 832 bp, Homo sapiens
  misc_feature: GYAE6OF01CUR39.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgcctcctcaccctcctcactcagggcacagggtcctgggcccagtctggcctgacacagcctgcctccgtgtctgagacctctggacagtcgatcaccatctcctgcactcggaaccagtcagtgtacgttggtgtacttaattaattattcgtccttccgttacggttaccaaaccagtctaagttccagggcctacggacccgacccccgtaaaacttaccttttaaatttaatcggtagggtttccttttcggccccggtaccccgttcgtacggggttttctacggttcctccgtttccgtaccggtccttaccgtaaacggttccgttacggacccgtaaaacccgtccccgggtaccccttaccccgtacggtaacccctacgtttacccgttacccgtttaacgtaacccgttaacccgtacgggtaccgttaacgggaaccggggtaccgggttaccgggaccgtttaacggtaaccggttttactttaaacggttttcggaccctaacggttacccttaaaccgtactttaaaaccgttacgttacggtaaacgttaccgtaaaggtttcggtaaccgttaaacccgtcggttacgggttaccgttcggggtttaccggggaacggggttaccggtaacccgtaaagggtttcccgtaacccggttccggttaacggacccgaaacggtcccccggtaaacggttccccgg

SEQ ID NO: 83783 - DNA, 606 bp, Homo sapiens
  misc_feature: GYAE6OF01DH4D6.36.23.C01.1.454.CMB.1.raw
  modified_base (259)..(259): a, c, t, g, unknown or other
  misc_feature (259)..(259): n is a, c, g, or t
  modified_base (270)..(271): a, c, t, g, unknown or other
  misc_feature (270)..(271): n is a, c, g, or t
  modified_base (389)..(389): a, c, t, g, unknown or other
  misc_feature (389)..(389): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctctcactcagggcacagggtcctgggcccagtctggcctgacacagcctgcctccgtgtctgacgacctccgtggacagtcgaatcaccatcctcctgcactggaaccagcagtgacgttggtgcttatattatntctctgtcacnncatcagcagccgacccgaactcttaatttagtgtacggttcttccggtcgcccgttcgtagggttctacgtctcgttccgtcgtcctactaagtcgtacgactaccgccgtccctccncacctactcctactacgtactcgagtcgtacggaggcggagtcgtacgtacttatttagtcgtcacgtactactaacgttataccgtagtaacgttactaagttacgtactcccgtagtcggtcgtacggggttaccggacgggtacgggtaaccgttacgggttccgtaacccggtaccggttaaccgtaccgaaccggtcccgaacgggtccccg

SEQ ID NO: 83784 - DNA, 787 bp, Homo sapiens
  misc_feature: GYAE6OF01BT7AS.36.23.C01.1.454.CMB.1.raw
  modified_base (210)..(210): a, c, t, g, unknown or other
  misc_feature (210)..(210): n is a, c, g, or t
  modified_base (229)..(229): a, c, t, g, unknown or other
  misc_feature (229)..(229): n is a, c, g, or t
  modified_base (255)..(255): a, c, t, g, unknown or other
  misc_feature (255)..(255): n is a, c, g, or t
  modified_base (272)..(272): a, c, t, g, unknown or other
  misc_feature (272)..(272): n is a, c, g, or t
tcagtacgctgtctcacgaccggtgctcgatttagtacacgtgattagggagttggggggggtctcaggaggcagcgctctcaggacatctccaccatggcctgggctctgctgctcctcaccctcctcactcagggcacagggtcctgggcccagtctggcctgacacagcctgcctccgtgtctgagctcctggacagtcgatcaccntctcctgccactggaaccngctagtgtacgttgtgcttataattntcgtctcctggtccaangctattcgaggcacgccgacccgtaaattctttaattagtgtaggttcctttccggtccggtccccgttaggtacggggtttcctacggttccgtccgtttcccgtacccggtcctttaccgtaacggttccgttacgggaaccctaaacccggtaccccgggtccccttacccccgttacggaaaccccttcgtttacccttacccggtttaaccgaacccccgtttacccgggaaacgggttccgttaacggggaaaccggggtacccggtaaggggtaccctttacggtaaaccttttaattttacggtttcggaccgttaaccgtaccctttaacgtaactttaaccgttaacggttaacgtaaacgttaccgtaaagttaccgggttaaaccttcccgtaacggttcgggtcccgtttaggggttccgggaccggggtaaacggtaacccgttaaacgggttccgtaacccggtaccgttacggtaccaccggtacccggaggtcccccg

SEQ ID NO: 83785 - DNA, 570 bp, Homo sapiens
  misc_feature: GYAE6OF01DYDDK.36.23.C01.1.454.CMB.1.raw
  modified_base (229)..(229): a, c, t, g, unknown or other
  misc_feature (229)..(229): n is a, c, g, or t
  modified_base (243)..(243): a, c, t, g, unknown or other
  misc_feature (243)..(243): n is a, c, g, or t
  modified_base (266)..(266): a, c, t, g, unknown or other
  misc_feature (266)..(266): n is a, c, g, or t
  modified_base (295)..(295): a, c, t, g, unknown or other
  misc_feature (295)..(295): n is a, c, g, or t
  modified_base (349)..(349): a, c, t, g, unknown or other
  misc_feature (349)..(349): n is a, c, g, or t
  modified_base (358)..(358): a, c, t, g, unknown or other
  misc_feature (358)..(358): n is a, c, g, or t
tcagtacgctgtctcacgaccggtgctcgattagtacacgtgattagggagttgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggncttatatatgtctctgtccacancatcagcagccgacccgaatcttaattangtagtctttcgtcgcctgtgggttctagtcgcttcgccgtctcagtctgcaacncggcctccngaccatctctacgacttccaggctaggaggacgaggctgtaacttagttatgacagtctcattactacgtagaacgttcaagttggtaactaccgtacgtcgggtacgttcgggttccgggacgggtaacgggtacccgtaaacgggtttccggaaaccccggttcccggttaacgggtacccgaacccgggtaccccgtaagggtcccccg

SEQ ID NO: 83786 - DNA, 716 bp, Homo sapiens
  misc_feature: GYAE6OF01BFOHQ.36.23.C01.1.454.CMB.1.raw
  modified_base (271)..(271): a, c, t, g, unknown or other
  misc_feature (271)..(271): n is a, c, g, or t
  modified_base (504)..(504): a, c, t, g, unknown or other
  misc_feature (504)..(504): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgccctccgtgtctgagacctccgtggacagtcgatcacatctcctgcatcggaaccagcagtgtacgttgtgtcttataattatcgtctctgtaccangctattcagcagccgacccgtaaactcttaatttagtgtacgttctttcgtccgtccgtacggtacgggttctaggtccgtcgttccgtccggtctccgtaactcgtcgaccaacgaccgtcctacccacgtaccctacttccttcgtaacgtcctacccgtacgggtaccgttagggaacgggtaccggtacgggtacgttacgtaacgtttacttaacggtttcggaaccnggttacctacgtaacttacgttaaccttaaggtaacgttaacgtaaaggttcggttaacctcccggttacggttccgggtaccgttttcggggttcccggggtaacgggggtaaccggggtaacccgttaacgggttacccgggttaacccccggtttacggtacccgggttaaccggacccgtaaccccgggtacgggttacccccccggg

SEQ ID NO: 83787 - DNA, 690 bp, Homo sapiens
  misc_feature: GYAE6OF01CQ7OZ.36.23.C01.1.454.CMB.1.raw
  modified_base (233)..(233): a, c, t, g, unknown or other
  misc_feature (233)..(233): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgacgactcctggacagtcgatccaccatcctcctgccactggaaccngcagtgacggttggtgtcttataattatcgtctccgtcggttaccaacagctattcaggcacgccgacccgtaaactctttaatttagtggtacgttcgtttccggtcggtcccgttacgtacgggtttctacgtcgtccttaccgtccggtcctcgtacgtcgtcggacctaaccgtcccggccctcccgtacgacctactccgtcttaccgtacctacccgtaggtcgacggaacgggacgacgggtcttaacgtacgtttattacgtcgtacgtacgtcttaccgtaagttacgttaacgttaagtaagttaccgtaagttacgtaaccgtaccgtccgttacgggttcgtacgggttccgggtacggggtaaccgggtacccgttaacgggttaaccggtacccgttaaccggtacggtacccgaacccggtacccggtaaccggggtccccg

SEQ ID NO: 83788 - DNA, 537 bp, Homo sapiens
  misc_feature: GYAE6OF01CILOA.36.23.C01.1.454.CMB.1.raw
  modified_base (227)..(227): a, c, t, g, unknown or other
  misc_feature (227)..(227): n is a, c, g, or t
  modified_base (365)..(365): a, c, t, g, unknown or other
  misc_feature (365)..(365): n is a, c, g, or t
  modified_base (374)..(374): a, c, t, g, unknown or other
  misc_feature (374)..(374): n is a, c, g, or t
  modified_base (419)..(419): a, c, t, g, unknown or other
  misc_feature (419)..(419): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttgtgcttataattatgtcttcctggttccaacagcattcaggcagccgaccccgaaactcttaatttatgtaggttctttcgtcggcctcgtagggtttctgtcgcttcgtccggctcagtctgcacncggcctccngaccatctctacgactccgagctggacggacgagctagactattnttgcagtctcatactactagaagttcaagtggtaactccgacgttcggcttcgggttcggacgggtacgggaccgtaaggttccgaccgttccgtaggtacacggcccgaaggtcccg

SEQ ID NO: 83789 - DNA, 529 bp, Homo sapiens
  misc_feature: GYAE6OF01E1FS9.36.23.C01.1.454.CMB.1.raw
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaatttatgtaggtctttcgtcggtccctcagggtttctagtcgcttctccggctccagtctggcacacggcctcctgaccatctctagacctcaggtctgaggacgaggctgactattacgttgcagtctcgatataacaagtagacagctacgtctcgtccttacggacgtcgggaccaaggtcacgttgtacccgttaggttaccagaccccaaggtccccaaacccccg

SEQ ID NO: 83790 - DNA, 595 bp, Homo sapiens
  misc_feature: GYAE6OF01C7ZGA.36.23.C01.1.454.CMB.1.raw
  modified_base (139)..(139): a, c, t, g, unknown or other
  misc_feature (139)..(139): n is a, c, g, or t
  modified_base (232)..(232): a, c, t, g, unknown or other
  misc_feature (232)..(232): n is a, c, g, or t
  modified_base (384)..(384): a, c, t, g, unknown or other
  misc_feature (384)..(384): n is a, c, g, or t
  modified_base (422)..(422): a, c, t, g, unknown or other
  misc_feature (422)..(422): n is a, c, g, or t
  modified_base (574)..(574): a, c, t, g, unknown or other
  misc_feature (574)..(574): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacngggtcctgggcccagtctggcctgacacagcctgcctccgtgtctagagtactcctggacagtcgatcaccatcctcctgcacgtcggaaccngctaagtcgtacgttggtgtacttataattatcgttcttccgtggttaccaacagctatttcgaggcacgccgaccccgtaattctttaaatttgtgtacggttctttcgtcgtccttgtagggttctagtcgtcttctccgctacacgtcnggcacgacgtcctcctcgacctatctctagcctcgagntacggagggtacgagtctagtactattacgtgacagtctataattacgtatagtaacgttctaagttcgtacgttaccgcgttggccggttagggttcccgggagggtaacggtacccttaagggttccgacccggttaacgtcgggaaccnccgtacccggtcgtaccccgg

SEQ ID NO: 83791 - DNA, 689 bp, Homo sapiens
  misc_feature: GYAE6OF01EGNBZ.36.23.C01.1.454.CMB.1.raw
  modified_base (228)..(228): a, c, t, g, unknown or other
  misc_feature (228)..(228): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctgttccaacagctattcaggcagccgaccccgaaattcttaatttatgtacggttctttcggtccggtcccttgtacgggtttctacggttcgtccttccgtcccggcttaccgtaacgttctacggaccaaccgtaccggtccctcccgtcgaccctacgttcctacctaacgtaccgtaccgaagggtcctagggaacgggaccgacgggtaccttacggtaacctttagtttacgttcgactacggtcttactaactttactaacgttagtaaaacttacctaaagttcgggttaacctacccgtacggttcggtccgtttacgggttaccggggtacgggtaacgggtaacccgttaacgggttaccgtaacccgggttccgttaacgggtacccgtaaccggtccccggtaaagggtcccccgg

SEQ ID NO: 83792 - DNA, 591 bp, Homo sapiens
  misc_feature: GYAE6OF01DN4UU.36.23.C01.1.454.CMB.1.raw
  modified_base (248)..(248): a, c, t, g, unknown or other
  misc_feature (248)..(248): n is a, c, g, or t
  modified_base (407)..(407): a, c, t, g, unknown or other
  misc_feature (407)..(407): n is a, c, g, or t
  modified_base (462)..(462): a, c, t, g, unknown or other
  misc_feature (462)..(462): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgccttccgtgtctgacgtactccgtaggacagtcgatcaccatcctcctgcactcgaaccagcagtgacgttgtntcttatattatgtctcctgttaccacagctattacgagcacgccgacccgtaattacttaattgtgtacgttcgttcgtccggtcctaggtacggtttctacgtcgtcttcgtccgctacgagtcgtacggccaacgtaccggccctaccgtcgacctntcctcacgtctccgtaggctacggaggaccgagtctacgtattagttagtcgacngtctactataactagtagtaactacttagtcgtactacccgtagtcggtacgttcggtccgggagggtaaccggtacgttaacggtcgtacccgttacggtaccggtacacccggtacgcggtcccccg

SEQ ID NO: 83793 - DNA, 663 bp, Homo sapiens
  misc_feature: GYAE6OF01EGAC9.36.23.C01.1.454.CMB.1.raw
  modified_base (231)..(231): a, c, t, g, unknown or other
  misc_feature (231)..(231): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagactccgtggacagtcgatcaccatcctcctgcactggaaccngcagtgacgttggtgtacttaataattatgtctcctggttaccaacagcattcgaggcagccgacccgaaacttcttaattgtcgggttctttcgtccggcccttgtagggttctagtccgtcttccgtccgtctccgaacgtcgttcggacaaccgaccggtccctccgtacgaccctactccttactaacgtacctaccgagggtctacgggacggaaccggacggtacccgtaacgtttacttagttcgacgtaacgtcctactaagttaacgttaacgtaaggtaacgttaacgtaaagttacggtacttacccgtacgttacggttcgttcgggttaccggggacgggtaacgggtaacccgtaagggttccgtaacccggttaccgtacggtaccgacgacccggacggtccgtcccgtcccccgg

SEQ ID NO: 83794 - DNA, 559 bp, Homo sapiens
  misc_feature: GYAE6OF01EQB2M.36.23.C01.1.454.CMB.1.raw
  modified_base (274)..(275): a, c, t, g, unknown or other
  misc_feature (274)..(275): n is a, c, g, or t
  modified_base (303)..(303): a, c, t, g, unknown or other
  misc_feature (303)..(303): n is a, c, g, or t
  modified_base (379)..(379): a, c, t, g, unknown or other
  misc_feature (379)..(379): n is a, c, g, or t
  modified_base (421)..(421): a, c, t, g, unknown or other
  misc_feature (421)..(421): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagacctcctggacaggtcgatcaccatcctcctgcacgtggaaccagcagtgacgttgtgtacttaataattatgtctctgtccaanntatcagcagccgacccaatcttaattangtagttcttcgcgacctgtagggtttcagtcgcttcgacgctacagtctgacaacgcgctcccgtgacctatcctntacgactcgagctagacggacgaggctagtacttattaatcnctagctactaatacgtagtagtaagtactaacgtagttacctacgtacgtacggtcttcgggttacggacggggttaacggaaccgtaagttccggaacccgttcgaacgggtacgacccgtacccggaacggtcccg

SEQ ID NO: 83795 - DNA, 589 bp, Homo sapiens
  misc_feature: GYAE6OF01BY6MI.36.23.C01.1.454.CMB.1.raw
  modified_base (265)..(265): a, c, t, g, unknown or other
  misc_feature (265)..(265): n is a, c, g, or t
  modified_base (267)..(267): a, c, t, g, unknown or other
  misc_feature (267)..(267): n is a, c, g, or t
  modified_base (277)..(278): a, c, t, g, unknown or other
  misc_feature (277)..(278): n is a, c, g, or t
  modified_base (280)..(280): a, c, t, g, unknown or other
  misc_feature (280)..(280): n is a, c, g, or t
  modified_base (283)..(283): a, c, t, g, unknown or other
  misc_feature (283)..(283): n is a, c, g, or t
  modified_base (286)..(286): a, c, t, g, unknown or other
  misc_feature (286)..(286): n is a, c, g, or t
  modified_base (303)..(303): a, c, t, g, unknown or other
  misc_feature (303)..(303): n is a, c, g, or t
  modified_base (488)..(488): a, c, t, g, unknown or other
  misc_feature (488)..(488): n is a, c, g, or t
tcagtacgctgtctcacgaccggtgctcgatttagtacacgtgattagggagttgggggggggtctcaggaggcagcgctctcaggacatctccaccatggcctgggctctgctgctcctcaccctcctcactcagggcacgagggtcctgggcccagtctggcctgacacagcctgcctccgtgtctgacgtcctccgtggacaggtcgatccaaccattcctcctgcacgtggaaccagcagtgacgttggtgcttataattntntctctgtcanncntcngcncgcaccaatcttaattngtacgttcttcgtcgcctcgtggttctgtcgtcttcgccgtctacagtctcggacacgccggtccctccgtacgacctacttctacgtacgaccttcccgaggtccgacggtaacgggacggtacgggtcttaggtaactttatttacgttcgacttacgctactaattacgtactagaacgttnaacgttcgaacttcgacgttcgggtcgttcgggtcggagggtacggacttaacgggttcgtacccggttcgtacggtaccaccggtaccgacgggtccccg

SEQ ID NO: 83796 - DNA, 638 bp, Homo sapiens
  misc_feature: GYAE6OF01EJGLP.36.23.C01.1.454.CMB.1.raw
  modified_base (239)..(239): a, c, t, g, unknown or other
  misc_feature (239)..(239): n is a, c, g, or t
  modified_base (255)..(255): a, c, t, g, unknown or other
  misc_feature (255)..(255): n is a, c, g, or t
  modified_base (285)..(285): a, c, t, g, unknown or other
  misc_feature (285)..(285): n is a, c, g, or t
  modified_base (427)..(427): a, c, t, g, unknown or other
  misc_feature (427)..(427): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcacctcagggcacgagggtcctgggcccagtctggcctgacacagccctgcccttccgtgtctggacgcctccgtggacagtcgatccaccatcctctgcacgtcggaaccngcagtgtacgttggtntacttataattatgtcctcgtcgttccaanagcattcgaggtcacgccgaccccgaacttcttaattactgtacgttcttcgtccgtcctgtacgggtttctacgtcgtcttccgtaccggtcctaccgtaagttcgtggaccaaaccgtccggtccctcccgtacgacctntcctacgtaagacctccgtaggtcgtaggaacgggtaccggtacggtctaggtacctttaagttacgttgacctagtcctacgtattaacgtacgttagaacgttactaagttacggtactaccgtagttacggtcgttcgggtcgggacgggaacggtaccgtaaacggttcgaacccgttcgtaacggcctacgtcccgaaggtccccg

SEQ ID NO: 83797 - DNA, 735 bp, Homo sapiens
  misc_feature: GYAE6OF01DBJ8N.36.23.C01.1.454.CMB.1.raw
tcagtacgctgtctcacgaccggtgctcgatttagtacacgtgattagggagttggggggaagaggaagactgacggtcctgtctcaggtgcagctgcagcagtcgggcccaggagtggtgaagccttcggagaccctcgtccctcacctgcgctgtgtcgtggacgcctcccgtcggcggagatgaagtggtggtaggttcgggtccgccgacggcccccgaaggggaacggggctggtaggttggagttggtagtaaaattaaagtggaacggaccgggggacaaccgaaactacaagtcgtaccgtcccgtacggacggggtaccgtaacgtccaaccgtaattacgtcgtacgacgaagaaccaaacgtaccaaaacgaaccctacttccctacccgtaggacggtcctacgtacctcgtcggtcgacccggccggtaccggacgtccggacctaataacgttagtttacgttggtcggtacgtaggtttacgttttacgacgtaggtacgttcgggtacggggtcgtacgtcggtagtcggtagggtacgaaggtactcgacgtctacgtctcctctcgacgtcccgtacgaaccgaccggtccctacgtcccgttccccgttccccgtcggtcccgtcccgtcggtccgtccggaggcccgtaccgtacccgaccggtacgaccgtacgaccggtaccggcccggtccggtcggtccgtcggtacccgg

SEQ ID NO: 83798 - DNA, 591 bp, Homo sapiens
  misc_feature: GYAE6OF01CVRV5.36.23.C01.1.454.CMB.1.raw
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (231)..(231): a, c, t, g, unknown or other
  misc_feature (231)..(231): n is a, c, g, or t
  modified_base (397)..(397): a, c, t, g, unknown or other
  misc_feature (397)..(397): n is a, c, g, or t
tcagtacgctgtctcacgaccggtgctcgatttagtacacgtgattagggagttggggggggtctcaggaggcagcgctctcaggacatctccaccatggcctgggctctgctgctcctcaccctcctcactcgagggcacgagggtcctgggcccagtctggcctgacacagcctgcctccgtgtctgagactccnggacngtcgatcaccatctcctgcactggaaccngcagtgacgttgtgtcttaataattatgtcttcctggttccaacagctattcaggcagccgaccccgaaatctttaatttatgacgtttctttcgcggccttggagggtttctagttcgctttcgccgtctccaagtctggcaacacggcctccctagaccatccnctagacctccgagctagaggacgagctacgacttattattcgcagtctactaataactacgtagtaacgtacgtaatggtactccgaacgtcgggtacgttcgggttaccggacgggtaacgggaaccgtaacggtttcggaaccccgtttccgtaacgggttcgaacccggtcccggaaacgggttcccccgg

SEQ ID NO: 83799 - DNA, 619 bp, Homo sapiens
  misc_feature: GYAE6OF01D9VEQ.36.23.C01.1.454.CMB.1.raw
tcagtacgctgtctcacgaccggtgctcgatttagtacacgtgattagggattgggggggggtctcaggaggcagcgctctcaggacatctccaccatggcctgggctctgctgctcctcaccctcctcactcagggcacgagggtcctgggcccagtctggcctgacacagcctgccctccgtgtctgacgacctcctggacaggtcgatcaccatcctcctgcacgtcggaaccagcagtgacgttggtgcttaataattatgtctccttgttccaacagcattcaggcacgccgaccccgtaaacttctttaatttatgtaggttctttcggtccggtcctgtagggtttctacgtcgtcttcgtccgtctctaagtcgtgacaaccgacggccctccgtcgacctcttcctactacgtcctcgacgtcgtaggacggacgacgtcgtatactttaattgttacgcagtcgtactattactaagttaagaacgttactaagttcggtacctaccgtacgtcggtacgttcgggttccggggaccgggtacgggtaaccgtaacggttcgaacccggttaccgacggttaccgaaccggtcccgtaacggtccccgg

SEQ ID NO: 83800 - DNA, 701 bp, Homo sapiens
  misc_feature: GYAE6OF01C5L7M.36.23.C01.1.454.CMB.1.raw
  modified_base (229)..(229): a, c, t, g, unknown or other
  misc_feature (229)..(229): n is a, c, g, or t
  modified_base (252)..(252): a, c, t, g, unknown or other
  misc_feature (252)..(252): n is a, c, g, or t
tcagtacgctgtctcacgaccggtgctcgatttagtacacgtgattagggagttggggggggtctcaggaggcagcgctctcaggacatctccaccatggcctgggctctgctgctcctcaccctcctcactcgagggcacgagggtcctgggcccagtcgtggcctgacacagcctgcctcgtgtctgacgctccgtggacaggtcatccacatctccgtgactacgnggaaccagcgagtgacggttggntacttaataattatgtctcgtcgtacaatagctattcgagcacgccgacccctaaattctttaaattagtggtacgttccgttcggtccggtcctggttaagggtttctacggtccgtcttccgtccggtctacgtaaggttcaggacctaaaccgccggtaccctacccgtacgtacctaacttccgtaacctacgtacctacccggaacggtccgtaagggaacgggtacggaacggtaccgtaggttaaccttaagtttacgtacgacgtacgtacctaagtaattaacgtaacgttacgtaaacgtacgtaaagttacggtaactacccggttacgtacggtccgttacggggtaccggggtaaccgggacgggttaaaccgttaacgggttaccgacccggttaccgtaacggtaccgacccggtaacccgaacgggttccccg

SEQ ID NO: 83801 - DNA, 814 bp, Homo sapiens
  misc_feature: GYAE6OF01BG8TC.36.23.C01.1.454.CMB.1.raw
tcagtacgctgtctcacgaccggtgctcgatttagtacacgtgattagggattgggggggggtctcaggaggcagcgctctcaggacatctccaccatggcctgggctctgctgctcctcaccctcctcactcgagggcacgagggtcctgggcccagtctggcctgacacagcctgcctccgtgtctgagacctccgtggacagtcgatccaccattcctcctggacctacgtacgggaaccagcgaggtcgtacgggtttggtagtttaattaagtttcgtcctcgtaggtaccaacgacgaccgacccgggacaacgtacccgaaccccctaaaagtcctaagttacgttaagttttacgacggtaacggttacctaaccgttaccgtaaccggttccccgggttacccgttacgggtttaaccggggttttaccttaacggttcccgttctttaccgttccgtacgtaccttaacgttaacccggtaacggtttccgtacggtaacccgtaacccggtaccccgggttaccccttacccggtaaccgtaccctacgttcccggtacggttccgggtaccctccgggacggtaccgtaggggaacgggtacccgtaagggttacctttaatttacggtttcgtacgtaccgttacgtttaccgaacttaaccgtaaccgaaccgtacgtaaccctaactccgttacgtacggttaccgttaccgggtacgggtaccgggaaccgggtaacaccggtactacccgtaaccgtacgtaccgtcgaacccgtaccgaccggtcccgtaccccgg

SEQ ID NO: 83802 - DNA, 818 bp, Homo sapiens
  misc_feature: GYAE6OF01EWE1E.36.23.C01.1.454.CMB.1.raw
  modified_base (232)..(232): a, c, t, g, unknown or other
  misc_feature (232)..(232): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacgagggtcctgggcccagtctggcctgacacagcctgcctccgtgtctgagacctcctggacagtcgatcactatcctcctgcacgtggaaccngcagtgacgttggtgcttataatatgttcctcctggttaccaacagctagttcgaggcacgccgaccccgtaaacttcttaatttagtgtacggttccgtttcgtccgtccccttcggtacgggtttctacgttccgtaccgtttccgtccggtccttcccgtaaacggttccgtacggtacccgaaacccgtaccggcccccgttaccccgtacggtaaccctaccgttcccgttaccgttaaccgttaccccgtacccgggtaacgggtaccccgttaggggaaaccgggggtaacccggtaacggggttacccgtaacgggtttaaacccttttaagtttttaaccggtttcgaacccgttacggtacccttacttaaacgtttaaacgttaaccgttaacggtaaaacggtttccgtaaagtttaccgggtaaccttacccgtaaacggttccgggttaccgtttacggggttacccggggaggggttaacccgggtaaccggttaaacggtttacccgggaaacccggtttcccggtacggttaacccgaacccgggttcccgtaaacgggttccccccgg

SEQ ID NO: 83803 - DNA, 689 bp, Homo sapiens
  misc_feature: GYAE6OF01CUGRE.36.23.C01.1.454.CMB.1.raw
  modified_base (188)..(188): a, c, t, g, unknown or other
  misc_feature (188)..(188): n is a, c, g, or t
  modified_base (198)..(198): a, c, t, g, unknown or other
  misc_feature (198)..(198): n is a, c, g, or t
  modified_base (214)..(214): a, c, t, g, unknown or other
  misc_feature (214)..(214): n is a, c, g, or t
  modified_base (241)..(241): a, c, t, g, unknown or other
  misc_feature (241)..(241): n is a, c, g, or t
  modified_base (273)..(273): a, c, t, g, unknown or other
  misc_feature (273)..(273): n is a, c, g, or t
  modified_base (311)..(311): a, c, t, g, unknown or other
  misc_feature (311)..(311): n is a, c, g, or t
tcagtacgctgtctcacgaccggtgctcgatttagtacacgtgattagggagttgggggggggtctcaggaggcagcgctctcaggacatctccaccatggcctgggctctgctgctcctcaccctctcactcagggcacagggtcctgggcccagtctggcctgacacagcctgcctcgtgtctganactctggacngtcgatcacatctccngcactggaaccagcagtgacggttggngtcttataattatgtcttccgtgttaccaacngctattcgaggcacgccgacccgaacttcttaatttangtacggttctttcggtccggtcccgttacggtaggggttttcctacggttcgtcctttccgtcccggtccttaccgtaacgttcgtacgggaccaaccgacccggtcccttcccgtacggacccttacttccgtaccgttaaccgaccgttacccgagggtaccgtacgggaacgggtaccggacgggtcttacggtaactttatttcgttacgactaccggtcttactaacgttactaacgttagaacgtttaacgtaacgttcggtaaacctccgtacggttcggtacgtttcgggtaccgggacgggtaacgggtacctaacgggtttcgaccccgttacggtacggtaccgaacggtcccgtaagggtcccccg

SEQ ID NO: 83804 - DNA, 782 bp, Homo sapiens
  misc_feature: GYAE6OF01EUHYT.36.23.C01.1.454.CMB.1.raw
  modified_base (235)..(235): a, c, t, g, unknown or other
  misc_feature (235)..(235): n is a, c, g, or t
tcagtacgctgtctcacgaccggtgctcgattagtacacgtgattagggattgggggggggtctcaggaggcagcgctctcaggacatctccaccatggcctgggctctgctgctcctcaccctcctcactcagggcacgagggtcctgggcccagtctggcctgacacagcctgcctccgtgtctgagactcctggacagtcgatccacctatcctcctgcacgtacggaaccngcaggtcgtacgttggtgtactttaagtaattatcgttccttccgttcggtttacccaaacgacgtactacgtttacggaacggtccgaaccggtaccccggtaacccccggtaaaacttttaccgttttaaaagttttacggtacgggtttaaccgggtttccgttttacccgggttcccgggtaccccgtttacgggtttaaccggggtttccttaacgggttccggttaccgtttcccgtaccccggtacttacccggtaacggttccgtacggacctaaacccggcccggtaccctcccgtaccgaaccttacgtccttaccgtacgtaccgtaccgaggtcgtacggaacgggacggtacggcttaacggtactttattacgtcgtaccgacgtccttactaattacgtaacgtaagtaactacgtaacgttacggtaccttaccgacgttacggtcgttcgggtaccgggagggtacggtaaaccgtacggttaccggtacccggttcggttacggaccgacggacccgtaaggtccccgg

SEQ ID NO: 83805 - DNA, 861 bp, Homo sapiens
  misc_feature: GYAE6OF01DVMEI.36.23.C01.1.454.CMB.1.raw
  modified_base (250)..(250): a, c, t, g, unknown or other
  misc_feature (250)..(250): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcgacgggcacgacgggtcctgggcccaggtctcggcctgacacgagcctgccctccgtgtctgacgtactccgtggactagtcgactccaaccattccgtcctgcctaacgcggaaccngcgaggtcgtacggttggtagtactttaataattagtgttccttccgttacggttacccaacgtacgtactacgttacgaacggtccaacggtaccccgtaccccggttaaaacttaccgtttttaacgttttaacgttacgggttaccggttttccgtttccgggttacccggtccccggtttacggtttacggggttttaccttaccggttccggttccgtttacccggtcccggtaaccctttaccggtaaacgttcccggtacgggaaccctaaaccggtaccccggttaccccttaccccgttaacgaacccgtttaaccttcccgttaacgttaaccggtacccgtaccgacgggttaccggtacgggaaccgggtaccgggtacggttcctacgggttaaactttaacgtttacggtacgtacggtacctacgttaacgttaataacttaacggtacggtaaagttacgtaagttacgggttaacctccggtaggttaccgtgggtttccgggtcgggtaaccggggtaacggtaaccggttaaccggttaccgtacccggttaacggttacggaccgtaccgggtacccgacgggttcccccg

SEQ ID NO: 83806 - DNA, 788 bp, Homo sapiens
  misc_feature: GYAE6OF01COQ6P.36.23.C01.1.454.CMB.1.raw
  modified_base (235)..(235): a, c, t, g, unknown or other
  misc_feature (235)..(235): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctagacgactccgtggacagtcgatccacctatcctctcgcacgtggaaccngcgagtgtacggtttgtagtactttaataactttagttcgttcctaccgttcggttaccaacgtacgctacgttcgacggcgaaccggcccgaaccccgtaaacttcttttaaagtttgtaggttacgtttccgttttccgggacccgtccgttaggttacggggttttcctacggttccgtacctttccgccggtacttaccgagtcgtacggactaacccggtaccggtccttcccgtactacctgttaccctacgttaaccgtaccgtccggtaacggtcggtaacggaacgggaccggtacggtaccgtacgttaaccttttaagttacgttcgacgtacgtacttactaacttacgttaccggttagtaaaccgtttacgtaaaggttcgtaaccgttccgtacggtaccggggttccgttacgggggttacccgggtaacggggttaaaccgggggtacccgttaaaccggggtttcccggtaaccccgggttaccggttaacccgggtacccgaaaccgggtccccggtaaaccggttcccccggg

SEQ ID NO: 83807 - DNA, 715 bp, Homo sapiens
  misc_feature: GYAE6OF01A00X5.36.23.C01.1.454.CMB.1.raw
  modified_base (232)..(232): a, c, t, g, unknown or other
  misc_feature (232)..(232): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacgagggtcctgggcccagtctggcctgacacagcctgcctccgtgtctgacgactcctggacagtcgatccaccatctcctgcacgtcggaaccngcaggtgacggttggtgtacttattaatttagtgtccttccgttcggttacccaaccgaggtactaacgtttccgacggccgaacggacccggtaacccccgtaaaactttaccttttaaagtttttaagtacggttacggtttccgttttccgggtccggttaccccgttcggttacggggttttctacggttccgttccgttccgtcccggtcctacccgtaacgtccgtacggaccaaccgtaccggtcccctcccgtacgtaccctactcctaccgtacgtacccgtcgtacggtacgtacgggacggacggtacggtcgttagtaacctttagttacgttcgacctacgtctaactactacgtacgtagtaagtactaacgtgtactcgtacgtcggtacgttcgggtccggagggtaccggtaccgtaggttccgaccggtttacacgggtaaccgaccggtcccgaacggttcccg

SEQ ID NO: 83808 - DNA, 773 bp, Homo sapiens
  misc_feature: GYAE6OF01CRJXW.36.23.C01.1.454.CMB.1.raw
  modified_base (144)..(144): a, c, t, g, unknown or other
  misc_feature (144)..(144): n is a, c, g, or t
tcagtacgctgtctcacgaccggtgctcgatttagtacacgtgattagggagttgggggggggtctcaggaggcagcgctctcaggacatctccaccatggcctgggctctgctgctcctcaccctcctcactcgagggcacgngggtcctgggccctagtctggcctgacacagcctgtcctccgtgtcgtgagacctccgtggacaggtcgactccacctatcctcctgcctacgtacggaaccagcgagtggtacgttggtcgtacttattaattatcgttccttccgttacggttaccaacacgtctattcgacggaccacgcccgtaacccgtaacttactttaactttagtcgtagtttccgtttaccggtcggtcccgttaggttacgggtttctacgttccgtcctttcccggtaccgtcgtaccgtagttccgtacggaccctaaccgacccggtccctaccccgtagtaccctacttacctcgtaccgtaccctcgtaacggtcgtaggaacggccgtaggtccgttaacgtaacgtttacgtttaagttcccggactaccggttacttaacgttaacgttaacgttaacgttacggtaagttaaccgtaaggttcggtaaccttaccggtacggttcgggttaccggtttacgggggtccgggtaaccggggaaccgggttaaccgtaacgggttaccccggtaacccgttacggtaacggtacccggtaacccggtaacccgggacccggttacccccggg

SEQ ID NO: 83809 - DNA, 618 bp, Homo sapiens
  misc_feature: GYAE6OF01A4S32.36.23.C01.1.454.CMB.1.raw
  modified_base (228)..(228): a, c, t, g, unknown or other
  misc_feature (228)..(228): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctctgcactggaaccngcagtgacgttggtgcttataattatgtctcctggttccaacagcattcaggcacgccgacccgaaactcttaatttatgagttctttcgtccggtcctgtacgggtttctacgtcgtccgttctccggtctccaagtctcggaccaacgtccggtccctcccgtagaccctattcctactagtaccctccgaggtctggtaacggacggcggtacttaggtaccttaagttacgttcgactaagtcttacgtaattacgtactaggtaagtacctaagttcggtacttaccgacgttcggcgttcgggttaccggtcgggaacggggtaccctaagggttaccgacccggttccgttacgggttacaaccggtcccggtaacggtcccg

SEQ ID NO: 83810 - DNA, 549 bp, Homo sapiens
  misc_feature: GYAE6OF01EM43F.36.23.C01.1.454.CMB.1.raw
  modified_base (228)..(228): a, c, t, g, unknown or other
  misc_feature (228)..(228): n is a, c, g, or t
  modified_base (272)..(272): a, c, t, g, unknown or other
  misc_feature (272)..(272): n is a, c, g, or t
  modified_base (306)..(306): a, c, t, g, unknown or other
  misc_feature (306)..(306): n is a, c, g, or t
  modified_base (343)..(343): a, c, t, g, unknown or other
  misc_feature (343)..(343): n is a, c, g, or t
  modified_base (359)..(359): a, c, t, g, unknown or other
  misc_feature (359)..(359): n is a, c, g, or t
  modified_base (366)..(366): a, c, t, g, unknown or other
  misc_feature (366)..(366): n is a, c, g, or t
  modified_base (371)..(371): a, c, t, g, unknown or other
  misc_feature (371)..(371): n is a, c, g, or t
  modified_base (375)..(375): a, c, t, g, unknown or other
  misc_feature (375)..(375): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgtcttataattatgtctcctggttccaacngcattcaggcagaccgacccgaaattcttaattntgtagtctttcgcgcctgtagggtttctagtctctcnccgctcagtctgcacncgctccngaccntctnacgactccaggctagacggacgacggtctagtacttagtttatcgctagtcttcaattacgtactaggtaacttactaatcggtaactccgtacgtcggtccttagggtccggtacgggacggtaccgtaaggttcgaacccgttcgtacggtccacggtacccgaggtccccg

SEQ ID NO: 83811 - DNA, 680 bp, Homo sapiens
  misc_feature: GYAE6OF01DA703.36.23.C01.1.454.CMB.1.raw
  modified_base (337)..(337): a, c, t, g, unknown or other
  misc_feature (337)..(337): n is a, c, g, or t
  modified_base (567)..(567): a, c, t, g, unknown or other
  misc_feature (567)..(567): n is a, c, g, or t
tcagtacgctgtctcacgaccggtgctcgattagtacacgtgattagggagttggggggggtctcaggaggcagcgctctcaggacatctccaccatggcctgggctctgctgctcctcaccctcctcacctcagggcacgagggtcctgggcccagtctgccctggctcagcctgcctccgtgtctggtctccgtggacagtcgatcaccatcctcctgctactggaaccagctagtggtacgtttggtaggtttattaaagttttcgttcctccgttacggtaaccaacacgccgaccccgggcaacgtccgaccccaaaatcatacgtatttanggtacggtacactactgtccggccctacgtagggtttctaagttccgtcttctactgacctactacacgtcgtcggtaccaacgaccggtccctccctacgaaccctcgttaccgtccggtggtcctacccgtaggtccgtaggacggaccggtaggtacctttaagttttactttcttcggacttacgttactacttaacctaactaaccgagtacctaactacccgtntacggtacttacggccgggtacgggaaccgggaacctaggtaccgtcgggtaccccgtacggttaaccgttaccgaacccgtacccggaacgtcccgtccccgtacccccggg

SEQ ID NO: 83812 - DNA, 565 bp, Homo sapiens
  misc_feature: GYAE6OF01CEQG6.36.23.C01.1.454.CMB.1.raw
  modified_base (228)..(228): a, c, t, g, unknown or other
  misc_feature (228)..(228): n is a, c, g, or t
  modified_base (371)..(371): a, c, t, g, unknown or other
  misc_feature (371)..(371): n is a, c, g, or t
  modified_base (431)..(431): a, c, t, g, unknown or other
  misc_feature (431)..(431): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcacatctcctgcactggaaccngcagtgacgttggtgcttataatatgtctcctggttccaacagcattcaggcagccgaccccgtaaactcttaatttatgaggttctttcgtcggcctcgtagggtttctagtcgcttcgtccggctccaagtcctggcaacncggcctcctgaccatctctagctccaggctgaggacgaggctagactattattgcagctnatatactgaagtctaatggtaactccgaacgtggtacgttggttcccgggacggggtaacgggtaccctaaagggtttccggaaccccggtttcgtaacgggttaccaaccgggtaccccgtaaagggtccccg

SEQ ID NO: 83813 - DNA, 681 bp, Homo sapiens
  misc_feature: GYAE6OF01AGXWZ.36.23.C01.1.454.CMB.1.raw
  modified_base (609)..(609): a, c, t, g, unknown or other
  misc_feature (609)..(609): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacgagggtcctgggcccagtctggcctgacacagcctgcctccgtgtctgagacctcctggacagtcgatccaccatcctcctgcacgtaggaaccagcaggtgtacggtttggtcgtactttaattaaatttattcgttccttcccgttcggtttacccaaacgacgctattcgaggcacgcccgaccccgtaaacttctttaatttacgtgtacggtttcgtttccgtcccggtcccttacggtagggttttcctacggtccgttcgttcccgtccggtccctaccgtaacgttcgtacggaccaaacccgtcccggtccccttcccgtacgtaaccctactttccctaccgttaacgtaccctaccggacggtcctaagggacggtacggacggtcttaacggtaacttaatttacgttcgaactgtctactaattactacgtaagtacgtactaagtcgtaactacgngttcggtcgttcggtcgggacggaacggtactaacgggttccaccggtacgtagaccgcgaccgcggtcccg

SEQ ID NO: 83814 - DNA, 751 bp, Homo sapiens
  misc_feature: GYAE6OF01EBPYY.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctcctgcactggaaccagcagtgtacgttggtgcttagtaattatgtctcctggttaccaacagctattcaggcagccgaccccgaaattcttaatttatgtaggttctttacgtcggtccgttcgtacggggtttctacggttccgtctttccgtccggtccttaccgtaaggttccgtacgggacccaaaccgtaccgggtccccttaccccgtacggtaaccctaacgttccgttaccgtaacgtaccccgttacccgtaagggtccttaacggggaacggggtaaccggtaacggggtcctttaacgggtaaaccttttaacgtttaacgttcggacctaacggtccgttactaaattacttaaccgtaaggttaaacgttaacgaagtttacggtaaccttaccgtacggttcgggtaccgtttcggggtttaccgggaccggggtaaacggggtaaccttaaacgggttccggtaaaccccggttccggttaaacgggtacccaacgggtcccccgtaaagggttccccccgg

SEQ ID NO: 83815 - DNA, 651 bp, Homo sapiens
  misc_feature: GYAE6OF01CI58A.36.23.C01.1.454.CMB.1.raw
  modified_base (228)..(228): a, c, t, g, unknown or other
  misc_feature (228)..(228): n is a, c, g, or t
tcagtacgctgtctcacgaccggtgctcgattagtacacgtgattagggattgggggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatctcctgcactggaaccngcagtgtactttggtagtaacaatcatgtctcctaggtaccaacgagtacccaggacaaacgaccccaaactcatctattttcgacgtcggtacgtcgcctatacggtaatttactaatcgtcttctctcggcctacaagtctacgaccaacaccggtcctccctcgacctactcctcgtcgggcctaccgacgtccgtagacggacgaggtctagtaactttacttacttcgttcctactaactactacgaacggtccggtaagttacgttcggttccgtttaccggggcccgggtaccggtaccccgtaccgtaccggtacccggttaccggtaccggtaccgaccggccccgtaacggtcccttccccggtccccccgttacggttaccttacccgttcccgttccccggttaccccccg

SEQ ID NO: 83816 - DNA, 728 bp, Homo sapiens
  misc_feature: GYAE6OF01AHV4C.36.23.C01.1.454.CMB.1.raw
  modified_base (237)..(237): a, c, t, g, unknown or other
  misc_feature (237)..(237): n is a, c, g, or t
  modified_base (252)..(252): a, c, t, g, unknown or other
  misc_feature (252)..(252): n is a, c, g, or t
  modified_base (286)..(286): a, c, t, g, unknown or other
  misc_feature (286)..(286): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcgagggcacgagggtcctgggcccagtctggcctgacacagcctgcctccgtgtctgacgactccgtggacagtcgatccaccatcctcctgccacgtcggaaccngctagtgacgttggngtcttataattatcgtctccgtggttaccaacgngtctattcgaggccacgcccgaccccgtaaattctttaattagtggtacgttctttccggccggtcccttggtacgggtttcctacgttccgtccgtttccgtcccggtctaccgtagtccgtacggacctaaccggccgtcccctcccgtacgaaccctcgttcctacgtaacgaccgttccgacgggtccttagggaaccgggtaccggacggttccgtacggttaactttacgttacggttcgacctacggtcccttaacgtaacgttaaccgtaccgttaaggtaactttacgtaaacgttcgtaaccttccgaccggttggtaccggtttcgggttaccggggaaccgggttaacggtaacccgttaacgggttcccgtaacccggttaccgttaacggtacccgtacccggtaaccgggtaccggttacccccggg

SEQ ID NO: 83817 - DNA, 585 bp, Homo sapiens
  misc_feature: GYAE6OF01D3LF1.36.23.C01.1.454.CMB.1.raw
  modified_base (228)..(228): a, c, t, g, unknown or other
  misc_feature (228)..(228): n is a, c, g, or t
  modified_base (242)..(242): a, c, t, g, unknown or other
  misc_feature (242)..(242): n is a, c, g, or t
  modified_base (263)..(263): a, c, t, g, unknown or other
  misc_feature (263)..(263): n is a, c, g, or t
  modified_base (265)..(265): a, c, t, g, unknown or other
  misc_feature (265)..(265): n is a, c, g, or t
  modified_base (270)..(270): a, c, t, g, unknown or other
  misc_feature (270)..(270): n is a, c, g, or t
  modified_base (295)..(295): a, c, t, g, unknown or other
  misc_feature (295)..(295): n is a, c, g, or t
  modified_base (394)..(394): a, c, t, g, unknown or other
  misc_feature (394)..(394): n is a, c, g, or t
  modified_base (411)..(411): a, c, t, g, unknown or other
  misc_feature (411)..(411): n is a, c, g, or t
tcagtacgctgtctcacgaccggtgctcgatttagtacacgtgattagggagttggggggggtctcaggaggcagcgctctcaggacatctccaccatggcctgggctctgctgctcctcaccctcctcactcagggcacagggtcctgggcccagtctggcctgacacagcctgcctccgtgtctgacgactcctggacagtcgatcaccatctctgcactggaccngcagtgacgttgtncttatatatgtctctgtacananctatnagcacgccgaccctaattctaattngtagtcttcgccgtctgtaggttcagtcctcttctcgctacagtctgacacgtcgcctcgtcgactgtcttacagtacctcgagtcgtagacggtacgngcttagtaactatttancgacgtactcgtaactaacgttacgtacgtacgtaaacttacgtaagttacggtaactacccgtacggttacggtccgttacgggtccgggtaaggggaaaccggttacccgttaaacgttcggtaacccgtaccgttaagggtaccccaacgggtaccccgaaggttcccccg

SEQ ID NO: 83818 - DNA, 571 bp, Homo sapiens
  misc_feature: GYAE6OF01BU8BQ.36.23.C01.1.454.CMB.1.raw
  modified_base (270)..(270): a, c, t, g, unknown or other
  misc_feature (270)..(270): n is a, c, g, or t
  modified_base (303)..(303): a, c, t, g, unknown or other
  misc_feature (303)..(303): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaangcattcaggcagccgacccgaattcttaatttntgtagttctttcgtcgccctgtagggtttcagtcgtcttcgtccggctcgagtctggcaacgtacggccctcctcgacctatctctacgacctccgaggctggacggaccgaggtcctagtaacttattattcggactacgtctcaattactacgtagtaacgtactaagtggtactccgtacgttggtacgttgggtcggtacgggaacgggtaccgtaaggttccgacccggttcgtacgggtaccgacgtcccgaagggtccccg

SEQ ID NO: 83819 - DNA, 790 bp, Homo sapiens
  misc_feature: GYAE6OF01A6K1B.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagacctcctggacagtcgatcaccatcctcctgccactacggaaccagcaggttgacggtttggtgtctttaataattactcgttccttccgtcggtttacccaaacgacgacctattcgacggccacggcccgaccccgtaaaacttctttaatttacgtggtacggttcctttcggtccggtcccgttcggtaacggggtttctacggttccgtctttccgtccggtactacccgtaacgttcgtacggaccaaccgtaccggtccctacccgtacgaccctacgtccttaccgtacgtacccgtccgtaggtccgtacgggaacgggtaccgacggtacttacgtaaccgtttatttacgtacggtaccaacggttcctaacgtaacttaacgttaaccgttacgtaacgttaacgttaacgttacgggttaacccttacccggtaacgttcccgggttacggttaccgggtttaccgggggtaccgggttaaacgggggtaaaccccgtttaaggggtttaccccggtaaccccgggtttaccccggttaaacgggtacccgtaacccgggtaccccggttaaaccggggttccccccgg

SEQ ID NO: 83820 - DNA, 739 bp, Homo sapiens
  misc_feature: GYAE6OF01AM717.36.23.C01.1.454.CMB.1.raw
  modified_base (239)..(239): a, c, t, g, unknown or other
  misc_feature (239)..(239): n is a, c, g, or t
  modified_base (657)..(657): a, c, t, g, unknown or other
  misc_feature (657)..(657): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcaggacacgagggtcctgggcccagtctggcctgacacagcctgcctcgtgtctgagcctccgtggacagtcgactccacctatcctcctcgaccacgtacggaaccngcgtacggtcggtacggtttggtacgtacttttaagttaatttactcggttccttccgttacggttacccaaagtcgctacgttcgacggtaccacggcccgtaaaccccgtaaatttacgtttaaatttacggtacggtacggtttccgtttcggtacccggtcccgttacggttacggggttttcaacggttccgtcctttccggtcccggtacttacccgtaagttccgtacgggtacctaacccgtcccggtacccttccccgtagaaacccttcgttcccgtacgtaaccgccgttacccgagggtcgtacgggaacggtacggtaccggtcgttacttacgtttagttacgtcgatacgcttaacgaattacggtactaggtaactctaaggttcgtactccgtgttacggngtacgggttaccggggaggtaccggtaacttaccgggttccgaaaccgttcgacggtaccaccgggtccgtaacgtccccgg

SEQ ID NO: 83821 - DNA, 535 bp, Homo sapiens
  misc_feature: GYAE6OF01ESHC3.36.23.C01.1.454.CMB.1.raw
  modified_base (391)..(391): a, c, t, g, unknown or other
  misc_feature (391)..(391): n is a, c, g, or t
  modified_base (426)..(426): a, c, t, g, unknown or other
  misc_feature (426)..(426): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctgttcaacagcattcagcagccgccccgaaactcttaatttatgtaggtctttcgtcggccctcgtagggtttctaggtcgcttcgtccggctccaagtctggacacacggcctcccgtgaccatctctanactcgagctagacggacgaggctagacttaacttntagcagctctatatactagaacgttcaagtggtactcctacgttcggcttgggtcgggaggacgggtacaaggttcgacccgttctacggtccacgcccgaagggtccc

SEQ ID NO: 83822 - DNA, 684 bp, Homo sapiens
  misc_feature: GYAE6OF01B2SB3.36.23.C01.1.454.CMB.1.raw
  modified_base (211)..(211): a, c, t, g, unknown or other
  misc_feature (211)..(211): n is a, c, g, or t
  modified_base (230)..(230): a, c, t, g, unknown or other
  misc_feature (230)..(230): n is a, c, g, or t
  modified_base (276)..(276): a, c, t, g, unknown or other
  misc_feature (276)..(276): n is a, c, g, or t
tcagtacgctgtctcacgaccggtgctcgattagtacacgtgattagggattgggggggggtctcaggaggcagcgctctcaggacatctccaccatggcctgggctctgctgctcctcaccctcctcactcagggcacgagggtcctgggcccagtctggcctgacacagcctgcctccgtgtctgagactcctggacagtcgatcaccntctcctgcacgtggaaccngcagtgtacgttggtgtcttataattatgtcctccgtggttccaanagctattcgaggcacggcccgacccgtaaacttctttaatttatgtacggttctttcggtccgcccttcggtacgggtttctacgtccgtacttccgtccggtactaccgtaagttccgtacggaccaaccgtccggtccccttcccgtacgaaccctacgttacccttaccgtaacgtaccctaccggacgggtctaaggggaacggaccggtaacgggtcctacggtaacctttaagttcgttacgcgtaacgtccttacgtaactttaacgtaccgtaaggtaaacgttacgtaaggttacgtaccttaccgtacgtcgggtacgttcgggtccgggggacggtaacgggtaacgtacggttaccggtaccgttcgtacggtaccaccggcccgtaaggtccccg

SEQ ID NO: 83823 - DNA, 716 bp, Homo sapiens
  misc_feature: GYAE6OF01DG51U.36.23.C01.1.454.CMB.1.raw
  modified_base (280)..(280): a, c, t, g, unknown or other
  misc_feature (280)..(280): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctctcactcagggcacagggtcctgggcccagtctggcctgacacagcctgcctccgtgtctgacgctctggacagtcgatcaccatctcctgcactcggaaccagcagtgtacggttggtgtctttaataattattgttccttccgttggttccaangctattcgaggcaaggccgaccccgtaaaacttctttaattttagtggtaacggttttccgtttccggtccggtcccccttaggttacggggttttctacggttccgtaccttttccgtccgggtccttaccgtaacggttctacgggacctaaaccgcccggtcccttacccgttacgaccctacttccgtaccttaacgaccttacccgaggtccgtagggaacggaccgtagggtcttacggtaactttagtttagtttcgacctagtcttacctaattacgttaacgtacgtaaacggttactaaggttcggttaaccttccctaaggttccgggtcgttacgggttccgggacgggttaacgggtaaccgttaaggttcccggtaacccgttccgttaacgggtcctaaccggccccgtaagggtcccccg

SEQ ID NO: 83824 - DNA, 634 bp, Homo sapiens
  misc_feature: GYAE6OF01B2RQD.36.23.C01.1.454.CMB.1.raw
  modified_base (215)..(215): a, c, t, g, unknown or other
  misc_feature (215)..(215): n is a, c, g, or t
  modified_base (227)..(227): a, c, t, g, unknown or other
  misc_feature (227)..(227): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcacatctccngcactggaaccngcagtgacgttggtgcttataattatgtctcctggttccaacagcattcgaggcacgccgaccccgtaaactctttaatttatgtagttcgttcgtcggtcctgtgggtttctagtcgtcttctccggtctaccgtaagtcgtggaccaacgaccggtccctaccctacgacctactacctactacggtacctacccgaggtccgtaggaacggacggacggacttacggaactttaatttacgttcgactagtccttaactaagttaacttaacgtaacgtaacgttactaagttcgggtaactcccgtagtcggtacgttggttccggggaggaacggggtaacctaacggttacggtacccggttacgtaacgggaccgtaacggtccccgtaaggtcccccgg

SEQ ID NO: 83825 - DNA, 630 bp, Homo sapiens
  misc_feature: GYAE6OF01A70GM.36.23.C01.1.454.CMB.1.raw
  modified_base (429)..(429): a, c, t, g, unknown or other
  misc_feature (429)..(429): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacgagggtcctgggcccagtctggcctgacacagcctgcctccgtgtctgagctccgtggacagtcgatccacatctcctgcactggaaccagcagtgacgttggtgtacttataattatgtctccttggttaccaacagtcattcgaggctacgccgaccccgtaaattctttaatttgtacgtaggttctttcggtccgtccttaggtacgggtttctacgtcgtccttcgtccgtctacgtaagtcgtggaccacgacggtccctccagacctatctactacgctccgngctagggacggacgacgtcgtagtactatttcgtgactacgtcttaacattaactacgagttaagttacctaagtacggtaactccgtacgttggtaccgttgggtacccgggaggttaacggggtacccttaaaggggttccggtaaaccccggtttaccgtagggttacccaaacggggtaccccgaaggttcccccgg

SEQ ID NO: 83826 - DNA, 705 bp, Homo sapiens
  misc_feature: GYAE6OF01ELJFH.36.23.C01.1.454.CMB.1.raw
tcagtacgctgtctcacgaccggtgctcgattagtacacgtgattagggattggggggggtctcaggaggcagcgctctcaggacatctccaccatggcctgggctctgctgctcctcaccctcctcactcagggcacgagggtcctgggcccagtctggcctgacacagcctgccctccgtgtctgacgacctccgtggacagtcgatccaaccatcctcctgccacgtacggaaccagcaggtgacggtttggtgtactttaattaatttatcgttccttccgttacggttaccaaacgtagactatttcgaaggccacggacccgacccccgtaaaactttactttaatttagtacggttacggtttccgttttccggtcccggtccccgtttacggttacggggttttcctacggtccgtcgtttcccgtcccggtcctaccgtaacgttccgtcggaacctaaccgtaccggtccccttcccgtacgaccctacttcctaccgtaacgacccttccggacggtcgtagggaacggacgacggtctagtactttattcgtcgactagtctataacgttatacgtagtaacgttactaagttacggttactccgtacgtcggtcgttgggtccggacgggtaacggtactacgggttaccgacccgttacggtacgtaccgaaccggtcccgaaggtccccg

SEQ ID NO: 83827 - DNA, 659 bp, Homo sapiens
  misc_feature: GYAE6OF01CW8OX.36.23.C01.1.454.CMB.1.raw
  modified_base (374)..(374): a, c, t, g, unknown or other
  misc_feature (374)..(374): n is a, c, g, or t
  modified_base (469)..(469): a, c, t, g, unknown or other
  misc_feature (469)..(469): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgacgactctggacagtcgatcaccatctcctgcactgaccagcagtgacggttggtgtcttataattatgtctccgtcggttaccaacagctattcaggtccacggccgaccccgaaacttctttaaatttagtgtacggtttctttccgtccggcccttcggtacgggtttctacgtcgtcgtttcnccggtctcctaagtccgtacggacctaacgacccggtccttaccctgacccattcctacctacgtacctacccgaggtccgtaggaacgggacgnggtacgtacgtaacctagtttaacgttggcctaaggtccttacgtaatttacgttaaccgtaggtaacgttacaaggtttagacccttaccgtacggtcggtcgttacggtccggggtacgaacggggtacctaacgggttaccgaccggttaccgtaaggtccctaacggcccgtaacgggtacccccg

SEQ ID NO: 83828 - DNA, 733 bp, Homo sapiens
  misc_feature: GYAE6OF01D2OFK.36.23.C01.1.454.CMB.1.raw
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctcgtgtctgagactcctggacagtcgatcaccatctctgcacgtggaaccagcagtgtacggttgtgcttataattatcgtcttctggttccaacagctattcaggcacgaccgacccgaaacttcttaatttgtgtacgttactttcggtccgtccttcgtagggtttctacgtcgtctttccgccggtctaccgaacggtctacggacctaaccgaccggtcccttcccgtacgacctacttccttacctaacggtaccgttaccgacgggtacttacgggaaacgggtaccggtacgggtccgttaacggtaacttttaagtttaacgtttcggaccgtacgttcctaaccgttaattaagttaaccgttaggtaaaccgttactaaacggtttcgggttaaactccctacggttcggttacccggtttcggggtttacccggggaaccgggttaaggggtaaccccgtttaaagggtttcccggtaaacccccggtttcggttaaacgggttacccgtaaacccggtaaccccggtacgggttaccccccgg

SEQ ID NO: 83829 - DNA, 875 bp, Homo sapiens
  misc_feature: GYAE6OF01BNXUA.36.23.C01.1.454.CMB.1.raw
  modified_base (204)..(204): a, c, t, g, unknown or other
  misc_feature (204)..(204): n is a, c, g, or t
  modified_base (216)..(216): a, c, t, g, unknown or other
  misc_feature (216)..(216): n is a, c, g, or t
  modified_base (223)..(223): a, c, t, g, unknown or other
  misc_feature (223)..(223): n is a, c, g, or t
  modified_base (237)..(237): a, c, t, g, unknown or other
  misc_feature (237)..(237): n is a, c, g, or t
tcagtacgctgtctcacgaccggtgctcgatttagtacacgtgattagggattgggggggaaatactttctgagactcatggacctcctgcacaagaacatgaaacacctgtggttcttcctcctcctggtggcagctcccagatgggtcctgtctcaggtgcagctgcagcagtcgggccaggagtggtgaagcccttcgganaccctgtccctnacctgcnctgtagtctggacncctcccgtggcggagtatgaagttgggtggtaggtttcgggtcccgccgacggcccccggtaaggggaacggggccttggtaacggttgggtagtttagggtacgtaaaagttaaagtgggaacgggtaacccgggggacaacccgtaaacgttaaccaaagttaccggacccggtttacccctacggtacggggtaccgaacgtacccgaacctaacgttaactccgttacgaccgtaacggtaaccgtaaacgttacccaaaacgtaacccctacctttaccgtaccccgttaggaccgggtaccttacggaccccgtttacgtaccgggttcggaaccccggtcccgggtaccgggtacccgtttacccgggaccccgttaaagttaacgtttaacgtttttacggtttacggttacggtaaccggttaagggttttacggttttttagggaccgttaagggtttaccgttacgggtttacgggggtaccgtttacgggttacccggttacggttaccgggttacgggggtaaccgtaaacggggttacttacccgggaaccgggtttaccttaacgtttccgggtttacccctttaccccgttaacggtcccggttcccccgtaaacccccggg

SEQ ID NO: 83830 - DNA, 544 bp, Homo sapiens
  misc_feature: GYAE6OF01DM8FZ.36.23.C01.1.454.CMB.1.raw
  modified_base (229)..(229): a, c, t, g, unknown or other
  misc_feature (229)..(229): n is a, c, g, or t
  modified_base (266)..(267): a, c, t, g, unknown or other
  misc_feature (266)..(267): n is a, c, g, or t
  modified_base (296)..(296): a, c, t, g, unknown or other
  misc_feature (296)..(296): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgccctcgtgtctgagactcctggacagtcatcaccatcctcctgcacgtggaaccngcagtgacgttggtgcttatattatgtctctgtcacnncatcagcagccgacccgtaatcttattangtagttcttcgtcgcctgtagggttctgtcgtcttctccggtctcagtctggcaacgcgcctcctagaccatctctaagctccgaggctaggagacgacggctacgtactattgtcgctagctactataatacgtagtaactctaagttcggtaactcccacgtggtcgttcggttccgggacggtagggtaaccctagggtttaccgacccgttccgtaacggtccaaccggtcccgaaggtccccg

SEQ ID NO: 83831 - DNA, 713 bp, Homo sapiens
  misc_feature: GYAE6OF01AE2BX.36.23.C01.1.454.CMB.1.raw
tcagtacgctgtctcacgaccggtgctcgatttagtacacgtgattagggattggggggaagaggaagactgacggtcctgtctcaggtgcagctgcagcagtcgggcccaggagtggtgaagccttcggagaccctgtccctcacctgcgctgtgtctggacgcctccctcggcggagatgaatgggtggaggttcgggtccgccgacgcccccgaggggaacggggctggaggttggagttgggtagaaaataaagtggaacgggaccgggggacaaccaaactaacaagtcgccgtcccgtacggacggggtccgacgtaccaacctattactcgtacgacgaacgaacgaacgtaccaaacgtaaccctaccttaccgtcccgtaggacggtcctacgtacctcgttacggtccgaccgccggacggaccgtccggacctattaattatttagttcggtgacggtagtttagttttcgacgtaggtacttcgggttaggggtcgttagtcggtacggtcggtagggtacgaaggctacgacgtctacgttccgtcttacccgtcgaccgtccctaccgaaccggaaccggccctacgttcccggttcccttacccgcgggccctacccgtcgccgtaccgacgggaccgccctaccgtaccgacggacgaccgtacgaccggcccgtccggtcggcgttccggtaccgg

SEQ ID NO: 83832 - DNA, 662 bp, Homo sapiens
  misc_feature: GYAE6OF01EEIV0.36.23.C01.1.454.CMB.1.raw
  modified_base (130)..(130): a, c, t, g, unknown or other
  misc_feature (130)..(130): n is a, c, g, or t
  modified_base (171)..(171): a, c, t, g, unknown or other
  misc_feature (171)..(171): n is a, c, g, or t
  modified_base (229)..(229): a, c, t, g, unknown or other
  misc_feature (229)..(229): n is a, c, g, or t
tcagtacgctgtctcacgaccggtgctcgatttagtacacgtgattagggagttggggggggtctcaggaggcagcgctctcaggacatctccaccatggcctgggctctggctgctcctcaccctcctnactcagggcacagggtcctgggcccagtctggcctgacacngcctgcctccgtgtctgagctcctggacagtcgatcaccatctcctgcactggaaccngccaggtcgacgttggtgtcttataattatgtcttacctggttaccaacagctattcaggtcagccgaccccgtaattcttaattagtgggttctttacggtcggtccccttcgtacggggtttctacggtccgtcgttccgtcgggtcctccgtaagtccgttaggctaaaccgacgggtcccttcccgttcggaaccctagttcccttactacgtacgtcccgaaggtcgtacggaacggtacgtaggcttaggaactttacgttattcggctaggtcctacgtacttacgttacgtacgtaaagttccaaagttcggtacttccggaacgttgggtcgtacgggtttacgggaccgggtaacgggtaaccttacgggtttcggacccggttacgttacgggtcccacggccccgtaaggtcccgttcccg

SEQ ID NO: 83833 - DNA, 613 bp, Homo sapiens
  misc_feature: GYAE6OF01B15AO.36.23.C01.1.454.CMB.1.raw
  modified_base (231)..(231): a, c, t, g, unknown or other
  misc_feature (231)..(231): n is a, c, g, or t
  modified_base (375)..(375): a, c, t, g, unknown or other
  misc_feature (375)..(375): n is a, c, g, or t
  modified_base (381)..(381): a, c, t, g, unknown or other
  misc_feature (381)..(381): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgccctccgtgtctgacgactcctggacagtcgatcaccatctcctgcactcggaaccngcagtgacgttgtgcttagtaattatgtctccgtggttccaacacgctattcaggtcacgccgaccccgtaaacttcttaatttatgtagttctttcgtccggcccttcgtagggtttcctagtcgtcttcgtccgctcagtcngacacncgcctcctgacctatcctatacgtactccgacgcgtaggacggacggaggtctagacttattagttgcacgtctacaattactacgtagaacgttacaagttcggtaacctaccgtaacggttggtacccgtttgggttacccgggacggggtaaccgggtaaccgttaacgggttaccggacccgtttaccggtacggtacccgaacgtaccccggtaaaggtccccccgg

SEQ ID NO: 83834 - DNA, 675 bp, Homo sapiens
  misc_feature: GYAE6OF01B3KBH.36.23.C01.1.454.CMB.1.raw
tcagtacgctgtctcacgaccggtgctcgatttagtacacgtgattagggattgggggggaaatactttctgagactcatggacctcctgcacaagaacatgaaacacctgtggttcttcctcctcctggtggcagctcccagatgggtcctgtctcaggtgcagctgcagcagtcgggccaggagtggtgaagccttcggagaccctgtccctcacctgcgctgtgtctggacgccctcccgtcggcggagactgaagtggtgggtaggttcgggtccgccgacgccccgaggggaacgggcgtggaggttggagttgggtagtaaagtaaagtgggacggaccgggggacaaccgaaactaacgaactcggccgtacccgtcggacgggggtcgacgtaccacctaattactcgtcgtacgaacgtaacgaaacgtaccgaaacgtaacctacttcctccctaggacgtcgtacgaccttcgtcgtcgacccggccggccgggacctaccggccctaattacgttactttagttcgtacggtacgtagtttaggttttcgagtacggtagttacggttcggggtcgttagtcggtaccggtaggttcggggtacggtaagggtactcggtacggtcgtacgtccgtaccgttccctaccgcgtccctacccgg

SEQ ID NO: 83835 - DNA, 620 bp, Homo sapiens
  misc_feature: GYAE6OF01ELHI3.36.23.C01.1.454.CMB.1.raw
  modified_base (392)..(392): a, c, t, g, unknown or other
  misc_feature (392)..(392): n is a, c, g, or t
tcagtacgctgtctcacgaccggtgctcgatttagtacacgtgattagggagttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcgtcctgcactcggaaccagcaggtgacgttggtgacttaataattatgtcttccgtaggttccaacagcattcaggcacgccgacccgaaattcttaatttgtgtagttctttcgtcgtcctcgtgggtttcacgtcgtcttcgcgtctcgagtctgacacgacgtcctcctagacctntctctaacgctcgaggtctaggacggacgacgtctacgtacttattagtcgtacagtctactaagttaactacgtacgtaaagttcaacgttacggttactacccgtacggtcggtaccgtttcggggttaccgggtcccgggggtaaacggttacccgtaacgggttaccggtaccccggttacgttaacgggtacccgaacggtacccccggtaacggtcccccgg

SEQ ID NO: 83836 - DNA, 665 bp, Homo sapiens
  misc_feature: GYAE6OF01DV65T.36.23.C01.1.454.CMB.1.raw
  modified_base (261)..(261): a, c, t, g, unknown or other
  misc_feature (261)..(261): n is a, c, g, or t
  modified_base (401)..(401): a, c, t, g, unknown or other
  misc_feature (401)..(401): n is a, c, g, or t
  modified_base (594)..(594): a, c, t, g, unknown or other
  misc_feature (594)..(594): n is a, c, g, or t
tcagtacgctgtctcacgaccggtgctcgattagtacacgtgattagggagttgggggggggtctcaggaggcagcgctctcaggacatctccaccatggcctgggctctgctgcctcctcaccctcctcactcagggcacagggtcctgggcccagtctggcctgacacagcctgcctccgtgtctgagtacctctggaccagtccgatccacctattcctccgtgaccacgtcggaacccaggctagtgtacggttggntcttaatattatcgttaccttcgtcggttaccaactgctacttgacggcacggtcccgacccgtaaactttattaatttagcgttacggtttcgtttcgtaccggcccgttggtagggtttctagttccgtccgtttacnccgggtactacgtagtccgtaggacctaaccgccggtcccctttaccacggtaaccctacttaccgtacctaacgtacccgtaccggacggtacgtacgggaacgggtacgtacggaccgtttacggtaactttacgttaagttcgacttaacggcttactaattactaacgttataagtctaacgtggtacnccgtacgtgtacgtcggtcgggaggtacgtacgtaagttcgacgtcgtacgtacgaccgtcgacggtcccg

SEQ ID NO: 83837 - DNA, 783 bp, Homo sapiens
  misc_feature: GYAE6OF01DMWG1.36.23.C01.1.454.CMB.1.raw
tcagtacgctgtctcacgaccggtgctcgatttagtacacgtgattagggagttgggggggggtctcaggaggcagcgctctcaggacatctccaccatggcctgggctctgctgctcctccaccctcctcactcagggcacagggtcctgggcccagtctggcctgacacagcctgcctccgtgtctgagacctcctggacagtcgatcaccattcctcctgcacgtacggaaccaggacaggtgtacggttggtatcttaattaattattcgtccttccgttacggttacccaaacgacggtacctaacgttacgacggaccgaacggtacccgtaccccgttaaactttacttttaatttacggtcgttacgggttccttttccggcccggttaccccgttacggttacgggggtttccttacggttccgtccgtttcccgtacccggtccttacgtaaacggttccgtcggaaccgtaccgaacccggtcccttacccgtacgtaccgtactttcctaccgttaaccgaccgttacccgagggtcctagggaagggtacccggtaggtaccgttaaggttaacctttaatttacgtcgcgtacgtctaactaacgttaactagtagtaacttacgttaagtttccgttaactacccgtacggttggtaaccggtttcgggttaacggggaccgggtaacgggtaaacccggtaacgggtttacccgaaccccggtttacgtaaccgggtacccaaccggtaccccggtgtacccccggg

SEQ ID NO: 83838 - DNA, 722 bp, Homo sapiens
  misc_feature: GYAE6OF01DTWYM.36.23.C01.1.454.CMB.1.raw
  modified_base (167)..(167): a, c, t, g, unknown or other
  misc_feature (167)..(167): n is a, c, g, or t
tcagtacgctgtctcacgaccggtgctcgatttagtacacgtgattagggagttggggggggtctcaggaggcagcgctctcaggacatctccaccatggcctgggctctgctgctcctcaccctctcactcagggcacagggtcctgggcccagtctggcctgacncagcctgcctccgtgtctgagactcctggacagtcgatcaccatcctcctgcactggaaccagcagtgacgttgtgtcttatattatgtctccgtgttccaacagctattcaggcacgccgacccgtaaacttacttaatttagtgtacggttcgtttccgtccggtccctcgtacgggtttctaggttccgtcttcgtccggtctccgtaagtcgttcggcaaccgtccggtccctcccgtccgtaccgacttccttacctacgtaccctcgtaacggtcgtacggacgggacgtcgggtacgttacgtaactttaagtttacgtttacgtaccgtaattcctaacgttaacttaacgtttaacgtaacggttaaaccggttacttaaacgggttaccggttaacgttaacccgtacggttaccgggttcgttccgggggttttaaccggggaccggggttaacggggtaaacccgttaacgggtttacccggtaacccggtttaccggtaaccgggttcccgaaccgggtaccccggacgggttaccccccgg

SEQ ID NO: 83839 - DNA, 725 bp, Homo sapiens
  misc_feature: GYAE6OF01CH3UV.36.23.C01.1.454.CMB.1.raw
  modified_base (212)..(212): a, c, t, g, unknown or other
  misc_feature (212)..(212): n is a, c, g, or t
  modified_base (265)..(265): a, c, t, g, unknown or other
  misc_feature (265)..(265): n is a, c, g, or t
  modified_base (333)..(333): a, c, t, g, unknown or other
  misc_feature (333)..(333): n is a, c, g, or t
tcagtacgctgtctcacgaccggtgctcgatttagtacacgtgattagggattggggggggtctcaggagtcagcgctctcaggacatctccaccatgcctggctctgctgctcctcaccctcctcactcaggcacgagggtcctgggcccagtctggcctgacacagcctgcctccgtgtctgagacctccgtggacagtcgatccaactntctcctgctacgtcggaaccagcagtgtacggttggtagtctttaataacttntcggttccttccgtaggttaccaaactcgactattccgaggccaacgcccgtaaccccgtaaactttntttaaatttgcggttaacgtttccgtttcccggtccggtccttacgggtacgggttttcctaacggtttcccgtcgttttcccggcccggtaccttaaccgtaaggtttccgtaacggggaccctaaaccggtcccggtccccttacccgtacgaacccttgtcccttacgtaccgtaccttccggacggtcgtaacggggaacgaccgggtagtacgttacgtaaccgtttaagttttacgcgaataccgtctaactagttactacgtaagtaacgttactaagttcgtactccgtagttcggtcgttacgggttccggagggtaaaccggttaccgaaggtttcccggtaacgtccggttacggacccgacgtaccggtacgtcccccgg

SEQ ID NO: 83840 - DNA, 621 bp, Homo sapiens
  misc_feature: GYAE6OF01CQVAS.36.23.C01.1.454.CMB.1.raw
  modified_base (435)..(435): a, c, t, g, unknown or other
  misc_feature (435)..(435): n is a, c, g, or t
tcagtacgctgtctcacgaccggtgctcgatttagtacacgtgattagggattgggggggaaatactttctgagactcatggacctcctgcacaagaacatgaaacacctgtggttcttcctcctcctggtggcagctcccagatgggtcctgtctcaggtgcagctgcagcagtcgggcccaggagtggtgaagccttcggagaccctgtccctcacctgcgctgtgtctggagcctccctcggcggagatgaagtggtggtaggttgggtccgccacgccccgagggaaggggctggagttggattggtagaaataaatgacggaccgggggcaaccaaactacaagtcgcgtccctgacggggtcgagtacaccatactctgcagacaacgtaccaaacgaaccacttcctaccctaggacgtctcgacctntcgtcgacccgccggacgacgtcggaccatatattagttgtgacgtagttacgttttgacgaggtattcggttacggggcggttaacgtccggtacggttcggtagggggtaccgaaaggggtactccggtaaccggtacgtacgttaccggtccttacccgtacgacccgtcccgtaacccccgg

SEQ ID NO: 83841 - DNA, 730 bp, Homo sapiens
  misc_feature: GYAE6OF01BHP93.36.23.C01.1.454.CMB.1.raw
  modified_base (171)..(171): a, c, t, g, unknown or other
  misc_feature (171)..(171): n is a, c, g, or t
  modified_base (287)..(287): a, c, t, g, unknown or other
  misc_feature (287)..(287): n is a, c, g, or t
tcagtacgctgtctcacgaccggtgctcgatttagtacacgtgattagggattggggggggtctcaggaggcagcgcgtctcaggacatctcccaccatggcctgggctctgctgctcctcaccctcctcactcagggcacagggtcctgggcccagtctggcctgacacngcctgccctccgtgtctgagctcctggacagtcgatccaccatcctcctgccacgtggaaccagccagtcgacgttggtgtctttataattatcgttcttccgttggttacccaanacgtctattcaggcacgccgaccccgaaattctttaatttacgtagtacgggttctttccggtccggtccccgttcggtacggggtttctacggttccgtcctttcccgtcccgggtccttaccgtaacggttccgtacggtaccgtaaacccgtaccgggtccccttaccccgtacgacccgtacttcccgtaccttaccgtacctcccgtaaggtccgtacggtaacgggaccggacggtccgttagtaaccgttattttacgtcgaccgtacgtcctacgtaattaacgtaacgttagtaaacgttactaaggttacgttacttaccgtagtcggtaccgttcgggttcccgggtagggtaaccgggtaaccgttaacggttccggtaacccgttccggtaacgggtaccgaacccgggtacccggacgggttacccccg

SEQ ID NO: 83842 - DNA, 620 bp, Homo sapiens
  misc_feature: GYAE6OF01BEKV2.36.23.C01.1.454.CMB.1.raw
  modified_base (239)..(239): a, c, t, g, unknown or other
  misc_feature (239)..(239): n is a, c, g, or t
  modified_base (265)..(265): a, c, t, g, unknown or other
  misc_feature (265)..(265): n is a, c, g, or t
  modified_base (278)..(278): a, c, t, g, unknown or other
  misc_feature (278)..(278): n is a, c, g, or t
  modified_base (316)..(316): a, c, t, g, unknown or other
  misc_feature (316)..(316): n is a, c, g, or t
tcagtacgctgtctcacgaccggtgctcgatttagtacacgtgattagggagttggggggggtctcaggaggcagcgctctcaggacatctccaccatggcctgggctctgctgctcctcaccctcctcactcgagggcacgagggtcctgggcccagtctggcctgacacagcctgccctcgtgtctgacgtactcctggacaggttcgatccaaccatcctcctgcacgtggaaccngcaggtgacgttggtattatactttntctctggtaccanacgcacccaggcacgaccaccccaaatcatgtatttanagacggtcaagaacgtccggccgtacggtacgggttctaggtacttccgtcttccgtcgtcggacctaccgtacgtcgtacgggacgaccggtaccggtccctcccgtacgtacctacgttccgaccggtcggcccgtaccgacggccgtagggaacgggacgtacgggcttagtaactttagtactcggtactaacgtcctactataactaaccgtaagtacgacgacgtctaccgttcgtacgttcgtacggtacggtcggacctacggactacgtacgttccgagtccaccgtaccgaccg

SEQ ID NO: 83843 - DNA, 735 bp, Homo sapiens
  misc_feature: GYAE6OF01CHBLH.36.23.C01.1.454.CMB.1.raw
  modified_base (702)..(708): a, c, t, g, unknown or other
  misc_feature (702)..(708): n is a, c, g, or t
  modified_base (710)..(711): a, c, t, g, unknown or other
  misc_feature (710)..(711): n is a, c, g, or t
  modified_base (713)..(717): a, c, t, g, unknown or other
  misc_feature (713)..(717): n is a, c, g, or t
  modified_base (721)..(722): a, c, t, g, unknown or other
  misc_feature (721)..(722): n is a, c, g, or t
  modified_base (724)..(727): a, c, t, g, unknown or other
  misc_feature (724)..(727): n is a, c, g, or t
  modified_base (729)..(733): a, c, t, g, unknown or other
  misc_feature (729)..(733): n is a, c, g, or t
tcagtacgctgtctcacgaccggtgctcgatttagtacacgtgattagggagttgggggggggtctcaggaggcagcgctctcaggacatctccaccatggcctgggctctgctgctcctcaccctcctcactcaggacacgacgggtccgtgggcccagtcgtggccctgacacagcctgcctcgtgtctgacgacctccgtggacagtcgatccaactatcctcctagctacgtacggaaccagcgtaagtcggtacggtttggttagtacttaattaactttatcggttacttcccgtagggtttacccaaaagtcgtactagttcgaggaccacggcccgaacccgtaaactttacgttaattagtacgtagttccggtttcgccggttacctagttaggggtttactacgtcgtcgtttcccgccgtacgtaccgtaacgtaccgtacggtaacccgaaccgtaccgggtaccccttaccccgtacggtaacctaccgttaccccttacggttaacccgttaaaccgttaccccggtaacggggtaccgttaacggggaacggggttaaacccggggtaccgggtaacccgttttaaaccgggtaaaacccgtttttaaaccggttttttaaaccgggttttacccggttaaaaccccggtaaaccccgggggtttttaaacccccgttttaaaaannnnnnnannannnnngtgnngnnnntnnnnngc

SEQ ID NO: 83844 - DNA, 563 bp, Homo sapiens
  misc_feature: GYAE6OF01B00CS.36.23.C01.1.454.CMB.1.raw
  modified_base (212)..(212): a, c, t, g, unknown or other
  misc_feature (212)..(212): n is a, c, g, or t
  modified_base (229)..(229): a, c, t, g, unknown or other
  misc_feature (229)..(229): n is a, c, g, or t
tcagtacgctgtctcacgaccggtgctcgattagtacacgtgattagggagttggggggggtcgtcaggaggcagcgctctcaggacatctccaccatggcctgggctctgctgctcctcaccctcctcactcagggcacagggtcctgggcccagtctggcctgacacagcctgcctccgtgtctgagacctcctggacagtcgatcaccntctcctgcatggaaccngcagtgacgttggtgcttataattatgtcttccttggttaccaacagctattcaggcagccgacccgtaaactcttaatttatgtagttctttcgtcggccctcgtacgggtttctacgtcgtcttccgtccgctcctaagtctggaccaacaccggcctccctgacctatctactagacctcaggtctaggacggtacgcggtctcggtaaccttagtttattgactagcttctaattactacgtagtaaagtctaagtgtactccacgtggactggttcgggacggacgggtacagttcggaccgttacgtacggacaccgtccgagtcccg

SEQ ID NO: 83845 - DNA, 724 bp, Homo sapiens
  misc_feature: GYAE6OF01B97ST.36.23.C01.1.454.CMB.1.raw
  modified_base (277)..(277): a, c, t, g, unknown or other
  misc_feature (277)..(277): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacgagggtcctgggcccagtctggcctgacacagcctgcctccgtgtctgacgcctcctggacagtcgatcacctatctcctgcactggaaccagcagtgtacgttgtgacttataattatgtctccgtggttaccaanacgctattcgaggcacgccgaccccgaaacttcgtttaacttttagtgttaggttccttttccggtccggtccccgttacggtacggggttttccttaacggttccggttacctttcccgtcccggtcgttacccgtaaaggttcccgtacgggcctaaaacccgccggtacccccttacccgtcgtaacccgtacttacccttaccgttaacgtaccctaccgacgggtcttaggaacgggaccgtagggccgttagtaactttaattcgtttacgacgtacgtacttactaattacttaacgttagaaacgtttactaaacgttcggttaacttcccgaacgttcgggtaccttcggggttaccgggacgggaaccgggtaaccttaacgggttcggaccccgtttacggtacggtaccctaccggtaacccgacgggttccccg

SEQ ID NO: 83846 - DNA, 895 bp, Homo sapiens
  misc_feature: GYAE6OF01AUI7N.36.23.C01.1.454.CMB.1.raw
tcagtacgctgtctcacgaccggtgctcgatttagtacacgtgattagggattgggggggaaatactttctgagactcatggacctcctgcacaagaacatgaaacacctgtggttcttcctcctcctggtggcagctcccatatgggtcctgtctcaggtgcagctgcagcagtcgggcccaggagtggtgagccttcggacgaccctgtccctcacctgcgcgtgtgtcgtggacgccctcccgtcggcggagagtgaagtgggtggtaggttcgggtcccgccgaccggacccccggagggggaacggggtcgtacgggtaggtttcgggtaaggtttacggggtaagtaaaagtttaaacggtaggggtaaccggggtaacccgggggggacctaaaccccggtaaacgtaaaccgtaaacggttcggaccccggttaccccggtacgggtacggggggtaccggtaacggttacccgaaacccgtaagttaccttccgtacggaccgtaacggaaaccgtaacgtaaccgtaaaacccggtaaaccccttaccgtttaccccgtacccgttacgggtaccgggtaccttaccggtaacccgtttccgtacgggtaccggaccccggtacccgggtacccgggtaccgttacccggaccttaacgtttacgtttaacgttttacgttacgggttacggttacggttaacgggttttacggttttacggaacggttaacgggttacgtttacggggttccgggggttacggttaacgtaccggggttacggttccgggttaggggtaccggaagggttaccgttacgggaccggttacccgtacgtttcccggtaccttacccgtaccggtaccgtccccgtaaaccccggg

SEQ ID NO: 83847 - DNA, 669 bp, Homo sapiens
  misc_feature: GYAE6OF01A6KRM.36.23.C01.1.454.CMB.1.raw
  modified_base (231)..(231): a, c, t, g, unknown or other
  misc_feature (231)..(231): n is a, c, g, or t
  modified_base (247)..(247): a, c, t, g, unknown or other
  misc_feature (247)..(247): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacgagggtcctgggcccagtctggcctgacacagcctgcctccgtgtctgagacctcctggacagtcgatcaccatcctcctgcactggaaccngcagtgtacgttggtntcttataattatgtcttccgtggttccaacagctattcgaggcacgccgaccccgtaaacttctttaatttagtcggtacggttcctttaccggtccggtcccttacggtacgggtttctacggttccgtccgtttccgtcccggtccttacccgtaacgttcgtacgggacctaaccgtcccggtcccttccccgtacgaccctattccctactacgtacctaccgaggtccgtagggaacgggtaccgacggtcttacggtaactttacgtttacgtcgacctagtccttactaagttactaacgtagtaacgttacaaggttcgtactccgtacgtcggtcgttcgggtcgggagggaacggtacctaacgggttcgacccggttccgtacgggtaccaccggacccggtacggtcccg

SEQ ID NO: 83848 - DNA, 945 bp, Homo sapiens
  misc_feature: GYAE6OF01E074X.36.23.C01.1.454.CMB.1.raw
  modified_base (274)..(274): a, c, t, g, unknown or other
  misc_feature (274)..(274): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcaggcacgagggtcctgggcccagtctcggcctgacacacgcctcgtcctccgtgtctgacgaccttccgtggacagtcgatccaccagttcctacctgacctacgtacggaacccaggtcgaggtcggtaacggttgggttntaacctttaagttaaacttttacgttacgttcccgttcccgtttacgggttaacccaaacgtaggtccttaacgtttccgaacgggccgaaccggtaacccccggtaccccgtaaaattttaccgtttaaaacgttttaggtacgtttaaccgggttttcccgtttacccgggtcccggtaccccgtttacggggttacgggttttacccggttacggcccgtttcccgtttcccggtacccggttccctaaaccggttacggttacccggtaacgggtaaccctaacccgggaccccgttccccgttaccccgttaaggaacccctttacgtacccgttttaccgtaacccggtaaccccgttacccgacggttaccggtaacgggtaaccggggtaaccgggtaacgttcccgggttaagttaaccgttttaattccgttaacgggtacctaccgtaccgttaactaacggttaacgtttaaccgtacgttaaaccgtacgttaaaccgtacggttaacccgtccgttaaccggttgggttaaccccggtttcggggtacccggggtacccgggttaaacgggtaaccgttaacccgggttaccgtaccccccggttaaagtttaccccgggaaggtaaccccgtcccggttaacccggttcccccggg

SEQ ID NO: 83849 - DNA, 871 bp, Homo sapiens
  misc_feature: GYAE6OF01D01S9.36.23.C01.1.454.CMB.1.raw
  modified_base (711)..(711): a, c, t, g, unknown or other
  misc_feature (711)..(711): n is a, c, g, or t
tcagtacgctgtctcacgaccggtgctcgatttagtacacgtgattagggagttgggggggggtctcgagggaggcagcgctctcaggacatctccaccatggccgtgggctctgctcgctcctccaccctcctcactcgagggcacgtacgggtccgtcgggaccctagtcgtcgggcctaggaccacgacgcccttcggccccttcccggtgttacctaggaacgtacccgttcccgtaggggaacctacggttccggaacttacccaaccgtaacttcccttcccgtacgggaccctaaaccggtaccgggaaaaccctaggacgtaaaccggggttggtaacggtttgggtacgtaaacttttaataaacgtttagtacgttccgttacccgtacggttacccaaagtacgtactagttacggacggaccacggacccggtaacccctaaaattttacgtttaaattacggttacggttacggtttccgtttcggtacccggtaccgttacgggttaaggggttttacctaggttcccgtccgttccggttacccggtaccttaccggtaaacggttccgtacgggaaacccaacccgtaccggtccctttacccggagtaacccgttctaccgttacgaccgtaaccgttccgagggtactacgggaacggtacgaacgggttctaacgttaacgttaacgtttancggtaccgtaagtaccgtacgtaaacttacgtaagtaaccgtaaacgtataacggtacgtaccacggagttccggaggtttacggtccggggaaggtacccggtaaacttacccgtggaaccccgttcgtaacgggaccaccggtaaccgccggtccccg

SEQ ID NO: 83850 - DNA, 702 bp, Homo sapiens
  misc_feature: GYAE6OF01DCRUH.36.23.C01.1.454.CMB.1.raw
  modified_base (273)..(273): a, c, t, g, unknown or other
  misc_feature (273)..(273): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctctcactcagggcacagggtcctgggcccagtctggcctgacacagcctgcctccgtgtctgacgactcctggacagtcgatcaccatctcctgcactggaaccagcagtgacgttggtgtctttatattatcgtctcttaggttccaanacgctattcgacggcacggcccgaccccgtaaacttctttaatttacgtggtacggtttcctttccggtccggtcccgttacggttacggggttttcctacggttccgtcctttacccgtcccggtcttaacccgtaacggttcctacgggacctaaacccggacccggtccccttaccccgtacgtaaccccgttacgttcccttaccgttaaccggtacccgtacccggtaacggtccgttacgggaacgggaccggtacggtaccgttacgtaacttagtttacgttcgtactacgtcttactaagttaactacgttagtaagttactaagttaggtacctaccgtacgtggtcgttggtccgggacgggtacggtacccgtaggttcgaccggttccgtacggtacgaccgccgtaacggtcccg

SEQ ID NO: 83851 - DNA, 827 bp, Homo sapiens
  misc_feature: GYAE6OF01ERKN9.36.23.C01.1.454.CMB.1.raw
tcagtacgctgtctcacgaccggtgctcgatttagtacacgtgattagggattgggggggggtctcaggaggcagcgctctcaggacatctccaccatggcctgggctctgctgctcctccaccctcctcactcgagggcacgagggtcctgggcccagtctggcctgacacacgcctgccttccgtgtctgagcctccgtggacagtcgatccacctatcctctgaccacgtacggaaccagcgtaaggtcgtacggttggtgtactttaattaatttagtcgttccttaccgttcggttaccaaacgacgtctaacgtttcgacggtaccgacggacccggtaaccccgtaaactttaactttaagtttagtcggttacggttcgtttccggtaccggtcccgttacggttacgggtttcgttacgtccgttccgttcccggtccgtaccgttacgtaacggttccgtacggtacctaaaccgtcccggtcccttacccgtacgtaccctacgtacctacgtaccgtaccgtccgtaggacgttaggacggaacggtacgggtaccgttaaggtaaccttttagttacgttacggtacctacggttacttaccgttaagtttaaccgttacgttaaacggtaaccgtttagtaaacggttaccgttacgtaacccgtacgggtttaccgggttacggtttaccggggtaccggggtaacccggggtaacggggttaaaccccggtacgggtttaaccccggttacccggtttaccgggttacggtaacccgacccgggtaaccccggtaccgggttaccccccgg

SEQ ID NO: 83852 - DNA, 731 bp, Homo sapiens
  misc_feature: GYAE6OF01BOAPD.36.23.C01.1.454.CMB.1.raw
  modified_base (249)..(249): a, c, t, g, unknown or other
  misc_feature (249)..(249): n is a, c, g, or t
tcagtacgctgtctcacgaccggtgctcgattagtacacgtgattagggattgggggggggtctcaggaggcagcgctctcaggacatctccaccatggcctgggctctgctgctcctcaccctcctcactcagggcacgagggtcctgggcccagtctggcctgacacagcctgcctcgtgtctgagactcctggacagtcgatccacctatcctcctgccactacggaaccagcagtgacgttggtntacttattaattatcgttaccttccgttacggttacccaacaggtcctagtttcgaggccgacggccccgaacccccgttaaaactttacttttaaattttacggttaggtacgggttttccgttttacccgggtcccggttccccttacgggttacggggttttaccttacggttccggtcctttccggttcccggtaccttacccgtaacggttccgtagggaccctaaccggtcccggtacccctcccgtacgtaccctacttacccgttacgtaaccgtacccgttaccgacgggtccgtagggaacggaacggtcggtaccgttacgtaacctttagttacgtgtccgtactctacttaactaagttacgtagtaacgtactaaggttcgtactccgacttaggcggttacggtcgggacgggacggttacgtacggttcgacccgtacggtaccgagaccggtaccgacggtcccg

SEQ ID NO: 83853 - DNA, 821 bp, Homo sapiens
  misc_feature: GYAE6OF01BRYEG.36.23.C01.1.454.CMB.1.raw
tcagtacgctgtctcacgaccggtgctcgatttagtacacgtgattagggagttggggggggtctcaggaggcaccgctctcaggacatctccaccatggcctgggctctgctgctcctcaccctcctcactcagggcacgacgggtccgtcgggcccagtcgtggcctgacacacgcctcgcctccgtgtctgacgacctccgtggactagtcgactccaacctactcctcctgcacgtacggaaccagcgaggtgtacggttggtcgtactttaattaatttctcgttccgttccgttacggttacccaagtcgactagttaccgacggccaaccggcccgtaaccccgttaaactttactttaagtttacgtcggttacggtttccgttttccgggtacccggttacccgttacgggttacggggttttcctacggttcccgttaccgtttcccggtacccggtaccgttaccgttaacgtccggtaccggaaaccctaacccggtacccccgggttccccttaccccggtaacgtaaccccttacgtttacccgttaccggttaccgtaacccggttcccggtaacggtcccggtaacgggacgggtaacccgtacgggtaccgttaacggttaaacctttagtttacgttaccggacgtacgttaccttaagtaacttaacgttaagtacggtaacttaacgttaagttcgttactacccgtagtcggttacggttcggtacggtacgggtagtacgtaacccgtagttacccggacccgttacgtacggtaaccgccggtaaccgtcggtccccg

SEQ ID NO: 83854 - DNA, 664 bp, Homo sapiens
  misc_feature: GYAE6OF01B2SSP.36.23.C01.1.454.CMB.1.raw
  modified_base (228)..(228): a, c, t, g, unknown or other
  misc_feature (228)..(228): n is a, c, g, or t
  modified_base (407)..(407): a, c, t, g, unknown or other
  misc_feature (407)..(407): n is a, c, g, or t
  modified_base (413)..(413): a, c, t, g, unknown or other
  misc_feature (413)..(413): n is a, c, g, or t
tcagtacgctgtctcacgaccggtgctcgatttagtacacgtgattagggattgggggggaagaggaagactgacggtcctgtctcaggtgcagctgcagcagtcgggcccaggagtggtgaagccttcggacgaccctgtcccctcacctgcgctgtgtctggagccctcccgtcggcggagatgaagtggtggagttgggtccgcacgccccgagggaagggctgngttggattggtagaaataagtggaggaccggggcaaccgaactacgaatgccgtccctcgaggggtcgacgtccacatatctgcagacaagtaccaaagaacctacttcctcctgagcttcgacctgtgtcgacccgcgcggactccgctatatatttagtgtcgcgtagtagttttgngtaggnttcgtgggtcgtcgtcgtcggtcgtgggtacgaagggactcgtacggtctactccgttcctaccgtcgacgccccttaccgaacccgtacgggcccctacggttcccgttccccgttcccccgtacgggtccccgtccccgttcggcccgttacccggaacgggtacccgcccggtaaccccgtccggaacggccaacccgaacggtacccggtcccgggaccccgttcggggccgtcccgggttacccgg

SEQ ID NO: 83855 - DNA, 655 bp, Homo sapiens
  misc_feature: GYAE6OF01E3JTD.36.23.C01.1.454.CMB.1.raw
  modified_base (231)..(231): a, c, t, g, unknown or other
  misc_feature (231)..(231): n is a, c, g, or t
  modified_base (402)..(402): a, c, t, g, unknown or other
  misc_feature (402)..(402): n is a, c, g, or t
  modified_base (454)..(454): a, c, t, g, unknown or other
  misc_feature (454)..(454): n is a, c, g, or t
tcagtacgctgtctcacgaccggtgctcgatttagtacacgtgattagggattgggggggggtctcaggaggcagcgctctcaggacatcctccaccatggcctgggctctgctgctcctcaccctcctcactcagggcacagggtcctgggcccagtctggcctgacacagcctgcctccgtgtctgacgactcctggacagtcgatcaccatctcctgcactggaaccngcagtgacgttggtgtacttataattatcgttcctccttcggttaccaaactcgctagttcgacggcacgaccgacccccgtaaaatttcctttaaatttataggttacgtttctttccggccggtcccttggttacgggtttctagtccgtcttccgtccgctacagtcnggacaacgtaccggtccctccgtcaccctatcccttacgtacaccgtaccgnggtactggaacggtcggacggtcttagtaactttagttgtgacctagcctataatacgttaactaagtaacttactaagttacggtaaccttccgtacgtcgggtccttcggggttaccggacggggtaaacggtaccgtaacggttacccggaccggttaaccggtacgggacctaccgggaccccgtaagggtcccccg

SEQ ID NO: 83856 - DNA, 594 bp, Homo sapiens
  misc_feature: GYAE6OF01BL3QP.36.23.C01.1.454.CMB.1.raw
  modified_base (314)..(314): a, c, t, g, unknown or other
  misc_feature (314)..(314): n is a, c, g, or t
  modified_base (348)..(348): a, c, t, g, unknown or other
  misc_feature (348)..(348): n is a, c, g, or t
  modified_base (383)..(383): a, c, t, g, unknown or other
  misc_feature (383)..(383): n is a, c, g, or t
  modified_base (392)..(392): a, c, t, g, unknown or other
  misc_feature (392)..(392): n is a, c, g, or t
  modified_base (479)..(479): a, c, t, g, unknown or other
  misc_feature (479)..(479): n is a, c, g, or t
  modified_base (528)..(528): a, c, t, g, unknown or other
  misc_feature (528)..(528): n is a, c, g, or t
tcagtacgctgtctcacgaccggtgctcgatttagtacacgtgattagggattggggggaagaggaagactgacggtcctgtctcaggtgcagctgcagcagtcgggcccaggagtggtgaagccttcggagaccctgtccctcacctgcgctgtgtctggagcctcccgtcggcggagatgaatgggtggaggttcgggtccgccacgcccccgagggaagggctgagtggattggtagaaataagtggacggaccggggacaaccaactaacaatcgccgtcccgtcgacgggtcgacgtacaccatactcngcagacaacgtaccaacgaacctacttcctccgngcgctcgcctctgtcgccgccggcgcgcgcatatnttatgtcgngtagtgttttgcgtaggtagttcggttaggtcgtagtcggtacgttcggtgggtacgaaggctacgacgtctgtccgtcctcctccncgccctaccgaccgaccggccctacgtccgtcccgttccccgcgtcccnccgtcgccgtcgacgccgccgaccgacgcgacaccgacgcgccggcccggcggtccgtcggtccgg

SEQ ID NO: 83857 - DNA, 825 bp, Homo sapiens
  misc_feature: GYAE6OF01C2IE9.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctctcactcagggcacagggtcctgggcccagtctggcctgacacagcctgcctccgtgtctgacgactcctggacagtcgatcaaccattcctcctgcctacgtacggaaccaggcaaggtggtacggttggtagtactttaattaagttattcgttccttccgttacggtttacccaaacgtaggtacctaacgtttaccgaacgggtccaacggaccccggtaaccccccgttaaaaacgttttaccgtttttaaaacgttttaaggttacggttaaacgggtttttcccgtttttaccgggtaccccgggtaccccgtttaccgggttaacgggggtttttaccttaacgggtttcccggttacccgttttcccgtcccgggtaccttaaccggtaaacggttccgttacgggaccgtaaaccgtacccgggtcccttaccccgtacggtaaccctacgttaccttacctaaccggtacctcccggaggtaccgtagggaaaccgggtacggacgggtccttacggtaacttagtttacgttcgcctaggtccttataacttaacgtaccgtagtaacgtactaacgttcggttactaccgtacgtcggtcgttacgggttccgggacgggtaacgggtacctaacgggtttcgaacccggttccgtaacgggtccgaaccgtacccggaggtaccccg

SEQ ID NO: 83858 - DNA, 824 bp, Homo sapiens
  misc_feature: GYAE6OF01CXDFQ.36.23.C01.1.454.CMB.1.raw
  modified_base (214)..(214): a, c, t, g, unknown or other
  misc_feature (214)..(214): n is a, c, g, or t
  modified_base (314)..(314): a, c, t, g, unknown or other
  misc_feature (314)..(314): n is a, c, g, or t
  modified_base (812)..(812): a, c, t, g, unknown or other
  misc_feature (812)..(812): n is a, c, g, or t
tcagtacgctgtctcacgaccggtgctcgatttagtacacgtgattagggagttgggggggggtctcaggaggcagcgctctcaggacatctccaccatggcctgggctctgctgctcctcaccctcctcactcgagggcacgagggtcctcgggcccaggtctggccctgacacacgcctcgccctccggtgtctgacgacctccgtaggacngtcgactccacctatcctcctgacacgtacggaacctagcgtaaggtggtacggttggtatactttaattaattattcgttctccgttaggttaccaagngtactatacgacggccacggaccctaacccgtaaacttatttaagttacggtacggttaccggtttcccgttacggtcccggtacccggtttacgggttacggttttccgtacgttccgtacccgtttccggacccgtaccgtaccgttaacggtccgtaccggaactaaccccggtcccgttacccgttcccgaacggtacccttacgttaccgtacggtaaccgtccgttaccgggagttacgtaacggggaacgttaaccgggacggttctttaaggtaaaccgttttattcggacgttacgaacgtaccgtttaactaaaacgtcgttaaaccgggtaagttaaccgtaaacggtttatacgggttaaccctacgggtaccggttcggttaccgggttaacgggtcgggggtaaacccgggtaacggttaaccggttacggttacccgttaaccccgggttaggttacccggaacccgacccgggttaacccgngggttcccccgg

SEQ ID NO: 83859 - DNA, 673 bp, Homo sapiens
  misc_feature: GYAE6OF01AJRPE.36.23.C01.1.454.CMB.1.raw
  modified_base (230)..(230): a, c, t, g, unknown or other
  misc_feature (230)..(230): n is a, c, g, or t
  modified_base (245)..(245): a, c, t, g, unknown or other
  misc_feature (245)..(245): n is a, c, g, or t
  modified_base (274)..(275): a, c, t, g, unknown or other
  misc_feature (274)..(275): n is a, c, g, or t
  modified_base (368)..(368): a, c, t, g, unknown or other
  misc_feature (368)..(368): n is a, c, g, or t
  modified_base (376)..(376): a, c, t, g, unknown or other
  misc_feature (376)..(376): n is a, c, g, or t
tcagtacgctgtctcacgaccggtgctcgattagtacacgtgattagggattggggggggtcgtcaggaggcaccgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcacgtggaacccngcagttgacgttggngcttataattatgtctccttggttccaannctattcaggcgagccgacccgtaaactcttattagtgagttctttcgccgtcctgtagggtttctagtcgtcttcgccggctcagtctgcacncgcctccngacctatctctacgcctcgaggtctacggaggtacgacggtcttagacttaattgttacgcgatccgtctaattcgtactacggtaaacgtctaacgtcggttaactcccgtaacggttcggttaccgttaccgggtttacccgggggtacggggtaaaccccgggttaaacccggtaaacgggttttaccccggggttaaaaccccggtttccccgggtttaaaaccggggttacccccgggtaaaccgttaccccccgggtaaaccggggtcccccgtttaaacccccccggggg

SEQ ID NO: 83860 - DNA, 835 bp, Homo sapiens
  misc_feature: GYAE6OF01BTZW5.36.23.C01.1.454.CMB.1.raw
  modified_base (172)..(172): a, c, t, g, unknown or other
  misc_feature (172)..(172): n is a, c, g, or t
  modified_base (239)..(239): a, c, t, g, unknown or other
  misc_feature (239)..(239): n is a, c, g, or t
tcagtacgctgtctcacgaccggtgctcgatttagtacacgtgattagggagttggggggggtctcaggaggcagcgctctcaggacatctccaccatggcctgggctctgctgctcctcaccctcctcactcagggcacgagggtcctgggccctagtctggcctgacacngcctgccttcgtgtctgagtactccgtggacaggttcgacttccaccatctcctgcacgtggaaccngcaggtctaggttggtgtcttaataattagtacgttccttccgtcggtttacccaacgtacgacctacttacgaggaccacggacccggtaacccccgtaaatttccgtttaaacttttacgttgggtaacggtttccgtttccggtacccggtcccgttacggttacggggtttctaacgttccggtaccgtttacgtcccgggtactttacccgaacgttcggtacgacccgaaccgtccggtccctcccgtacgaccctaagttccctacgtaccgacccgtccgacggtccgtaacgggtaacggaccggtacgtctttaacgtaccgtttacgttagtttcgaccgttagtacccttacggaaatttcgtaaccgttaggtaaacgtttccggtaaacgttaccgggttaaccttccccggttaaaccggttcgggttaccccggttttgggggtaccccgggggtttaaccggggtaaacccgggggtaacccttaaaccgggggtttacccgggttaaacccggttacccggtttaaacggggtccccgaaaacccggggttaccccgggaacccggggttacccccgg

SEQ ID NO: 83861 - DNA, 921 bp, Homo sapiens
  misc_feature: GYAE6OF01CDUWX.36.23.C01.1.454.CMB.1.raw
  modified_base (257)..(257): a, c, t, g, unknown or other
  misc_feature (257)..(257): n is a, c, g, or t
tcagtacgctgtctcacgaccggtgctcgatttagtacacgtgattagggagttggggggggtctcaggaggcagcgctctcaggacatctccacatggcctgggctctgctgcctcctcaccctcctcactcaggcacgagggtcctgggcccagtctggcctgacacgagcctgccctccgtgtctagacgaccgtccgtggactagtcgaactccaacctactccgttcctgaccgtaacgtaccgggaaaccngtaccgtaaggtcggttaaccggtttgggtacttaccttttaaattaaagtttacgttacggttacccgtttccccgttacggggttttaaccccaaacgtacggtacctaacgtttccggaacgggtacccgaaccgggtaccccccgtaaccccggttaaaaaccgttttaccgtttttaaaaacgtttcgttaaacgggttcccgggtttttccggtttacccgggtttaccccggtaccccgtttaccggggttttaaccggggttttaccgttaccggtacccggttacccgttttccccgtacccggggttacccttaacccggtaaggtttcccgtaacgggtaccccaaacccgggttacccggtcccttccccgtagaaccctcgttaccgttacccgtaaccgtaccgttaccggtacggtaccgtagggaacgggtaccggtagtaaccgttagtaaccgtttactttagtaccgacgttaacgtacgttaacctagttaacgttaacgaaggttactagttaacggttcggtaactcggtacgttcgtaccgggtttggttaccgggaggggtacccgttaacttacgggttcccgttacccggttaaccgttacgtacgtaacccggtaaccccggttcggtacccccggg

SEQ ID NO: 83862 - DNA, 774 bp, Homo sapiens
  misc_feature: GYAE6OF01A3C2K.36.23.C01.1.454.CMB.1.raw
  modified_base (239)..(239): a, c, t, g, unknown or other
  misc_feature (239)..(239): n is a, c, g, or t
tcagtacgctgtctcacgaccggtgctcgatttagtacacgtgattagggagttgggggggggtctcaggaggcagcgctctcaggacatctccaccatggcctgggctctgctgctcctcaccctcctcactcagggcacgagggtcctgggccctagtctggcctgacacagcctgcctccgtgtctgagctccgtggacagtcgatccacctagtcctcctgccacgtcggaaccntcgagtgacggttggtgtacttaattaattagtgttcctccgttggttaccaacgagtcctaattaccgaggaccgacggcccgaccccgtaaacttcgtttaatttacgtggtacggttctttaccggtccgtccgttaggttacgggtttctacggttcgtactttccgtcccggtctcccgtaagttccgtcggtaccgaaaccgtacccggtcccttcccgtacgtaccctacgttccgttaccgtaacgtacccgtacccggtacggtacggtacgggtaaccgggtaaccggtacgggtaccttacggttaaaccgtttaagtttacgttaacgggtactacgttaccgttaacgtaacgtttaacgttaaacgttaggtaaaccgttacgtaacgtttacggtacctacccgtacgttacgggtccgtttaggggttcccgggacgggtaaccggggttaccttaacgggttccggtaacccggttccggtacgggtacccgaaccggtacccggaacggttccccgg

SEQ ID NO: 83863 - DNA, 807 bp, Homo sapiens
  misc_feature: GYAE6OF01EYW77.36.23.C01.1.454.CMB.1.raw
  modified_base (231)..(231): a, c, t, g, unknown or other
  misc_feature (231)..(231): n is a, c, g, or t
  modified_base (245)..(245): a, c, t, g, unknown or other
  misc_feature (245)..(245): n is a, c, g, or t
  modified_base (255)..(255): a, c, t, g, unknown or other
  misc_feature (255)..(255): n is a, c, g, or t
  modified_base (275)..(275): a, c, t, g, unknown or other
  misc_feature (275)..(275): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcnctgtcgtcggtgtntataattatntctcctcgttcgtacacgcntactctaccggccaccggaccgtaccccgtaaaactttactttaaagttttacgttacgtacgggttccgttttccgttccggtcccgttccgttacggggttttccgttacggttccgtccgtttccgttcccggtaccgttacccgtaaacggttccgttacgggtaccgtaaacccgtacccgggtcccgtacccctaccgtaccctaacttacccgttacccttaaccgtaccgtacccgaacgggttccgttacgggaaaggaccccggtaaacgggggtacccgtttaaaacgttttaacgttttttacccgtttacgggttacccgtaacggtttttacccgtaaacgtttaaaccgtttaaacccgtaaaacccccgtaaacggtaccctaaaaccctaacccgtttacccgttacggtaccgtttaacgttttacccggggtcccggggtaaacgggggtaaccccgaaaacggtaccgttacggtaaccccggttacccgttaaacggttacccgtaaccgg

SEQ ID NO: 83864 - DNA, 699 bp, Homo sapiens
  misc_feature: GYAE6OF01BGL4F.36.23.C01.1.454.CMB.1.raw
  modified_base (171)..(171): a, c, t, g, unknown or other
  misc_feature (171)..(171): n is a, c, g, or t
  modified_base (233)..(233): a, c, t, g, unknown or other
  misc_feature (233)..(233): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacgagggtcctcgggcccagtctggcctgacacngcctgcctccgtgtctgacgactccgtggacagtcgatcaccatcctctgcactcggaaccngcagtgacgttgtgtacttataattatgtctccgtgttaccaacgtgctattcgaggcacgccgtaccccgaaacttcttaattagtgtacgttctttccgtaccggtcccttcgtaggtttctacgtcgtcgttctccggtctccgaagtcgcgcaacgaccggcctaccgtcgacctactcctacgtacgtaccgtaccgagtcgaggtacggacgtacgggtacttacggtaacttatttacgtacgtcgtaacgtccgtaactaacgttacgtaacggttaggtaaaccgttattaaccgggttagttaacccgtaccgttacggttgggttaccgttacggggttaccgggggtaaccgggtaaccggggtaaacccgttaacggggtttaccccggtaacccgggtttacccgtaacgggttaccgtaaccccggtaccggaaaccggtttccccccggg

SEQ ID NO: 83865 - DNA, 734 bp, Homo sapiens
  misc_feature: GYAE6OF01B08WB.36.23.C01.1.454.CMB.1.raw
  modified_base (147)..(147): a, c, t, g, unknown or other
  misc_feature (147)..(147): n is a, c, g, or t
  modified_base (235)..(235): a, c, t, g, unknown or other
  misc_feature (235)..(235): n is a, c, g, or t
  modified_base (254)..(254): a, c, t, g, unknown or other
  misc_feature (254)..(254): n is a, c, g, or t
  modified_base (723)..(723): a, c, t, g, unknown or other
  misc_feature (723)..(723): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcgaggcacagggtccngggcccagtctggcctgacacagcctgcctccgtgtctgacgactcgtggacagtcgatccactacttctcctgctacgacggaaccnggacagtggtacgttggtntacttaataattatgttctccgtcgttaccaacagctagttcacgcacgccgacccgtaaacttactttaatttagtagtacggtttcctttcgtccgtccttacggttgggtttcctagttccgtccgtttcgtccggcttaccgtaacgtcgtacgggaaccaccggtacccgtccctacccgtacgtaacccgtattcctaacgtaaccgtacgtacccggtacggttaacgaacgggtaaacgggtaaccggtacgggtccgtttaacgttaaccggtttaactttacggtttaaccgcgtaacggtacctttaacgtaattaaacgttactaaggggtaacttaacgtaagtaacggtaaccttccggttaccgtggtaccgttcggggtaccggggacgggtaaacgggtaaccgtaacggttacccggaccggtttccgtaacggtacgaaccggacccggngttacccccgg

SEQ ID NO: 83866 - DNA, 877 bp, Homo sapiens
  misc_feature: GYAE6OF01EMZ14.36.23.C01.1.454.CMB.1.raw
  modified_base (258)..(258): a, c, t, g, unknown or other
  misc_feature (258)..(258): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacgagggtcctcgggcccagtctggcctgacacagcctgcctcgtgtctgacgacctccgtggacagtcgatccaacctatcctctcgctacgtacggaaccagcaggtgtacggttggtntacttaagttaatttagtcgttccttccgttacggttaacccaaacgtacggtactaacgtttacgaacgggtaccgtacggtaccccggtaacccccgttaaaacttttaccttttaaaagttttacggtacgggtttaaccgggttttcccgtttttacccgggtccccggttaccccgtttacggggttttaacgggggttttacccttaacgggtttccccgttccgtttaccccggtcccggtaccttacccgttaaacggttccggtacggtaaccccaaaccggtcccgtccccttacccgtaacgtaacccgttacgttccgttaacccgtaacgtaccccgttacgggtaacggtaccgttacgggaaacgggtaccggacgggttcctaagtaactttagttacgtcgtaccgtagttcctaacgttaataacgttacgtagtaaccgttaagtaacgttacggtaactacccggtaaggttccggtcggtttacgggttacccgggggaacgggtaaaccgggttaacccggttaacgggttacccggtaaccgggtttaccgacgggtttaacccgacccgggttaccgtaaacccggttcccccgg

SEQ ID NO: 83867 - DNA, 593 bp, Homo sapiens
  misc_feature: GYAE6OF01DZ1PQ.36.23.C01.1.454.CMB.1.raw
  modified_base (228)..(228): a, c, t, g, unknown or other
  misc_feature (228)..(228): n is a, c, g, or t
  modified_base (304)..(304): a, c, t, g, unknown or other
  misc_feature (304)..(304): n is a, c, g, or t
  modified_base (405)..(405): a, c, t, g, unknown or other
  misc_feature (405)..(405): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctgttaccaacagcattcagcagccgaccccgaattcttaatttntgtacgttctttcgtcgtcctcgtaggtttctagtcgtcttctccgctcagtcgtgcacgcgcctcctgacctatctctagctccgagctaggacggacgnggtctagtacttattatcgacacgtctaacattacttacgtagtaagttactaaagttcggtaacttacccgtacggttcggtaccgtttcgggttaccgggacggggtaacgggtaccgtaaacgggtttccgtaaccccgggttcgttaacgggaccgtaacccggcccggtaaacggtcccccgg

SEQ ID NO: 83868 - DNA, 733 bp, Homo sapiens
  misc_feature: GYAE6OF01BMZSE.36.23.C01.1.454.CMB.1.raw
tcagtacgctgtctcacgaccggtgctcgattagtacacgtgattagggattggggggggtctcaggaggcagcgctctcaggacatctccaccatggcctgggctctgctgctcctcaccctcctcactcagggcacgagggtcctgggcccagtctggcctgacacagcctgcctcgtgtctgagacctccgtggacaggtcgatccaacctagtcctcctgacctacgtacggaaaccaggccgtaggtcgtaacggttggtcgtactttaattaaatttatgttaccttccgttacggtttacccaaacgtagtactacgtttcgacggacgacggacccgacccccgtaaacttactttaatttagtacgttacggttcttttaccggtccgtccgttacggtacgggtttctacggtcgtaccttccgtccgtctaccgtaacgttccgtacgaccgtaacgaccggtccctcccgtacgtaccctatccttactaacgtaccctaccgtacggtacgtacggaaacgggacggtacgggtacgtacgtaccgtttaacgtttacgtacggctaaccgtctaacgttaagttaactaacgtaggtaaactacgtaacgttacggtaactccgtacggttcgtcggttacgggtaccggtgggtaaccggttacgtaacggtcgtaccggtccgttacggaccgaccggtacccgtaacggtcccccg

SEQ ID NO: 83869 - DNA, 588 bp, Homo sapiens
  misc_feature: GYAE6OF01CUZC6.36.23.C01.1.454.CMB.1.raw
  modified_base (386)..(386): a, c, t, g, unknown or other
  misc_feature (386)..(386): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagacctcctggacagtcgatcacatcctcctgcactggaaccagcagtgacgttgtgcttataattatgtctcctggttccaacagcattcaggcagccgcccgaaactcttaactttatgtaagttctttcgtcggccttcgtagggtttcctagtcgtctttctcccggctcaacgtctgacaacacggtcctacccngtacccatctctagacctccgaggtctagacggacgaggctgactattacttgctagctcactattacgtagtaagtactaagttggtactcctaacgttcggtacttcggttccgggtaccgggacgggtaacccgttaacgggttacgtaccccggttaccggttacggtacctaacggtaccccgaaacggttccccgg

SEQ ID NO: 83870 - DNA, 824 bp, Homo sapiens
  misc_feature: GYAE6OF01C49ET.36.23.C01.1.454.CMB.1.raw
  modified_base (245)..(245): a, c, t, g, unknown or other
  misc_feature (245)..(245): n is a, c, g, or t
tcagtacgctgtctcacgaccggtgctcgatttagtacacgtgattagggagttggggggggtctcaggaggcagcgctctcaggacatctccaccatggcctgggctctgctgctcctcaccctcctcactcagggcacgacgggtcctgggcccctagtctggcctgacacagcctgcctccgtgtctgacgacctccgtggactagtcgactccacctatcctcctgccacgtacggaaccngcagtgtacgttggtcgtacttaattattagttcgttccttccgttcggttaccaacgtacgtcctagtttaccgacggtaccaccggtaccccgtaaccccggtaaaacttttacttttaaacgttttacggtacggttacgggttttccgtttccgggttcccggtaccccgtttacgggttacgggtttaccttacggttccgttccgtttaccgtcccggtaccttaccgtaacggttcgtacggacccgtaaaccgtcccggtcccttacccgtacgtaacctacttccgtaccgttaacgaccttacccggtaggtccgtagggtaacggaccggtaggtacttacgtaaactttaggtttaacgtcgtaacgtaccgttacttaacgttaacgttaacgttacgttaacgttaacgttaacttaacgggtttcgttaacccttacgtacggttcggttaccggtttaccggggtcgggtaacccgggtacgggttaaacccgttacgggttacccggttaaccccgggtacgttaacggccgtaacccggacccggtacggttaccccccgg

SEQ ID NO: 83871 - DNA, 687 bp, Homo sapiens
  misc_feature: GYAE6OF01CEYZO.36.23.C01.1.454.CMB.1.raw
  modified_base (187)..(187): a, c, t, g, unknown or other
  misc_feature (187)..(187): n is a, c, g, or t
tcagtacgctgtctcacgaccggtgctcgatttagtacacgtgattagggattgggggggaaatactttctgagactcatggacctcctgcacaaagaacatgaaacacctgtggttcttcctcctcctggtggcagctcccagatgggtcctgtctcaggtgcagctgcagcagtcgggcccaggngtggtgaagccttcggagaccctgtcccctcacctgccgctgtgtcgtggacgccctcccgtcggccggagagtgaagtgggtggtaggttcgggtccgccgacggccccgaggggaacggggcgtggtaggttggtagtttagggtagtaaaagtaaagtaggaacgggaccgggggaccaaccgtaaacgtaacaacgtcggccggtaccctcggacggggtacgagtaccaacctatactcgtacgacaacgacaacgtaccaaacgaacctacttcctcccgtgacggtctacgtaccgtcgtgtaccgaccgccggtacggaccgtccggacctataacttagttacgttgtcgtaacgtaggttacgttttggacgttaggtagttcggttcggggtacgttacgtaccggtacggttacgggtcggggtacggtaagggtcgtcggtacggtctacgttccgtccttacccgtctacccgtcccgtaaccccg

SEQ ID NO: 83872 - DNA, 948 bp, Homo sapiens
  misc_feature: GYAE6OF01BW4UI.36.23.C01.1.454.CMB.1.raw
tcagtacgctgtctcacgaccggtgctcgatttagtacacgtgattagggagttgggggggggtctcaggaggcagcgctctcaggacatctccaccatggcctgggctctgctgctcctcaccctcctcactcagggcacagggtcctgggcccagtctcggcctgacacagcctcgcctccgtgtctgacgactcctggacagtcgatccacctatcctcctgaccacgtacgggaaccagaccgtaaggtggtaaccggtttggtagtacctttaaattaacgttttaacgtcgttacccgttcccggttacggtttaacccaaacgacgtccttaacgtttccggaacggtccgaccggtaccccgtaaaccccccggttaaaactttacgtttttaaaccggttttatacgggttaacgttttaccgtttcccggttcccggtaccccgttacggtttcgggggttttactacggtcccgttccgtttccgtacccgggtacctacccgtaacgtttccgtacggacccgtaaacccgtcccgggtaccctttaccccgggtacgaaccccgttaaccgtttccccgttaccgtaaaccgggttaaccccccttacccggggttaacgggttacccgggtttaacgggaaaccggggggttaaccgaccgggggtttcccggttaaacgtttaaacccgtttttaggtttaacccgttttccgggaacttacccgggttacttaacttaaccggtttaattacccgggtaaagttaaccggttaaccctaaggtttacggtacccttaccggaacggttttccggtacgggtttccgggtaaccggggtacccgggtaaaggggttcccccggttaacggtttaacccgcccggggttacccgttaggacccggaaacccgtcccggaaaggttccccccggg

SEQ ID NO: 83873 - DNA, 820 bp, Homo sapiens
  misc_feature: GYAE6OF01B14WW.36.23.C01.1.454.CMB.1.raw
tcagtacgctgtctcacgaccggtgctcgatttagtacacgtgattagggagttgggggggggtctcaggaggcagcgctctcaggacatcctccaccatggcctgggctctgctgctcctcaccctcctcactcgagggcacgacgggtccgtcgggcccagtctcggcctgacacacgtcctcgtccctccgtgtctgacgtacctccgtcggacagtcgactccaacctactcctcctgaccacgtacgaaccgagacgtaggtcggtacggttggtacgtactttaattacgttacgttcgttccttaccgttacggtaaccaacgtacgtaccttaagtaccgacggaccgtaccggaccccgtaaccccgtaaactttacgttttaaacggtttacgtacgggttaccggttttcccgtttacccgggtaccgggtccccgtttacggggtttacgggttttaccgtaccggttccgttacccggtttcccgttacccggtacccttaaccggtaacgggtttccgacggtaacctaacccggtcccggtccccttacccgtacgtacctacttccgttaaccgacgtacccgtacggacgggtacgtacgggacggtaaccggtcggtaactttacggtaactttaacgttagtcgtactacgttcctaacgtaacttaacgtacgttagtaaacgttcgtaacggttacgttaccaccgttagggtcgtacggttcgggtacggaacggtaacggtacgtccggtacggtaccccgtaggtaccggtaaccgcccggtacgaccggttcccg

SEQ ID NO: 83874 - DNA, 917 bp, Homo sapiens
  misc_feature: GYAE6OF01EF74B.36.23.C01.1.454.CMB.1.raw
  modified_base (123)..(123): a, c, t, g, unknown or other
  misc_feature (123)..(123): n is a, c, g, or t
  modified_base (129)..(129): a, c, t, g, unknown or other
  misc_feature (129)..(129): n is a, c, g, or t
  modified_base (133)..(133): a, c, t, g, unknown or other
  misc_feature (133)..(133): n is a, c, g, or t
tcagtacgctgtctcacgaccggtgctcgattagtacacgtgattagggattggggggggtctcaggaggcagcgctctcaggacatcctccaccatggcctgggctctgctgctccctaccncctccncacncgcggcacggcggtcgcggccagtcgcgctgacacgcgctcgcctcgtgtctgactcctcgtacgactcggtacactccaacgtcttcctctcaccgtaccgtaacgaaccgcgacgtacggtacggttaggttcggtacttaactttaatttaagtttcgttccgttcccgtttaccggtttaccgtaaccaacggtctaccttacgttaccggacggtaccgacccggtaccccggtaaaacccctttaaacgttttaacgtttttaaagtttacggtacgggtttaccggtttttcccggtttccgggaccccgttccggtttaacgggtttaccgggtttacgttccggtttacccgtcgtttacccggtccgtaccttaaaccgtcggttccggtaaccgtaaccgaaaccggttccccgttaccccgtaccgtaccgtaaccttacttccgttaacgtaccctaccgtacggtacggtaacggtacgggtacggaaaccgttcggtacgtaacttaacccgtttagttccgtacgtccgtacgtaccttacgttaacgttaccgttaaggttaaccgtaacgttaacgttaacgtaccgggtttacctaccgggttaccggtttacggtccggtttaaaccgggggtaccgggtaaccggggttaacccgttaaacgggtttaccccggggttaaacccggttcccccggtttaaaggggtttccccgaaaaccggggtccccctaaacccggggtttcccggttaaacccccccggg

SEQ ID NO: 83875 - DNA, 860 bp, Homo sapiens
  misc_feature: GYAE6OF01CVVIM.36.23.C01.1.454.CMB.1.raw
tcagtacgctgtctcacgaccggtgctcgatttagtacacgtgattagggagttgggggggaaatactttctgagactcatggacctcctgcacaagaacatagaaacacctgtggttcttcctcctcctggtggcagctccagagtggtcctgtctcaggtgcagctgcgagcgaggtccgggacccgagggaggtgggtacgaagtcccgttacggacgaccctcgtccctccaccgtgcgtctggtgtcgtcggacgtcccgtccgtacggacggagagtagaaggtgggtaggtggttcgggccgccgaccggcccggaaggggacgggtcgtaggtaggttcggtaaggtttaggtaaagtaaaagttaaacggtacggaaccggggtaacccggggacctaaaccggtaaaccgtaaacggaacgttccggtacccggttacccgtacgggtacggggtaacgtaccgttaaccaaccgtaagtactttaccgacgaacgtaacgtaaaccgtaaaacggaacccgtaaaaccgtaaccctaccctttcccgtacccgtagggtaccggtccgttaccgtacccgtcggttaccggaccccggtacccgggacccggtaaccgggtaccccgtaccggaaccttaacttaacgtttaacgtttaggttacgggtacgttaaccggttaaggttttacgtttacggacgggtaaggtttcgttcggggtaacgggggttaccgttacggttaccggggtacggttacggggtacgggttaaccggtacgggttacctacgggtaccttcgtaacggtcccgttccgtaccctccgtaccgtccccgtaaacccgg

SEQ ID NO: 83876 - DNA, 802 bp, Homo sapiens
  misc_feature: GYAE6OF01EMFXS.36.23.C01.1.454.CMB.1.raw
  modified_base (231)..(231): a, c, t, g, unknown or other
  misc_feature (231)..(231): n is a, c, g, or t
tcagtacgctgtctcacgaccggtgctcgattagtacacgtgattagggattgggggggggtctcaggaggcaccgctctcaggacatctccaccatggcctgggctctgctgctcctcaccctctcactcagggcacgagggtcctgggcccagtctggcctgacacagcctgcctcgtgtctgagcctctggacagtcgatcacctatcctcctgccacgtcggaaccngcagtcgtacgtttggtagtacttaattaagttagttcgttccttccgttacgggttaaccaaacgtagtacctagttaccgacggtacaaccggacccgtaacccccgttaaaactttacgttttaaaacgttttaagtcgggttaacggttttccgttttacccgggtacccggttacccccgtttagggtttacggggttttaccctacgggttcccgttccgtttaccgtcccggtaccttaaccgtaacggttcgtacggaccctaaaccgggtcccgtacccttacccgtacggtaacccttacttacccgtactaccgtaaccgtaccgaacggttacgtacgggaacggaccgggttaacgtccgttaggtaaacgtttaacgtttacggtaccgacgttaccgtacgttactaacgttaacgtacgtaagtaaacgttacgtaacgttaggtaacctcgtaaccgtgtccgttacgggttaccgggacggttaacgggaaccgtacggttaccgtacccgtacggttacgaaccgaccgtaccgtaacgtcccggtaccccg

SEQ ID NO: 83877 - DNA, 745 bp, Homo sapiens
  misc_feature: GYAE6OF01DH7LC.36.23.C01.1.454.CMB.1.raw
  modified_base (241)..(241): a, c, t, g, unknown or other
  misc_feature (241)..(241): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacgacgggtcctgggcccagtcgtggcctgacacagccctgccctccgtgtctgagtacctccgtggacagtccgatcaccatcctcctgcacgtacggaaccngcacggtgtacggttggtcgtactttaattaattacgttcgttaccttccgttacggtttacccaactacggtactagtttaccgaaggtccacggacccgtaacccccgtaaacttactttaaagttttacgtcggttaacggtttcctttacggtcccggtacccgttacggtacgggttttctacggttccgtacgttcccgtccggtacctaccgtacgtcgttacggaccctaaaccgtcccggtacccttccctacggtacctacttccgttacgtaccgtacccgtaccgacggttcgacgggaacggtaccggacggtccgtacgtacttaacgtttacgttacgactacgtcttaacctaattacgtaacgttagtaacgttactaacgttagtacgtacccgtagtcggtaccgttcgggtacgggacgggtaacggtaccgttaccggttcgtacccgttccggtaacggtccgaacgacccgacgtccccgg

SEQ ID NO: 83878 - DNA, 655 bp, Homo sapiens
  misc_feature: GYAE6OF01ATN7I.36.23.C01.1.454.CMB.1.raw
  modified_base (231)..(231): a, c, t, g, unknown or other
  misc_feature (231)..(231): n is a, c, g, or t
  modified_base (248)..(248): a, c, t, g, unknown or other
  misc_feature (248)..(248): n is a, c, g, or t
  modified_base (281)..(281): a, c, t, g, unknown or other
  misc_feature (281)..(281): n is a, c, g, or t
  modified_base (421)..(421): a, c, t, g, unknown or other
  misc_feature (421)..(421): n is a, c, g, or t
tcagtacgctgtctcacgaccggtgctcgattagtacacgtgattagggattgggggggggtctcaggaggcagcgctctcaggacatctccaccatggcctgggctctgctgctcctcaccctcctcactcagggcacgagggtcctgggcccagtctggcctgacacagcctgcctccgtgtctgagactcctggacacgtcgatcaccatcctcctgcactggaaccngccagtcgacgttggtnactttaataattatgtcctccgttggttccaanagctatcgaggcacgccgaccccgtaaatcttttaatttagtggagttctttcgtccggccttcgtaggggtttctacgtcgtcttcgtccggtcttaccgaagtcgtcggaccaacgtaccggccctccgtacaccctntcctctacgactcccgagtccgtgaacggacgcggtctagtacttattatcgctagccttagaattacgaccttgaaattccgttaaagttcggttaactccgtaacggttcggtaaccgttcgggggttcccgggaacgggtaaccgggtaacccgttaaagggtttacccgggaacccccgtttacgggtaacccggtacccgacccggtaaccccggtaagggtccccccg

SEQ ID NO: 83879 - DNA, 785 bp, Homo sapiens
  misc_feature: GYAE6OF01CWXXB.36.23.C01.1.454.CMB.1.raw
  modified_base (204)..(204): a, c, t, g, unknown or other
  misc_feature (204)..(204): n is a, c, g, or t
  modified_base (209)..(209): a, c, t, g, unknown or other
  misc_feature (209)..(209): n is a, c, g, or t
  modified_base (222)..(222): a, c, t, g, unknown or other
  misc_feature (222)..(222): n is a, c, g, or t
  modified_base (242)..(242): a, c, t, g, unknown or other
  misc_feature (242)..(242): n is a, c, g, or t
  modified_base (274)..(274): a, c, t, g, unknown or other
  misc_feature (274)..(274): n is a, c, g, or t
  modified_base (295)..(295): a, c, t, g, unknown or other
  misc_feature (295)..(295): n is a, c, g, or t
  modified_base (339)..(339): a, c, t, g, unknown or other
  misc_feature (339)..(339): n is a, c, g, or t
tcagtacgctgtctcacgaccggtgctcgatttagtacacgtgattagggagttggggggggtctcaggaggcagcgctctcaggacatctccaccatggcctgggctctgctgctcctcaccctcctcactcgaggcacgagggtcctcgggcccagtcgtggcctgacacacgcctcgcctccgtgtctggacgacctccgnggacngtcgactcacctntctcctgcacgtacggaacngctaggtgtacggttggtatacttaattaatnttcgtccttccgtcgtaccancgctagtcgagcacgtcccgaaccgtaatttactttaattacgnggttaccgtttcgttccggtccggtaccgtttcggttacgggtttctacggttccgtccgtttcccgtaccggtcctaacgtaacggtcgtaaccgggacctaacccggtacccggtcccttacccgtaccgtaacccttacgttccccgtaacgtacccgtaacccgttaccggacgggttaccggtaacggggaaaccgggttacccgtagggttacccgttaacgttaacgtttaaccggtttcgtcggtaaccgttacgttaacccttaaggttaacctttaacggtaaccgttaaggtaaacttaccgttaaggttaccgtaccctaccgttacggttcgggttaccgttcggggtaaccgggacgggttaaccggtaaaccgttaggttccccgtaaccggttacgtacggacccgaaccggcccgtaacgggtcccccg

SEQ ID NO: 83880 - DNA, 499 bp, Homo sapiens
  misc_feature: GYAE6OF01BVVBE.36.23.C01.1.454.CMB.1.raw
  modified_base (228)..(228): a, c, t, g, unknown or other
  misc_feature (228)..(228): n is a, c, g, or t
  modified_base (367)..(367): a, c, t, g, unknown or other
  misc_feature (367)..(367): n is a, c, g, or t
  modified_base (451)..(451): a, c, t, g, unknown or other
  misc_feature (451)..(451): n is a, c, g, or t
  modified_base (488)..(488): a, c, t, g, unknown or other
  misc_feature (488)..(488): n is a, c, g, or t
  modified_base (494)..(494): a, c, t, g, unknown or other
  misc_feature (494)..(494): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggcagccgccccgaaattcttaatttatgagttctttcgtcggccctcgtagggtttctagtcgcttctccggctccagtctggcaacncggcctccctgaccatctctagactccaggctgaggacgaggctgacttattattgcagctcatatactagaatcatgtactcnctaagctggtcggcggaggcagtcgaccgtctagtcncgccgngtccg

SEQ ID NO: 83881 - DNA, 1091 bp, Homo sapiens
  misc_feature: GYAE6OF01B4M9D.36.23.C01.1.454.CMB.1.raw
tcagtacgctgtctcacgaccggtgctcgatttagtacacgtgattagggagttggggggggtctcaggaggcagcgctctcaggacatctccaccatggcctgggctctgctgcctcctcaccctcctcactcagggcacgagggtcctgggcccagtctggcctgacacagcctgccctccgtgtctgacgtactccgtggacagtcgatccacctattcctcctgacctacgtacggaaccaggcgtaggtgtacggttggtcgtactttaattaatttacgttcgttccttcccgtttacgggtttacccaaaacgtacggtaccttaacgtttaccgaacggggtaccgaaccgggaccccggtaaacccccccggttaaaacttttaaccgtttttaaaacgttttaacggtacggggtttaacgggtttttcccgttttcccggggttacccgggtaccccccgtttacggggttttaaccggggggtttttaccttaaccgggtttcccggtttaccccgtttttacccgggtcccccgggtaccctttttaaccccggtaaaacgggtttcccggtaccggggtaaaccccgtaaaaccccggttacccccggggttacccccctttacccccggttaacggtaaacccccgtttacgtttacccccgtttaaaccggtaacccgggttaacccccttaccccgggtaaacggggttccggttaaacgggggaaaccggggtaaacccgggtaccggggttaacccgtttaacggttaaaccgttttaaacgttttacggttaccggacgttaaccggttaccctacgtttaacgttaaaccgtttaaccgttaaaggtaaaccggtttacgttaaacggtttacgggttaaccttaaccccggttagttaccgggttaccgggttttaccggggtaaccggggggtaaccgggggttaaaccggggttaaccccggttaaaggggttttaccccgggtaaacccccgggttttaaccgggttaaccggggtacccgtaaaccccgggtaaaccccgggtaaccgggggtttccccccccgg

SEQ ID NO: 83882 - DNA, 822 bp, Homo sapiens
  misc_feature: GYAE6OF01C4IOP.36.23.C01.1.454.CMB.1.raw
  modified_base (175)..(175): a, c, t, g, unknown or other
  misc_feature (175)..(175): n is a, c, g, or t
  modified_base (255)..(255): a, c, t, g, unknown or other
  misc_feature (255)..(255): n is a, c, g, or t
  modified_base (333)..(333): a, c, t, g, unknown or other
  misc_feature (333)..(333): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcgagggcacgacgggtcctgggcccagtcgtcggcctgacacncgcctcgcctacgtgtctgacgtacctccgtaggactaggtcactcacctacttccttccgtgcctaacgacggaaaccncggtactaggtcggttaccggttggttcttactttaattaacgtttattcgtccgtttaccgtacggttacccaacgngtcctagttccggacgggcctaaccggtacccgaaccccgttaaacgtttacttttaacgtttagtcggttaccggtttaccgtttccggcccggtaccgttcgggttacgggtttcctacggttccgttaccttcccgtccggttacctaacgtacggtccgtacggacctaaccgtccggtcccttccctacgaacctcgtacctaccgttacgacccgtaccggtagtccgtaacgggacgggaccgtagggtaccttacgttaaccgttatttacgttccgacgtactacttaaccgttaacgttaacgttacgtaacggtaaccgtttacggtaacgtttacgtaccttcccggtacgttccgggttacgggtaccggggttaccgggaaacgggggttaacgtaaaccggtttaccgggttaccggtccggtttaccgggtaacgggtacccgaacccgggtccgttacccggtacccccggg

SEQ ID NO: 83883 - DNA, 906 bp, Homo sapiens
  misc_feature: GYAE6OF01DNGXU.36.23.C01.1.454.CMB.1.raw
  modified_base (276)..(276): a, c, t, g, unknown or other
  misc_feature (276)..(276): n is a, c, g, or t
tcagtacgctgtctcacgaccggtgctcgatttagtacacgtgattagggagttgggggggggtctcaggaggcagcgctctcaggacatcctccaccatcggccgtgggctctgctgcctcctccaccctcctcactcgagggcacgacgggtccgtcgggcccagtcgtcggtcctcgaccacacgtcctcgtcccgtccgtgtctgacgtaccttccgtaggacgagtccgactaccacctacttcctccgtacgcctaacgtacggaacccnggacgtacggtcggtacggttggttacgttaacttaatttaattacgttcgttccgttaccgttacgtaaccaaacgtcgtactagttaccggacggccgtaaccggtaccccggtaaacccttaaactttctttaaacgttttaggacggttttaccggttttcccgtttccgggtccccggtacccggtttcggggtttaaccgggtttccgttaccggtttcccggtttcccgtttcccggtacccgtacccgttacgtaacggttccgaaacgtacccgtaacccggtacccggtccccttacccggtacctaccttactttacccgtaaccgtacccgttaccgtaccggcggtaacccggtagggaaccgggtacggtacgtacgttaaccttaagtttacgttagtcccgtaacttaccgtaaccgttcgtaaacttacgttaaccggttataaccggttataaccggttacgggttaccctacccgggttgttcggggttacccggtttacgggggacccggggaaacgggttaccggtaacccggttaccgggttaccccggtaccggttaaccgggaacctacccggggacccttaacccgggcccggttaaccccccgg

SEQ ID NO: 83884 - DNA, 678 bp, Homo sapiens
  misc_feature: GYAE6OF01A2KUF.36.23.C01.1.454.CMB.1.raw
  modified_base (202)..(202): a, c, t, g, unknown or other
  misc_feature (202)..(202): n is a, c, g, or t
tcagtacgctgtctcacgaccggtgctcgatttagtacacgtgattagggagttgggggggggtctcaggaggcagcgctctcaggacatctccaccatggcctgggctctgctgctcctcaccctcctcactcagggcacgagggtcctgggcccagtctggcctgacacagcctgcctccgtgtctgagactcctggacngtcgatcaccatcctctgcacgtcggaaccagcaggtgtacggttggtgtactttaataattattcgtactccgttacggttaccaacgtacgtctagttcgaggccacggtaccccgaccctaaaatttcctttaaatttacgtacggtacggtttccgtttaccggtcccggtaccttcggttacggggtttactacggttccgtctttccgccggtactaccgtagtcgtacgaccaaccgtccggtccctccgtacgacctactcctacgtacgacctcgaggtctaggaacggacgcgtctagtacttagtacgttgacctagtacctagtaacttacgtacgtacggtaattacgtaagttcgacttacgtacgttcgggtcgttacggggtccggtacggggaacggtaccgtacgggttaccgacccgtaccggttacgggaccgaacggtacccggacggttcccgg

SEQ ID NO: 83885 - DNA, 676 bp, Homo sapiens
  misc_feature: GYAE6OF01AJBHI.36.23.C01.1.454.CMB.1.raw
  modified_base (231)..(231): a, c, t, g, unknown or other
  misc_feature (231)..(231): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgccctccgtgtctgacgactcctggacagtcgatcaccatcctcctgccactggaaccngcaggtgacgttggtgtcttataattatgtctcctggttccaacagctattcgaggcagccgaccccgaaacttctttaatttatgtaggttcctttcggtccgtcccttcgtacggggttttctacggttccgtctttcgcccggtctccgagtcgtcggaccaacgaccggtccctcccgtcgacctactcctactacgacctccgaggtccgtaggacgggacggacggtcgttacgtacgttatttacgttcgctacgtcctagtaacttactacgttacgtaaacgttactaagtcggttaccgtcccgtacgtcgggtaccgtttcggggttacccgggaccggggttaacgggtaacccgttaacggttacccgggtaaccccggtttaccggttacgggtacccgaacccgggtaccccggtaaacgggtcccccgg

SEQ ID NO: 83886 - DNA, 801 bp, Homo sapiens
  misc_feature: GYAE6OF01A2K8P.36.23.C01.1.454.CMB.1.raw
  modified_base (239)..(239): a, c, t, g, unknown or other
  misc_feature (239)..(239): n is a, c, g, or t
tcagtacgctgtctcacgaccggtgctcgattagtacacgtgattagggattggggggggtctcaggaggcaccgctctcaggacatctccaccatggcctgggctctgctgctcctcaccctcctcactcagggcacgagggtcctgggcccagtctggcctgacacagcctgcctccgtgtctgacgtactcctggacagtcgactccactactcctcgtcgactacgtacgaaccngcgtaggtcggtacggttggtacttacttaattaattagtcgttacccttcgttacgtacccaagtcgtactacgttacggacggtccaaccgggtacccctaaacccgttaaacttttaccgttttaaagtttcgtacgggtttaccggtttccgtttccgggtccccgggtaccgtttagggtttaccggggttttactccgttcccgtttccgttaccgtcccgggtacttaccgtaaccgggtcgtaccggtaacccgaaaccggtccccggttccctaccgtaccgtaaccttcgttaccgttaccgtaccgtaccgtacggtacggttaaccgtacggggtaaccgggtacggtaacccggtcgtttaaaccgttaacgttttaagtttacccggtacgtccggtaactccttaactaaggtttactaacggtagttaacccgtaagttacgttacgtacctccggtagtccggtgtaccggggtacgggacgggttagaccggttcggtacccgtagttccgtacggaccaccggcgtacccgtccggtaccccg

SEQ ID NO: 83887 - DNA, 771 bp, Homo sapiens
  misc_feature: GYAE6OF01C6UVK.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacgagggtcctgggcccagtctggcctgacacagcctgccctccgtgtctgagacctccgtggacagtcgaatccacctatcctctgcacgtggaaccagcagtcgtacggttggtacgtactttaattaatttacttcggttccttcccgttcgggtttaacccaaacgtacggtacttaacgtttaccggaacgggtaccgaaccggtaccccgtaaccccccgttaaaaactttaccgttttaaattttacggttacggttaaccgggttttccgtttcccgggttacccggtaccccggttacggttaacggggttttcctacggttccgttccgtttcccgcccggtaccttaccgtaacggttccgtacgggacctaaccgtcccggtccctccgtacgacctacttccgtacgtacgacgtcgtacgcgtaggacgggtacgacgtcgtagtaccgttattacgtcgacgtacgcttaagaaccgttagtaccgtagtaacgttaacgtaacgtacgtacctccgtactcgggttgtaccgggttggggaaccggtaacggtacgttaacgggttccgtaaaccggtttccgacggttaccgaaccggtacccgtaacggtccccgg

SEQ ID NO: 83888 - DNA, 712 bp, Homo sapiens
  misc_feature: GYAE6OF01BI3UC.36.23.C01.1.454.CMB.1.raw
tcagtacgctgtctcacgaccggtgctcgatttagtacacgtgattagggattggggggggaaatactttctgagactcatggacctcctgcacaagaacatgaaacacctgtggttcttcctcctcctggtggcagctcccagatgggtcctgtctcaggtgcagctgcagcaggtcgggcccagggagtgggtagaacgtccgttcggacgacccctcgtcccctcaccgtgccgtctgtgtcgtcggacgtccctcccgtcggcggagtagtgagtggtggtaggttcgggtccgccgaccggcccggaggggacgggcgtggtaggttggtagttgggtagtaaagtaagtggacggaccggggacaaccgaacgtaacaagtacgccgtacccgtacggacggggtcgacgtaccactatactcgtcgacaacgacaacgtaaccaacgaacctaccttaccttccgtagtaccgtcgtacgtacctcgtcggtaccgacccggccgaccggtccgtccggtacctattagttatttacgttcgtaggcgttagtttacgttttgaccggttaggttcggttacgggttcggggtcgtaggttaccgttcgggttcgggttacggggtaccggtagggtaccgttcggtaccgggtcctacgttcccgttacccgtcccgtacgtacccggttccccgtaaccccgg

SEQ ID NO: 83889 - DNA, 794 bp, Homo sapiens
  misc_feature: GYAE6OF01B9SIG.36.23.C01.1.454.CMB.1.raw
  modified_base (212)..(212): a, c, t, g, unknown or other
  misc_feature (212)..(212): n is a, c, g, or t
tcagtacgctgtctcacgaccggtgctcgatttagtacacgtgatttagggagttggggggggtctcgaggaggcagcgctcgtcaggacatcctccaccatggcctggctctgctgctcctccaccctctcactcgaggcacgcgggtcctcgggcccagtccgtggcctgacacgagcctcgccttccgtgtctagacgactcgtggacngtcgactccaccgtatcctcgtgacaacgtacggaaccagccgaggtcgtacggttggtcgttactttaattaagtttactcggttaccttccggttacggttacccaagcgtacgttacttacggaacggaccgtaaccggtcccggtaaaccccgttaaaactttacgttttaaacgttttgtccggttaacggttttccgtttacccgggttccggtaccccgttagggtttaacgggtttccttcgtcccggttacctttcccggaccggtaccctaccgttaaggtcgtaccgaacgtaacccgccggtccctaccgtactaccgtacttcgtacctaacgtcctcggacgggacttacgggaacggacgtacggtccgtagttaacctttagttctacggtcaacgttcgtaactaattaccggtacgtagaacgttactagttacggtacctacgtacgggttcgtcgggttaacgggtccggggaaggtaaccggttaaccgttacggttacccgggtaacccggttacgttaccggggaacccgtacccgtaccgggggtaacttccccccgg

SEQ ID NO: 83890 - DNA, 829 bp, Homo sapiens
  misc_feature: GYAE6OF01CCECQ.36.23.C01.1.454.CMB.1.raw
  modified_base (223)..(223): a, c, t, g, unknown or other
  misc_feature (223)..(223): n is a, c, g, or t
tcagtacgctgtctcacgaccggtgctcgattagtacacgtgattagggagttgggggggggtctcaggaggcagcgctctcaggacatctccaccatggcctgggctctgctgctcctcaccctctcactcagggcacgtaggtcctgggccctagtctggcctagaccacagcctgcctccgtgtactgacgactcgtggacagtcgatcacctatctccngacacgtcggaaccagcaaggtgtacggttgtacgtactttaataagtttactgttcctaccgttcggttacccaagtacgtactacgttacggaaggaccaaggtacccgtaaccccgtaaaactttacgttttaaactttaagtacggtaacggtttccgtttaccggtccgggtaccccgttaggtacggggtttacctacggttccgtcttaccggtccgtctaaccgtaagtctcggaccaaaccgtccggtcccttaccgtacgacctacttacctacgtaaccggtaccttaccggaacggttaccgagggaaaccgggaccggtaagggtaccttaacgtaacctttaagttacgtttacggaacgtaacggttacttaaaccggtaaacttaacggttaaacttacgtaaaacggttactaaacggttacgggtaaaccgtttacccggtaaaccgttgggttacccgggttaccggggtttacggggaaaacccgggggttacggggttaaacccgttacgggtttaaccccggaaaccggtttcccgggtaaaaccgggtaccgtaaaccggtccccgttaacggggtacccccg

SEQ ID NO: 83891 - DNA, 686 bp, Homo sapiens
  misc_feature: GYAE6OF01AN39F.36.23.C01.1.454.CMB.1.raw
  modified_base (170)..(170): a, c, t, g, unknown or other
  misc_feature (170)..(170): n is a, c, g, or t
  modified_base (238)..(238): a, c, t, g, unknown or other
  misc_feature (238)..(238): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacgagggtcctgggcccagtctggcctgacacngcctgccctccgtgtctgacgactcctggacagtcgatccaccattcctcctgccacgtacggaaccngcgagtcgtacggtttggtcgtacttaattaatttatcgttccttccgttaggttacccaacgacgtctacttcgacggtcaacggcccgaccccgtaaacttctttaagtttctggtacggtttcctttacggtcccgtccgttcggttacggtttctacggtccgtcctttacgtcccgtactaccgtaagttcgtcgtacaaccgtccggtccctcccgtacgacccttattcctacgtaacgtccctccgaggtccgtacgggtacggaacggtcgttactacgtacgtttaattcgtagtcacgtctagtacttacgtacgttagaacttagtacgttcgtactccgtagtcggtacggtttcggaccgggttcgggaacggtaccgttacgttaccggtacccgttacggtacggtacccgacgtacccgtacggtccccgg

SEQ ID NO: 83892 - DNA, 648 bp, Homo sapiens
  misc_feature: GYAE6OF01ACFZH.36.23.C01.1.454.CMB.1.raw
  modified_base (228)..(228): a, c, t, g, unknown or other
  misc_feature (228)..(228): n is a, c, g, or t
  modified_base (265)..(265): a, c, t, g, unknown or other
  misc_feature (265)..(265): n is a, c, g, or t
  modified_base (299)..(299): a, c, t, g, unknown or other
  misc_feature (299)..(299): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttgtgcttataattatgtctctgtcaanagctatcagcacgccgacccgaacttcttaattntgtacggttcgtttcgtcggtcccttcgtacgggtttctacggtcgtctttcgtcccggtcttaccgaagttcgtcggacaccgaccggtccctacccgtcgacctacttccgtactacgacctccgaggtctaggacggtacggacgtcttaggtaactttaacgttacgttcgacgtacgtcttacgtaacttaacgttacgtacggtaaacttacgtaaagttcggttaactttcgacgttcggtcgttacgggttccgggagggtaaccgggtaccgttaacgggttaccgggtacccggttaccgttaagggtacccgacccggacccggtaagggtcccccgg

SEQ ID NO: 83893 - DNA, 914 bp, Homo sapiens
  misc_feature: GYAE6OF01D8NNC.36.23.C01.1.454.CMB.1.raw
  modified_base (173)..(173): a, c, t, g, unknown or other
  misc_feature (173)..(173): n is a, c, g, or t
  modified_base (224)..(224): a, c, t, g, unknown or other
  misc_feature (224)..(224): n is a, c, g, or t
tcagtacgctgtctcacgaccggtgctcgatttagtacacgtgattagggagttgggggggggtctcaggaggcagcgctctcaggacatctccaccatgcctgggctctgctgctcctccaccctcctcactcgagggcacgagggtcctgggcccagtctggcctgacacngcctgccctccgtgtctgacgtacctccgtaggacagtcgactccaacctntcctcctcgacacgtacggaaccagcgtaggtgtacggttggtagtactttaattaatttagtcgttccgttccgttacggttacccaaacgtacgtactacgttccgaagggccaaccgggtaccccggtaacccccgttaaaacttttaccgttttaaaacgtttttacgtacgggtttaacgggttttcccgtttttccgggtaccccgggtccccgtttacggttaccgggggttttctacggttccgtccgtttaccccggtcccggtaccgtaacccgttacgggttccgacggtaccctaaaccggtccccggtaccccttcccgaccgtaacctacgttcccttaacccggaacgtcccgttaccgggacggtacggttagggaacggggtacggtaccgggtactttaacgttaacgttttagtttaccgttacggacctaacgtccttaacttaaacgttaccgttaaacgttacgttaaaacggttacccgtaagtttaccggttaacccgttacccgttacgggttaccgggttaccgggtttccgggggtaaccccgggggtaaggggtaaacccgggttaaccgttaaccggggtttaccccggtaaaccccgggtttccgggttaaaccggtacccggtaacccggtaacccgggtaaccgggttcccccccggg

SEQ ID NO: 83894 - DNA, 823 bp, Homo sapiens
  misc_feature: GYAE6OF01ASF7S.36.23.C01.1.454.CMB.1.raw
  modified_base (244)..(244): a, c, t, g, unknown or other
  misc_feature (244)..(244): n is a, c, g, or t
tcagtacgctgtctcacgaccggtgctcgatttagtacacgtgattagggattgggggggggtctcaggaggcagcgctctcaggacatctccaccatggcctgggctctgctgcctcctcaccctcctcactcagggcacgagggtcctcgggccctattctggcctgacacagcctgcctccgtgtctgacgactccgtggacagtcgatccgaccatcctccgtgccaacgtcggaaaccngcgtagtcgtacggttggtcgtacttaattaattacgtcgttcctccgttacggttaccaacgtacgtcctaacttcgaggtccgaaccgcccgtaaccccgtaaacttaccgtttaaatttacgtggtaacgtttccgtttccggtccggtacccgtttcgggtacgggttttcctacggttcccggtacgtttcccgtcccggtacctaccgtaacggttccgtacggaccgaaacccgtccgggccccttacccgtacgtaacccttacgttccctaccgtaccgtacccgtaccggtacggtaccggtaacgggacgggtaacggacggtaccgtttacggtaaactttacgttacgttacgacgtaacgtcgttaaccttacgtaacgtttaaccgtaaggtaaaccgttacgtaaagttccggtaattaccccggtaggttccggtaccgggttcggggttacccggggaacggggttaaaccgggtaccgttaaaccgggttcccggtaaccccggtttaccgggtaacccgggtaaccgaacccgggtaccccggtaacgggttaccccgg

SEQ ID NO: 83895 - DNA, 825 bp, Homo sapiens
  misc_feature: GYAE6OF01AR0EM.36.23.C01.1.454.CMB.1.raw
tcagtacgctgtctcacgaccggtgctcgatttagtacacgtgattagggattgggggggaaatactttctgagactcatggacctcctgcacaagaacatgaaacacctgtggttcttcctcctcctggtggcagctcccagatgggtcctgtctcaggtgcagctgcagcagtcggcccaggagtggtgaagccttcggagaccctgtcccctcacctgcgcctgtgtctggacgcctccctggcggtagatgaatggtggagttcgggtccgccacggccccgagggaacgggctggtacgttggagtttggtagtaaaacgtaaagtcggaacggtaacccgggggaccaacccgtaaaccgtacgaaacgttcggaccggttccccgtacggtacgggggtaccgacgttaccgaacccgtaacgttaccgttcgtacggaccgtaacggtaaacctaaaccggttaccccgaaaccggtaaacccctacccggtttaccttaccccgtaggtaaccgggtaccttacggtacccgttccgttacggttaccggaaccccggtacccgggacccgggtacccgttacccgggaccctaagtttaccgttaacgttttacgttacggttacggtaccggttaaggtttacgggttttttacgaccggtaagggttacgttaccgggtttacgggggtaccggttaacggttccgggtaaccggttcgggttacggggttacgaacgggggttacttaccgggtaaccggtttcgaaaccgtttccgtacccttaccgtaccgtaccgtcccgtaaccccgg

SEQ ID NO: 83896 - DNA, 591 bp, Homo sapiens
  misc_feature: GYAE6OF01EZO4E.36.23.C01.1.454.CMB.1.raw
  modified_base (198)..(198): a, c, t, g, unknown or other
  misc_feature (198)..(198): n is a, c, g, or t
  modified_base (209)..(209): a, c, t, g, unknown or other
  misc_feature (209)..(209): n is a, c, g, or t
  modified_base (226)..(226): a, c, t, g, unknown or other
  misc_feature (226)..(226): n is a, c, g, or t
  modified_base (239)..(239): a, c, t, g, unknown or other
  misc_feature (239)..(239): n is a, c, g, or t
  modified_base (248)..(248): a, c, t, g, unknown or other
  misc_feature (248)..(248): n is a, c, g, or t
  modified_base (261)..(262): a, c, t, g, unknown or other
  misc_feature (261)..(262): n is a, c, g, or t
  modified_base (266)..(266): a, c, t, g, unknown or other
  misc_feature (266)..(266): n is a, c, g, or t
  modified_base (269)..(269): a, c, t, g, unknown or other
  misc_feature (269)..(269): n is a, c, g, or t
  modified_base (291)..(291): a, c, t, g, unknown or other
  misc_feature (291)..(291): n is a, c, g, or t
  modified_base (371)..(371): a, c, t, g, unknown or other
  misc_feature (371)..(371): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagctcctggacngtcgatcaccntctcctgcactggaccngcagtgacgttgngcttatatntgtctctgtccanncatngcngccgacccgaattcttaattgngtagtctttcgtccgcctgtacggtttctagtctcttccgtccgctccgagtctgaccacgtccggccctccgtgacctntcctcgtacgtcctcgtaggcgtaggacggacgtacggtcctagtacttagtttagtcgaccagtcctacgtaattacgtacgtaacgtaacttacgaagttcgtacctaccgtacgttggtaccgttgggttcccggggacggtaacgggtaccttaacgggttaccggtaacccgttaccggtaacggtaccgtaaccggacccggtaacggtccccg

SEQ ID NO: 83897 - DNA, 751 bp, Homo sapiens
  misc_feature: GYAE6OF01DE824.36.23.C01.1.454.CMB.1.raw
  modified_base (213)..(213): a, c, t, g, unknown or other
  misc_feature (213)..(213): n is a, c, g, or t
  modified_base (244)..(244): a, c, t, g, unknown or other
  misc_feature (244)..(244): n is a, c, g, or t
  modified_base (745)..(745): a, c, t, g, unknown or other
  misc_feature (745)..(745): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcgagggcacgacgggtccgtcgggccccaggtcgtcggcctgacacacgcctcgcctccgtgtctggagacctccgtggacngtcgatcaccatcctcctgcacgtggaaccngctagtcgtacgttggtgtacttaattaattattcgttccttcccgttacggttacccaaacgtcgtacctagttacgaacgggccacggaccccgtaaccccgtaaaactttacctttaaattttacggtacggttacggtttccttttaccggtcccgggtaccccgtttacgggttacggggttttacctacgggttccgtacccgttttcccggtcccggttaccttaccgtaaacggttccgtacggtacccaaaccgtcccggtccccttccccgtagaccctacttccgtacctaacgtacgtacccgagggtacgtaaggggtaacgggtaccggtaggtacctaggtaacctttagtttaacgttcggacttacgtctaacgtacttaacttacgtaaggtaacgtacgtaagttacggtacctcgtacggtcgtacgtcgggtcgggacggtacggtacgtacggtctaccgtcgtacggtcgacgtccgnggtccc

SEQ ID NO: 83898 - DNA, 862 bp, Homo sapiens
  misc_feature: GYAE6OF01CBYX8.36.23.C01.1.454.CMB.1.raw
  modified_base (178)..(178): a, c, t, g, unknown or other
  misc_feature (178)..(178): n is a, c, g, or t
tcagtacgctgtctcacgaccggtgctcgatttagtacacgtgattagggagttgggggggggtctcaggaggcagcgctctcaggacatctccaccatggcctgggctctgctgcctcctccaccctcctcacgtcgacgggcacgagggtcctcgggcccagtctggcctgacacngcctgcctcgtgtctgacgtacctccgtggactagtcgatccacctacttcctccgtgacctaccgtacggaaccagaccgtaggttcggtacggtttggttacgttactttaaagttaaattttcgttccgttcccgtttacccgttacgggtttaaccccaaacgtacggtaccttaacgttccggaacgggtccgaaccggaccccggtaaacccccttaaaactttacgttttaaacgttttaggtacggttacggttttcccgtttccgggtaccccggtacccgtttacgggttacgggttttaccctacggttccgtccgttttcccggcccggttaccttaccggtaacggttccgtacgggaccctaaacccggtcccggtaccccgttacccgtacgtacccttacttccgtaaccgtaccgacccgttccggacgggtactacggggacgtacggacgtcgttacgttaacgttatttccgtcgactacgtcctaactaattacgtaacgtacggtaacttacgtaacgttgtaacccgttaacgtcggttcggttacggttacggggtaccgggtaagggtaaacccgggttacgttaacgggtttccccggttaacggttacccggtaacggttaccgaaaccccgggttcccggtaacgggttccccccg

SEQ ID NO: 83899 - DNA, 692 bp, Homo sapiens
  misc_feature: GYAE6OF01B4GM3.36.23.C01.1.454.CMB.1.raw
  modified_base (230)..(230): a, c, t, g, unknown or other
  misc_feature (230)..(230): n is a, c, g, or t
  modified_base (245)..(245): a, c, t, g, unknown or other
  misc_feature (245)..(245): n is a, c, g, or t
tcagtacgctgtctcacgaccggtgctcgattagtacacgtgattagggattggggggggtctcaggaggcaccgctctcaggacatctccaccatggcctgggctctgctgctcctcaccctcctcactcagggcacgagggtcctgggcccagtctggcctgacacagcctgcctcgtgtctgagctcctggacagtcgatccaccatcctcctgcacgtcggaaccngcagtgacgtttggntcttaataattatcgttctccgttaggttccaacagtctacttcgacggcaccggacccgtaccctaaaccgtttactttaagtttagtcggtacggtttccgtttccggtcccggtcccgttcgtacggggtttctacgttccgtctttccgtcccggcctacgtaacgtcgtcgaccgaacgccggtccctacccgtacgacctactaccttacgtacgtaccgtccgtacggcgtacggaacggacgtacggtcttaagtacttagtttctcgcgactactatataacgttacgtaggaacttacgtaagtcggttacctaccgtccgttcggttccgtacggggttccgggaccgggtaaccgggtaaccttacgggttacccgtacggttacccggttcggtaacccggacccgtacccgggtaccgtcccggttacccccg

SEQ ID NO: 83900 - DNA, 669 bp, Homo sapiens
  misc_feature: GYAE6OF01AN8LD.36.23.C01.1.454.CMB.1.raw
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagctcctggacagtcgatcaccatcctcctgcacgtggaaccagcagtgacgttggtgtcttataattatgtctcctggttaccaacacgtcattcgaggcacgccgacccgaaacttcttaatttagtgtacgttcgtttcgtcggtccctcgtacgggtttctacgtccgtcttcgtccggctaccgacgtctcggacctacgacggccctcctgacctatctctaacgtcctacgacggtcgtgggacggtacggacggcgttacgtaacttaatttagtacgtaccgacgtacttacaaattacgtaacgttaggaaacgttcaaggttacggttaacctaccgtacggttccgggtacgttacgggttaccggggggtacgggtacggggtaaacccgttaaagggttccggtaaaccccggtttccccggtaacggttcccgaaacccgggtaccccggtaaaggggttacccccg

SEQ ID NO: 83901 - DNA, 700 bp, Homo sapiens
  misc_feature: GYAE6OF01EBNK8.36.23.C01.1.454.CMB.1.raw
  modified_base (172)..(172): a, c, t, g, unknown or other
  misc_feature (172)..(172): n is a, c, g, or t
  modified_base (202)..(202): a, c, t, g, unknown or other
  misc_feature (202)..(202): n is a, c, g, or t
  modified_base (226)..(226): a, c, t, g, unknown or other
  misc_feature (226)..(226): n is a, c, g, or t
  modified_base (239)..(239): a, c, t, g, unknown or other
  misc_feature (239)..(239): n is a, c, g, or t
  modified_base (281)..(282): a, c, t, g, unknown or other
  misc_feature (281)..(282): n is a, c, g, or t
  modified_base (285)..(285): a, c, t, g, unknown or other
  misc_feature (285)..(285): n is a, c, g, or t
  modified_base (371)..(371): a, c, t, g, unknown or other
  misc_feature (371)..(371): n is a, c, g, or t
tcagtacgctgtctcacgaccggtgctcgatttagtacacgtgattagggattggggggggtctcaggaggcagctctctcaggacatctccaccatggcctgggctctgctgctcctcaccctcctcactcagggcacgtagggtcctgggcccagtcctggcctgacacngcctgccctccgtgtctgacgtccttccgnggaccagtcgactcaccatcctcngcacgtcgaaccngctagtcgcgttgtgtcttatattatgtctccgtgtacaacnnctnttcgcgcacgccgaccgtaatacttattgtgtacgttcgttcgtcgtccgtcggtggttcgtgtcgtctcgtccgtctactagtcncgaccacgccgtcctcccgtcgacctatcgtactacgtactacgacggtacgtaggaacggaccggtacggtcttacgttaaccgttatttaacgttcgaaccgtaccgttactaaccttaacttaaccggtacgttaacggtacgttaaactaacggttaccggttaacctaccgggtaccggtttcggtaccgggtttacggggtacccggggtaacgggggttaacccgggtaaacccgtttaaccggggttacccgttaaccccgggttaccggttaaccgggtaccggtaaccccgggtacccggtaacccgggtacccccggg

SEQ ID NO: 83902 - DNA, 668 bp, Homo sapiens
  misc_feature: GYAE6OF01BQPUI.36.23.C01.1.454.CMB.1.raw
  modified_base (216)..(216): a, c, t, g, unknown or other
  misc_feature (216)..(216): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgccctcgtgtctagagtactcctggacagtcatcacatctccngcatggaacagcagtgacgttgtgtcttaataattatgtctcgtgtaccaatgacattcgagcacgacccgacccgtaaattctttaattatgtacgttcttcgtcgcctgtacgggtttactagtcgtcttcgtccgactacgtaacgtctcggaccaacgtccggtccctacctacgaacctaactcctccgtcgggtccctaccgacgtaccgtacggaacggacggacgtacgttagtaactttacttacgttcgttcctactaactacttacgaacgtaccggtaacgttaaccgtttcggttccggttttaccgggcccgggacccgggtaacccgtacccgtaccggtacccgttacccggtaggtacccgtaaccggacccggtaaacggtcccgtacccgtaccccccgttaggtaccctacccgtttcccgttaacccccgg

SEQ ID NO: 83903 - DNA, 725 bp, Homo sapiens
  misc_feature: GYAE6OF01CLDUF.36.23.C01.1.454.CMB.1.raw
  modified_base (142)..(142): a, c, t, g, unknown or other
  misc_feature (142)..(142): n is a, c, g, or t
  modified_base (240)..(240): a, c, t, g, unknown or other
  misc_feature (240)..(240): n is a, c, g, or t
  modified_base (339)..(339): a, c, t, g, unknown or other
  misc_feature (339)..(339): n is a, c, g, or t
tcagtacgctgtctcacgaccggtgctcgatttagtacacgtgattagggattggggggggtctcaggaggcagcgctctcaggacgatctccacatggcctgggctctgctgctcctcaccctcctcactcagggcaacgngggtcctgggcccagtctcggcctagacacagcctgccttccgtgtctaggacgtacctccgtggacaggtccatccactatctctgcactcggaacngcagtcgtcggttggtagttattaatttcgtctaccgtcggtaacaacgtacgaccgaccggacaacgtccgaacccctaaaatcattggttaatttanggtacgtccacttacgtacgtcccggtaccgttcggtacgggtttacctacgtccgtacctttccgaccggttacctaccgttaacgtcgtacggacctaacgtccggccctaccgtacgacctcttacgtacgtacgtacctaccgaggcgtcgggaaacgcggaggtacttagttacttacgtttagttacacgtacgaccctttaagtaacttacgtaacgttagtaacgttaacgtaacgttcggtaacctccgttaaacgggtcgttacggttaccgggtacgggtacccggggtaaactaaacccgggttacggttcccgtaaccccggtttacggaacggttacccgggaaccgtaaccccgggttggtcccccccggg

SEQ ID NO: 83904 - DNA, 725 bp, Homo sapiens
  misc_feature: GYAE6OF01B9SMQ.36.23.C01.1.454.CMB.1.raw
  modified_base (263)..(263): a, c, t, g, unknown or other
  misc_feature (263)..(263): n is a, c, g, or t
tcagtacgctgtctcacgaccggtgctcgatttagtacacgtgattagggagttggggggggtctcaggaggcagcgctctcaggacatctccaccatggcctgggctctgctgctcctcaccctcctcactcagggcacgagggtcctgggcccaggtctggcctgacacagcctgcctccgtgtctgacgtacctccgtggacagtcgactccaccacttcctcctgcacgtacggaaccagctaggtcgtacggtttggngtactttaattaaatttatcgttccttccgttggttacccaacgtacgtcctagttcgagggtcacggacccgacccgtaaaacttctttaatttacgtggttacgtttccgtttccggtacccggtccgtttacggttacgggttttcgtacggtccgttccttccggtccgtcctacgtaacgttcgcgaccaaccggtaccgtcccttacccgtacgtaccctacttacgtaccgtacgtaacccgtcgacggtcgtagaacgggtcgacggtcttagacctttattacgtgactacgttactactagttaacgtaccgtaaggtaacgttacgtaaggttacttaaccgtccgtagttcgggtacgttcggggtccgggacgggtaaccggtaaccgtacgggtttccgacccggttacccgtagggtaccccgtaccgacccggtcgggttcccccg

SEQ ID NO: 83905 - DNA, 900 bp, Homo sapiens
  misc_feature: GYAE6OF01CSOOJ.36.23.C01.1.454.CMB.1.raw
  modified_base (171)..(171): a, c, t, g, unknown or other
  misc_feature (171)..(171): n is a, c, g, or t
tcagtacgctgtctcacgaccggtgctcgatttagtacacgtgattagggattggggggggtctcaggaggcagcgctctcaggacatctccaccatggcctgggctctgctgcctcctcaccctctcactcgagggcacgagggtcctgggcccagtctggcctgacacngcctgcctccgtgtctgagacctccgtggacagtcgactccaccattcctcctgcctacgtcggaaacccaggcaaggtgtacggttggtcgtacttaattaattagtcgttccttccgttacggtttacccaaacgtacgtacctacgtttacgacggccaacggaccccgtaacccccggtaaaactttccttttaaagttttacgtcggttacggtttccgttttccggtcccggtaccccgtttacggttaacggggtttttcctacggttcccggttccgtttcccgtacccggtaccttaccggtaaacgttccgttacgggaccctaaacccggtacccggtccccttacccgtacgtaaccctaacttcccgttacccgtaacggtacccgttacccggtacggtaccggttacgggaaaccgggtaccggacgggttacccgttacggttaacccgtttaagttttaaccggttcgaacccggttaaccgttcctttaaccgaagtttaaccgtaaccggttaggttaaaccgttagtaaaccggttcggttaacctacccgtaacgggttccgggtaccggttttacggggttaccccggggaaacggggttaaacccggggtaacccgttaacgggtttaccccggttaaaccccggttaccggttaaacggggttccccgtaaacccgggtaaccccgtaacccgggttccccccgg

SEQ ID NO: 83906 - DNA, 732 bp, Homo sapiens
  misc_feature: GYAE6OF01BQP1Y.36.23.C01.1.454.CMB.1.raw
  modified_base (169)..(169): a, c, t, g, unknown or other
  misc_feature (169)..(169): n is a, c, g, or t
  modified_base (194)..(194): a, c, t, g, unknown or other
  misc_feature (194)..(194): n is a, c, g, or t
  modified_base (292)..(292): a, c, t, g, unknown or other
  misc_feature (292)..(292): n is a, c, g, or t
  modified_base (333)..(333): a, c, t, g, unknown or other
  misc_feature (333)..(333): n is a, c, g, or t
tcagtacgctgtctcacgaccggtgctcgatttagtacacgtgattagggagttggggggggtctcaggaggcagcgctctcaggacatctccaccatggcctgggctctgctgctcctcaccctcctcactcaggcacagggtcctgggcccagtctggcctgacacngcctgcctccgtgtctgacgctcgngacagtcatcactatctctgcactacggaaccagcgagtcgtacggttggtactactttaataagttactcgtccttcgtacgtaccaagtcgacctntacgacggcgaccgccggtacccctaaattctttaaattgnggtaccgtttcgtttccgccggtccttggtagggtttcctagttccgtctttccgcggcttacccgagtcgtacgacctaacgtcccggtccctaccgttacgaacccttacgttaccctccgtacgtaccctccggacggtacgtacgggtaaacgggtaccgggtaagtacccgttagtaacctttaacgtttcgtaacggtacctacgtacgttaacaagtttaaccgtacgttaaccgtaaacgttcgttaaaggtcgttaacttccccgttaaggtccgggttacgttcggggtaacccgggtaggggtaaaccgggttcccgttaacggttacccggaacccggttacggttaaccggtaccgtaacccggtaaccccgaggggtaccccccg

SEQ ID NO: 83907 - DNA, 945 bp, Homo sapiens
  misc_feature: GYAE6OF01DJLNZ.36.23.C01.1.454.CMB.1.raw
tcagtacgctgtctcacgaccggtgctcgatttagtacacgtgattagggagttgggggggggtctcaggaggcagcgctctcaggacatctccaccagtcggccgtgggctctgctgctcctcacctctcactcgaggcacgtagggtccgtcgggccctagtccgtcggcctacgaaccacgacgtccgtcgtccgttccgtgtcttagacgtccgtccgtacggacgtacggtactactccaaccgtacgttcctaccgtcgaccgtaccggtacggaaaccgttcgacggttaacggttcggttaacgggttggttacgttaacgttttaacgtttaacgttacgttccgttaccgttaccggttaacgtaaccgaacgtacgtacgtacgtacggacggtaccgtaccggtaacccgttaaccgttaacgtttacgtttaacggtttacgttacgggtttaccggtttaccggttacccgggttaccggttaccggtttacgggttaccggtttccgttaccggttccgttccgttaccggtaccgtacgtaccgtacggtacgtaaccggtaccgtaacccggtccgtacccgtaccgtaccgtaccttacgtaccgtacgtaccgtaccgtacggtacggttacggtacgggacggtacggtaccgttacgttacgttaacgtttacgttacgtacgtacgtacgttaacttaacgttaacgttaacgtaacgttaaacggttaacgttaaccggttaacggttaccgttaacccggttacgggttaccggttaccgggttaccggttacccggggtaacgggtaacccgggttaaaccggttaaccgggtttaccggttaccccgggttaaccggttaccgggttaaacccggtaacccgggtaacccggtaacccgggttaccccgggtaccccgg

SEQ ID NO: 83908 - DNA, 939 bp, Homo sapiens
  misc_feature: GYAE6OF01C7K0S.36.23.C01.1.454.CMB.1.raw
  modified_base (258)..(258): a, c, t, g, unknown or other
  misc_feature (258)..(258): n is a, c, g, or t
tcagtacgctgtctcacgaccggtgctcgattagtacacgtgattagggattgggggggggtctcaggaggcagcgctctcaggacatctccaccatcggcctgggctctgctgctcctcaccctcctcactcgagggcacgacgggtcctcgggccctagtcgtcggcctgacacacgcctcgcctcgtgtcgtgacgtactccgtaggaccagtcgaactccaacctcttccgtcctcgaccacgtacggaaaccngcgtaggtcgtacggttggtcgttactttaattaacttattcgttccgttccgttacggtaaccctaaacgtacgtacctaacgttccggaaggccgtaacggtaccccggtaaacccccgttaaaacgtttaaccgttttaaacgtttttaacggttacggttaaccgggtttttccgttttacccggggttacccggtacccggtttccgggtttacggggtttttaccgttaccggttccgttcccgttttcccggtccccggttccgtttaacccggtacgttccggtacgggtacccaaaacccggtcccggttaccccgttacccgtacgtaaccctacgttacccgttaacctaaccggtacccgtacccggtacgggtccgttaacggggaacgggtaaccggtacggtaccgtttaacggtaacgtttactttacggtttaccgaacgttaccgtacgttaactaaacgtaacgttaccgttaagtaaaccgttcggttaaacggtttacggtaccgttaacccgtcgggttaaccgggttccgttacgggggttacccgggggacgggttaaacccggggtaacgtttaaaccgggttaacccggttacccggttaacccggttaacggttcccggaaacccggttacccgggacgggtttaaccccccgg

SEQ ID NO: 83909 - DNA, 707 bp, Homo sapiens
  misc_feature: GYAE6OF01B9XUB.36.23.C01.1.454.CMB.1.raw
  modified_base (174)..(174): a, c, t, g, unknown or other
  misc_feature (174)..(174): n is a, c, g, or t
  modified_base (205)..(205): a, c, t, g, unknown or other
  misc_feature (205)..(205): n is a, c, g, or t
  modified_base (241)..(241): a, c, t, g, unknown or other
  misc_feature (241)..(241): n is a, c, g, or t
tcagtacgctgtctcacgaccggtgctcgattagtacacgtgattagggagttggggggggtctcaggaggcagcgctctcaggacatctccaccatcggcctgggctctgctgcttcctcaccctctcactcgaggcacgcgggtcctcgggccagtcgtcggcctcgacacncgcctcgcctcgtgtctgacgctcgtcgacngtacgactcacactctacgtcgacacgtacgaaccngacgacggtcgtacggttgtactacgtttaatagttacgtcgtcttaccgttcgttaccgaactgtactacgtacgacggacgtaccgaccgtaccgttaaacgttactttaagtttacgttacggttacggtttccgtttccggttacccggtaccgttacgggtttacggttttcgtaaccggtttcgttcccgtttacccgggtaccgttaccgttaccgttaacggtcgttaccgggaaccgtaccgtaccggtccctaccgtacgaccgtacttcgtacgtaccgacgtacgaggttacgacgggtacgtcggactacgtactaagttcttaagcgtacacgtctacgacttacgttacgtaagtactacgtagttcgaacttccgtcgacggttgtacggtcggacggtacggtcgttaacgtcggtactacggtacgacgtcgtaccggcgttacccgg

SEQ ID NO: 83910 - DNA, 746 bp, Homo sapiens
  misc_feature: GYAE6OF01A249O.36.23.C01.1.454.CMB.1.raw
  modified_base (241)..(241): a, c, t, g, unknown or other
  misc_feature (241)..(241): n is a, c, g, or t
tcagtacgctgtctcacgaccggtgctcgatttagtacacgtgattagggagttgggggggggtctcaggaggcagcgctctcaggacatctccaccatggcctgggctctgctgctcctcaccctcctcactcagggcacgagggtcctgggcccagtcgtggcctgacacagcctgccctccgtgtctgacgtacctccgtggacaggtcactcaccatcctcctgcacgtcggaaccngcaggtgtaccggttggtgtacttaataatttactcgttaccgttcccgttcggttacccaaacgtcgtactacgttacgacggcgaccggtaccccgaaccccgttaaaactttactttaaacgtttagtcggttaccggtttcgtttaccggtcccggtacccgttacggttacggggttttcctacggttccgtccgtttccgtcccggtactacccgtaacggttccgtacggaccctaaaccgtcccggtccctcccgtacgtaccctacgttccctacgtaccgtaccgtccggaggtaccgtaggacggacggtacggtcgtaagaccgtttagttcgtacgactacgtctacgtagttactacgtagtaacgttactaacgtacggtacctacggtacgttcggtccgttcgggtaccgggagggtaaccgggtaaccgttacgggtaccggtacccgttacggtacgtacccgacccggtccgtacggtcccccgg

SEQ ID NO: 83911 - DNA, 872 bp, Homo sapiens
  misc_feature: GYAE6OF01DHBVN.36.23.C01.1.454.CMB.1.raw
  modified_base (715)..(715): a, c, t, g, unknown or other
  misc_feature (715)..(715): n is a, c, g, or t
tcagtacgctgtctcacgaccggtgctcgatttagtacacgtgattagggagttggggggggaaataactttctgagactcatggacctccctgcaacaagaacatagaaacacctgtgttcttcctcctcctggtggcagctcccagagtgggtccttcgtctcgaggtgcagctgacaggcagggtccgggccagggtaggtggtagacgtccttacgggacgaccctcgtcccctactccgtgcgtcgttggtgtcgtaggtaccgtccccgttcccggtaggggcggatagtacggtagttgggtggtacgggttcggtcccgtaccggacccggacccggagggggtaacgggcgtaggtagggttaggtaggtttaaggtaaaggtaaaacgttaaggacgggtaaccggggaacccggggacccaaaccgtaaacgtaacgtacgtacgtacccggttacccggtacgggtacgggggttacgaaccggtaccaacctaattacgttaccgaggaaccgtaaacggaaccgtaaacgtaacccggaaaccttaaccccttaacccgttacccgttaccggtacggaaccgggttcctaccgttaccgttccgtacgggtacccggacccgggcccggtaacggttacccgaccgttacgtactttaatttacgttacgtggtacggtacgttaagttttacgggtttnagggtaaggttcggtttcgggggttaccgggtacgggtttaactccggggacggttttaacggggacggggttaaccgaaggttaccggtcgttacccgggtatttaccgggttccttaccccctcccggtcttaaccccgggcccccgtaaccggg

SEQ ID NO: 83912 - DNA, 705 bp, Homo sapiens
  misc_feature: GYAE6OF01BGYGV.36.23.C01.1.454.CMB.1.raw
  modified_base (214)..(214): a, c, t, g, unknown or other
  misc_feature (214)..(214): n is a, c, g, or t
  modified_base (227)..(227): a, c, t, g, unknown or other
  misc_feature (227)..(227): n is a, c, g, or t
  modified_base (249)..(249): a, c, t, g, unknown or other
  misc_feature (249)..(249): n is a, c, g, or t
  modified_base (562)..(562): a, c, t, g, unknown or other
  misc_feature (562)..(562): n is a, c, g, or t
tcagtacgctgtctcacgaccggtgctcgattagtacacgtgattagggagttgggggggggtctcaggaggcaccgctctcaggacatctccaccatggcctgggctctgctgctcctcaccctctcacgtcgagggcacgtacgggtccgtcgggcccaggtcgtcggcctgacacacgtcctcgccttcgtgtctgacgtctccgtggacngtcgactccactntcctctgacacgtacggaaccngcgtaggtcggtacggttggtacttactttaaagttattcgttcgttaccttcgttacggtaccagtagtcttagtcgacgcgaccgacccgtaacccttaattacgtttattacgtcggtccgtttccttcggcccgtcgttagggttacggttctcgttcgtccttccggcctacttaccgagtcgtacggtaccaccgtcccgtccttaccgcgtaacctcgttactacccggtaataccccgttaggacccggttaggaaccgggacgggtaacggcggttactaaggttaccttagttccgacgcgtnttaacccgtatacttaacggatacggtaactaggtacttaccgtacgtagtcggttcgggcgttccggggacggacgggttagtaacgtaccgttcgggaaaccgttcggaccaccgtacggacccggtgtcccgtaccccgg

SEQ ID NO: 83913 - DNA, 833 bp, Homo sapiens
  misc_feature: GYAE6OF01CX7F6.36.23.C01.1.454.CMB.1.raw
tcagtacgctgtctcacgaccggtgctcgatttagtacacgtgattagggattgggggggggtctcaggaggcagcgctctcaggacatctccaccatggcctggctctgctgctcctcaccctctcactcagggcacgagggtcctgggcccagtctggcctgacacagcctgccttccgtgtctgacgtactccgtaggacagtcgatcaccattcctcctgcactacggaaccagtcgaggtcgtacggttggtagttactttaattaattcgttcgttccctttacccgttacggtttaacccaaacgtacgtccttaacgtttcgaacgggtacctaaccgggtaccccgtaaacccccgttaaaactttactttttaaacggttttacgtacgggtttaacggttttcccgttttccgggtcccggtaccccggtttacgggttacggggttttcctacggtttcccgttccgtttccgtcccgggtacctaccgtaaggttccgtaacggaccgtaaaccgtccccggtcccttacccgtacgtaacctacttccgtaccgtaccgtacctccggaggtccgtagggaacggtcggacgttcgtaaacgttacgttatttacgtcgacctaacgttctaacgttaacttaacgttaccgtaaggtaacgttacgtaacggtttcgtaaccgtaccgttaagggtcgggttccgttacgggggtccgggtaaccggggtaacggttaacccgttaacgggttacccggttaccggttaccggttaaaccggcccggaaccgggttacccggtccggttacccccggg

SEQ ID NO: 83914 - DNA, 792 bp, Homo sapiens
  misc_feature: GYAE6OF01EKN14.36.23.C01.1.454.CMB.1.raw
  modified_base (219)..(219): a, c, t, g, unknown or other
  misc_feature (219)..(219): n is a, c, g, or t
  modified_base (240)..(240): a, c, t, g, unknown or other
  misc_feature (240)..(240): n is a, c, g, or t
  modified_base (257)..(257): a, c, t, g, unknown or other
  misc_feature (257)..(257): n is a, c, g, or t
  modified_base (638)..(638): a, c, t, g, unknown or other
  misc_feature (638)..(638): n is a, c, g, or t
tcagtacgctgtctcacgaccggtgctcgatttagtacacgtgattagggagttggggggggtctcaggaggcagcgctctcaggacatcctccaccatggcctgggctctgctgctcctcaccctcctcactcagggcacgagggtcctgggcccagtctggcctgacacagcctgaccttccgtgttctgagacctccgtggactagtcgatcaacngtcctctgcacgtcggaaccngcaggtgacggtttggngtacttaagttaatttagtcgttccttcccgtaggttacccaaacgagtactacgttacgacgggaccaacggtcccggaaccccccggttaaaatttacttttaaaagttttaacgtcgggttaacggttttcccttttccgggtcccggtcccccttagggtttaacggggtttctaacggtttccgtccgtttcccggttcccggtcctttaccgaacgggttcctaacggtaacccgaaaccgtacccccggggtccctttaccccgtacggtaacccctatttccccgtaaccttaaggaccccctttaacccggaggtaccggttacgggaaccgggacggtacgggtactaacggttacttagttacttcgacncgtctactaagttacacgttaagtaacgtcgtaaattcgggtaactccggtaagttcggtacgttacggggtccgggacgggtaacgggttaaccgtaagggttcccgacccggttacggtaggacccgtaaccgcccggtaacggtcccccgg

SEQ ID NO: 83915 - DNA, 685 bp, Homo sapiens
  misc_feature: GYAE6OF01EHMKO.36.23.C01.1.454.CMB.1.raw
  modified_base (168)..(168): a, c, t, g, unknown or other
  misc_feature (168)..(168): n is a, c, g, or t
  modified_base (224)..(224): a, c, t, g, unknown or other
  misc_feature (224)..(224): n is a, c, g, or t
  modified_base (248)..(248): a, c, t, g, unknown or other
  misc_feature (248)..(248): n is a, c, g, or t
tcagtacgctgtctcacgaccggtgctcgatttagtacacgtgattagggattggggggggtctcaggaggcagtgctctcaggacatctccaccatggcctgggctctgctgctcctcaccctcctcactcagggcacgagggtcctgggcccagtctggcctgacncagcctgcctccgtgtctagacgtacctccgtggaactaggtcgaactccaacctntcctcgtgcctacgtacggaaccngctagtcggtacgttggtatcttaattaatttagtcgttccgttccgttacggttaacccaacgagtctacgttcgaaggtccacggtacccgaccgtaaacttacgtttaattgtcggttacgtttccgtttcggtcccggtccttaggtacggtttcgtacgtcgttactccgtacgctacgtacgtcgtacgaccaacgccgtcctaccgtacgacctctacttaccgacgtcctacggagtccggtagacggtaccgcggtactagaactttattcgtcgtacctgtacctagtaactacgttacgtagtaacgttatagtacggtaactcggtaacgttcgggttacggttaccgggaccgggtaaggtaccgttacggttaccgtacccggttagtaccgttacgaccgttcccggaggtccccgtacccg

SEQ ID NO: 83916 - DNA, 860 bp, Homo sapiens
  misc_feature: GYAE6OF01D8WDI.36.23.C01.1.454.CMB.1.raw
  modified_base (142)..(142): a, c, t, g, unknown or other
  misc_feature (142)..(142): n is a, c, g, or t
  modified_base (248)..(248): a, c, t, g, unknown or other
  misc_feature (248)..(248): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactgagggcacgngggtcctgggcccagtctggcctgacacacgcctgcccttccgtgtctgacgacctccgtggacaggtcgactccaaccattccgtcctagccacgtacggaaccngcgtaggttgtacggttggtcgtacgtttaactaagtttatcgttccttccgttcggttaccaacgtacggtactacgttacgacggtccgaccggtacccgtaaccccgttaaaactttcgttttaaattttacggtacggttacgggttttcccgtttaccgggttccccggtaccccggtttacgggttacgggggtttttaccgtacggtttcccgggtcctttacccggtcccgggtacttacccggtaagttccggttcgggaaacctaacccggtacccggtcccttacccgtcgtaacccttacttccgttaccgtacgtacccttaccggtacggtaccgttacgggacgggtaaccggtcgggtaccttaggtaaccttttagttacggtcgtacgtacgtacttacgtaatttaaccgttaacgtaaggttaaccgttaacgttaacggttacgttaccgtaccggttaacggttcgggtaccgggtttacggggttaaccgggacgggggttaacccggtaacggttaaccggggtttaccgtaaccccggttacggttacggtacccggaacccgggtccccggaaggttccccccggg

SEQ ID NO: 83917 - DNA, 722 bp, Homo sapiens
  misc_feature: GYAE6OF01CYZOV.36.23.C01.1.454.CMB.1.raw
  modified_base (165)..(165): a, c, t, g, unknown or other
  misc_feature (165)..(165): n is a, c, g, or t
tcagtacgctgtctcacgaccggtgctcgattagtacacgtgattagggattggggggggtctcaggaggcagcgctctcaggacatctccaccatggcctggctctgctgctcctcaccctcctcactcagggcacagggtcctgggcccagtctggcctgacncagcctgcctccgtgtctgacgactcctggacagtcgatcaccatcctcctgcactcggaaccagcagtgtacgttggtgtcttattaagttatgtcttcctcggtttaccaacacgcgtattacgtacgggcacggacccgtaccccgtaaaacttaccttttaaattttatacggtacggtttccgttttacggtcccgccccgtttcggtacggggtttctacggttccgtccgtttccgtccggtctacccgtaagttcgttacggaccgtaacgacccggtcccttaccccgtcgtacctaacgttctaccgtaacgtaccgttaccgaggtccgttacgggacgggtaaccgagggtcctaggtacctaagtttactcgtcaacgtcttacgtaacttaacgttactacgtaacgtataacgttacggtaccttaccgtagttcggtcgttacgggttaccggggtacgggaacgggtaacccgtaaacgggtttccgtacccggttaccgttacgggtacccgtaaaccggcccgtaacggttaccccgg

SEQ ID NO: 83918 - DNA, 664 bp, Homo sapiens
  misc_feature: GYAE6OF01BSLRD.36.23.C01.1.454.CMB.1.raw
  modified_base (232)..(232): a, c, t, g, unknown or other
  misc_feature (232)..(232): n is a, c, g, or t
  modified_base (283)..(283): a, c, t, g, unknown or other
  misc_feature (283)..(283): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatccaccatcctcctgctactaggaaccngcagtgacgttggtgcttaataattatcgttcttccgtggttaccaagacnctattcgaggccgacgccgaccccgtaaacttctttaaattagtggtagttccgttttcgtccggtcccttggtacgggtttctacgttcgtccgtttcgtcccggtctacccgtaagtcgtggaccaaccgccggtccctccctacgaccctactccttacctaagtaccctcgacggtccgtaggaacggacggaggtcctaggtaacttacgtttatcgacagtcctataattacgttagtagtaacgttcgaattccgggtattaccccgttagtggttaccttcggggttaccgggaccgggtaagggtaccccgtaagggttacccgtacccggttaccgtagggtccccaacgggtccccgtagggtacccccg

SEQ ID NO: 83919 - DNA, 994 bp, Homo sapiens
  misc_feature: GYAE6OF01D404L.36.23.C01.1.454.CMB.1.raw
tcagtacgctgtctcacgaccggtgctcgatttagtacacgtgattagggagttgggggggggtctcaggaggcagcgctctcaggacatcctccaccatcggcctgggctctgctgctcctccaccctcctcactcgagggcacgacgggtcctgggcccagtcctcggcctgacacacgtcctcggcccttccggtgtcgtagacgtaccttccgtaggaacctaggtccgactacccaacctacttcctccgtgacctaaccggtacggaaaccctaggtacctaaggggttcggttaacggttttgggttacgttaccttttaaattaaacgtttacgttcgtaccgtttcccgtaacggttaaccaaacgtacggtacctacgtttacggacgggaccgtaacccgggtacccccgtaaacccccggttaaaaacttttaccgtttttaaaaggttttaaccggttacgggtttaacccgggttttccccgttttaaccccggggttacccccggtttccccggtttaaccggggtttaccggggttttttaaccgttaccggttccccgggtttacccgttttccccggtaccccggggttacccctttaaacccgggttaacccggtttccggtaacccggggtaaacccgtaaaccccgggttaccccggtacccccgtttacccgtacccgtaaacccttccgtttaacccgttacccggttaaccggtaaccccgttacccgggtaacgggtaccgggttaacggggacgggtaaaccggttaacggtccgtttaaacgttaacgttttacgttacggtaaccgtacgtaccggtacttaacgttaacgttaacgtaacgttaaggtaaacttacggtaagtttccggtaacttcccggtaacggttgtacggttcgggtaccggagggtaccgtacggttacgtccggtacccgtacggtacacgtaccgtccggccgtcccg

SEQ ID NO: 83920 - DNA, 866 bp, Homo sapiens
  misc_feature: GYAE6OF01A3MTG.36.23.C01.1.454.CMB.1.raw
tcagtacgctgtctcacgaccggtgctcgatttagtacacgtgattagggattgggggggaaatactttctgagactcatggacctcctgcaacaagaacatgaaacacctgtgttcttcctcctcctggtggcagctcccagatgggtcctgtctcaggtgcagctgcagcgagtccgggccaggagtggtagaacgccgttcggacgtacccgtcgtcccctacaccgtgccgtcgttggttcgtcgtcgggaccgtccccgtcccgtacggggacggtagtacgtaggtaagtgggtagggtacggttccgggtcccgaccgacccggaccccggagggggtacggtcgtaggtaggttaggtagttagggtaagtaaagtaaggtacggaacgggacccggggactaaccgtaaacgtacgtaacgtcggtaccccgtaccggtacgggtaccggggttaccggtaccgttaaccaaaccgttacgtacgttacgtcgaaccgtaacgtaaaccgaaacgtaaacccgaaacgtaacccttaaccctttcccgtacccgtacggtaccggtaccgttaccggtacccgtttacgtacggtaccggaaccccggtaccggaccccgtaccgtaccgtaccgttaacgtttaactttacgtttaggttacggtacggtaacgttttaacgggttcgttttacgggacggttagggttacgtttacgggtagggtaccggtacggttaccggtaccggggtttacgggtaccggggttacggtaacgggtaccggttaccgggtacccgttacgtccggttccgttaccccgccgttaaccgtaccccgtcccggtaaaccccgg

SEQ ID NO: 83921 - DNA, 794 bp, Homo sapiens
  misc_feature: GYAE6OF01EEAYH.36.23.C01.1.454.CMB.1.raw
  modified_base (241)..(241): a, c, t, g, unknown or other
  misc_feature (241)..(241): n is a, c, g, or t
  modified_base (266)..(266): a, c, t, g, unknown or other
  misc_feature (266)..(266): n is a, c, g, or t
  modified_base (633)..(633): a, c, t, g, unknown or other
  misc_feature (633)..(633): n is a, c, g, or t
  modified_base (780)..(780): a, c, t, g, unknown or other
  misc_feature (780)..(780): n is a, c, g, or t
tcagtacgctgtctcacgaccggtgctcgatttagtacacgtgattagggagttgggggggggtcgtcgaggaggcgagcgctctcaggacatcctccaccatggccgtgggctctgctgcctcctccaccctcctcactcagggcacgagggtcctgggcccagtcgtggccctgacactagccgttgcctccgtgtctgacgccttccgaggacaggtccgataccacctacttccctntccgactacggtaaccggaacacgngtacggtcggttaacggttggttctacttaattaactttagtcgttccgttccgttacgttacctaacgcgactagttacgacggtcgccgtaacccgtaacccgtaaacttacgttttaatttacgttacggttacgttcccggtttcggttccccggtccgtaccgggtttaggggtttaccttacggtccgttccgttacccgttcccggaccgttacgtaacgtcgtaacgggtacccgtaaacccggtccgttaccccgtaccttaaccggccttaacgttccccgttaacttaccgtacgtccgtacggtacgttaccgggacgggtaaccgtacggttatttaaaccgtttctttaccgnggttaaccttaggtacttaactaaccgtaaaccaccgtaactaactaccggtactacgtacgtaacgttcggtacggacgggtaaccggacgcgtacggaccgtaaccgttcgaacgtaccggaccgacccggtaccgtaccccgtntcccccgggtaccg

SEQ ID NO: 83922 - DNA, 684 bp, Homo sapiens
  misc_feature: GYAE6OF01ETAR4.36.23.C01.1.454.CMB.1.raw
  modified_base (544)..(544): a, c, t, g, unknown or other
  misc_feature (544)..(544): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcacgtggaaccagcagtgacgtttggtgtacttataattattcgtctccgtggttacccaactagctatttccgagggcaacggccggtacccccgaaactttacctttaaattttataggtaggtttctttccggtccggtccccttcggtacgggttttcctacgtccgttccgtttccgtcccggcttaccgaaacgttcctacggtacccaaacgtacccgggtcccctccccgttaggtaccctacgttcccttacgtaacgtacctaccggtacggcgttacgggacggaccggagccgttagtaaccttattacgtgacngtctacaatatacgtagaagtactaagttacgtactccgtacgttcggtcgttcgggtttacgggaccgggtaacggtaccttaaaggttcggtacccggttacgttaacgggtaccgaacgccccggtaaggtcccccg

SEQ ID NO: 83923 - DNA, 959 bp, Homo sapiens
  misc_feature: GYAE6OF01DW700.36.23.C01.1.454.CMB.1.raw
tcagtacgctgtctcacgaccggtgctcgatttagtacacgtgattagggattggggggggaaatactttctgagactcatggacctcctgcacaagaacatgaaacacctgtggttcttcctcctcctggtggcagctcccagagtgggtcctgtctcgaggtgcagctgcagcaggtccgggcccagggagtgggtagaacgtccgttacggacgtaccctcgtcccctcaccgtgcgtctgtgtcgtggacgccctccgtcgggcggagacgtaggaaggttgggtgggtacggttcgggtcccgccgaccggaccccggaaggggtacggggcgtaggtaggttgggtagtttagggtaagtaaaagtaaaggtacgggaaccggggacccgggggaacctaaaccgtaaacgtaaccgtaacgttccggtacccggttaccccgtacgggtaacgggggttaccgtaaccggtacccgtaaaccgtaagttacgttaccgtacggaaccgtaaacggaaccgtaaaaccgggttaaacccctaaaaccggtaaaccccttaacccgtttaccccgtaccccggttaacgggtaaccgggttaccccttaccgggtaccccgtttacccggttaccgggttaccccgggaccccggggtaccccggtacccggggtaacccgttacccggtaaccgtttaaacgtttacgttttacggtttaacggtttccgggtacggttaacgggtttaacgggttttacggtttttacggacgggttaacggtttcggtttcggggttacgggggtacccggtttacggttccgggttaccgggttacggggttaaccggggtaaccggtaaaggggttacccgttaccgggtacgggttaccctacgggtttaccccgttaccttacccgtacccggtaccggtcccccgtaaaccccggg

SEQ ID NO: 83924 - DNA, 734 bp, Homo sapiens
  misc_feature: GYAE6OF01AVTA7.36.23.C01.1.454.CMB.1.raw
  modified_base (712)..(712): a, c, t, g, unknown or other
  misc_feature (712)..(712): n is a, c, g, or t
tcagtacgctgtctcacgaccggtgctcgattagtacacgtgattagggagttggggggggtctcaggaggcagcgctctcaggacatcctccaccatggcctgggctctgctgctcctcaccctcctcactcagggcacgagggtcctgggcccagtctggcctgacacagcctgcctcgtgtctagagacctcgtggacaggtcgactccacctatcctcctgactaacgtcggaaccagcgtaggtacgtacgttggtagtactttaaattaaattcgtcggttcctacccgttaggttacccaaacgtagtacctaagttccggaacggtaccgaacggtaccccggaaacccccgttaaaaatttccttttaaaagtttacggtacggtacggtttccgtttaccgggtacccggtccccgttagggttacggggtttccttaacggtcctccggtttacccgccgtaccttaccgtaaaggttcgtacggtacctaaacccgccggttccccttaaccgcggtaacctattccgtactacgtaccctacgacggtacgtaggaacggtacggtagtaccgtagtaaactttatagttcgatcgtactaacgtaattaacagttaacgacgttacgaacgttacgtaacctctacggtggtaccgttaggtccggacgggtaacgaacgtacggtaccaccggttanaccggtagacgacgtacggccg

SEQ ID NO: 83925 - DNA, 548 bp, Homo sapiens
  misc_feature: GYAE6OF01B7VJK.36.23.C01.1.454.CMB.1.raw
  modified_base (228)..(228): a, c, t, g, unknown or other
  misc_feature (228)..(228): n is a, c, g, or t
  modified_base (241)..(241): a, c, t, g, unknown or other
  misc_feature (241)..(241): n is a, c, g, or t
  modified_base (371)..(371): a, c, t, g, unknown or other
  misc_feature (371)..(371): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagacctcctggacagtcgatcaccatctctgcactggaaccngcagtgacgttgngcttataattatgtctcctgttccaacagcattcaggcagccgaccccgtaaactctttaatttatgtagttctttcgtcggtccctcgtagggtttctagtcgcttctccggctccaagtctgacaacncggcctcctgaccatctctagactcaggtctgaggacgagctgtactattagtcgcagtctcatatacgtgaacgttcaattgtactccgtagtcggtcttggttcgggacgggtaacgggtacctaagggttcgacccggttaccgtacgggtaccaacggccctaagggtccccg

SEQ ID NO: 83926 - DNA, 669 bp, Homo sapiens
  misc_feature: GYAE6OF01DL8L0.36.23.C01.1.454.CMB.1.raw
  modified_base (242)..(242): a, c, t, g, unknown or other
  misc_feature (242)..(242): n is a, c, g, or t
  modified_base (257)..(257): a, c, t, g, unknown or other
  misc_feature (257)..(257): n is a, c, g, or t
  modified_base (270)..(270): a, c, t, g, unknown or other
  misc_feature (270)..(270): n is a, c, g, or t
  modified_base (288)..(288): a, c, t, g, unknown or other
  misc_feature (288)..(288): n is a, c, g, or t
tcagtacgctgtctcacgaccggtgctcgatttagtacacgtgattagggagttggggggggtctcaggaggcagcgctctcaggacatctccaccatggcctgggctctgctgctcctcaccctcctcactcagggcacgacgggtcctgggcccagtcctggccctgaacacgagccctgccctcgtgtctgacgactcgtggacagtcgatcacctagtctcctgacactggaaacccngcagtgacgttggtntacttataagttntcgtctcgtcgtaccaangcaattcgaggtcacggaccgaccctaaatttctttaaatttacgtggtacgttcttccggtcgtaccctggtacgggtttctagtccgtcttcgtcccggtctacaagtcctggactaacggcccgtacccttcccgacgtaccctacttccgtacctacgacctccgaggtctaacgggtacgaaccggtagtaccgtgtaacgtttacgttaacttcggacgtagacttacgtaattacgttaactacgggtaaattccgtaaagttacggacttccgtaacgtcggttacggttcggttacggggaccggtaacgggtacctaacggtccgttaaccgttccgaacggtcgtaaaccggccggtaaacggtccccgg

SEQ ID NO: 83927 - DNA, 604 bp, Homo sapiens
  misc_feature: GYAE6OF01AWXG9.36.23.C01.1.454.CMB.1.raw
  modified_base (213)..(213): a, c, t, g, unknown or other
  misc_feature (213)..(213): n is a, c, g, or t
  modified_base (348)..(348): a, c, t, g, unknown or other
  misc_feature (348)..(348): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcncctgcactggaaccagcagtgacgttggtgcttataattatgtctcctggttccaacagcattcaggcagcgccccgtaaatcttaatttatgtaggttctttcgtcggtccctcgtagggtttcagtcgcttcnccggctacagtctggcaacgaccggccctccgtcgacctatcctactacgacctccgaggtcgtggacggacggacgggtctgtaacctagtttacgttgactacggccttacgaagttactaacgttagaaacgttacaaacgttcggttaaccttccgaaccgttggtaccgttacggttccgggacgggtaacgggtaaccctaaggttaccgacccgttacgttacggaccgtaccggtcccgaaggtcccg

SEQ ID NO: 83928 - DNA, 841 bp, Homo sapiens
  misc_feature: GYAE6OF01DUKUQ.36.23.C01.1.454.CMB.1.raw
  modified_base (563)..(563): a, c, t, g, unknown or other
  misc_feature (563)..(563): n is a, c, g, or t
tcagtacgctgtctcacgaccggtgctcgatttagtacacgtgattaggggattggggggggggtctcaggaggcagcgctctcaggacatctccaccatggcctgggctctgctgctcctcaccctcctcactcgagggcacgacgggtccgtcgggcccagtcgtcggcctgacacacgcctgcccgtcgtgtctggacgtacctccgtggacaggtcgatccaacctatcctcctgacctaaccgtacgggaaaccaacgaggtcggtaccggtttgggtattacttaattaatttacttcggttccttaccgttacggttaccaaacgtacgtactacgttaccggacggaccgaccggaaccccgtaccccggtaaaactttacgtttaaattttaacggtggttaccggtttccgttttaccggacccggttacccgttacgggttacggggttttactaacgttccgttctttcgtcgtacgtacctaacgttaccgtaacgttccgtacggtaacctaaacccggtcccgtacccgtacccgtacctaacccgtnttcccggtccggttccgggacctacccgggtaggtaccgtaaggggaaccggtaacgggttaaccggtttaactttaacgttttaacgtttccgtacggtaaccgtttacgttaacctaaagtttaaccaaaacccgtccgtaaacgtaacccaacttacgtacttacggtacgttaccgggttaccgggaaggtaaaccgggaccaacggtcgtacccggtaaccgtaacgtaaccggtacacccggtaacccgtacggtcccgtccccggtacccg

SEQ ID NO: 83929 - DNA, 805 bp, Homo sapiens
  misc_feature: GYAE6OF01DG43O.36.23.C01.1.454.CMB.1.raw
  modified_base (274)..(274): a, c, t, g, unknown or other
  misc_feature (274)..(274): n is a, c, g, or t
  modified_base (354)..(354): a, c, t, g, unknown or other
  misc_feature (354)..(354): n is a, c, g, or t
  modified_base (490)..(490): a, c, t, g, unknown or other
  misc_feature (490)..(490): n is a, c, g, or t
tcagtacgctgtctcacgaccggtgctcgatttagtacacgtgattagggagttgggggggggtctcaggaggcagcgctctcaggacatctccaccatggcctgggctctgctgcctcctccaccctcctcactcgacgggcacgtacgggtccgtcgggccctaggtcgtcggcctacgacacacgtccgtcgtccgtccgtgtcgtagacgtcgtcgaggactggtactactaccacctacctccctcgacgacgtaaccggaccgaacgngtacgtacggtaggttggttctatttaattaaacttgtccgttactccgttaccggtactaacgtacgtacttacgtacncggaccggtaaccgtacccggaccctttaaactttactttagttaacggttcgtcgtttccgttcccggtccggtcccgttggttaacgggttccgttccgtacggtccgttacccgtccgaccgttaacgttacncggtacggtacccaagtaccccgtcctaccgttcgaacctttcgtactactaccgtacgaccgtcgggttaggacggtaacgggacggtacggtacgtacggtttacctaacggttttacacggtacgtactcgtttaacgtattaacgttaacgtacggttaacgttagtaacgtttaccggtactcccgttaagggtccgtttaccgggtcgggtaccggggtaaccggtaagggtacggttacccggttaacgggttaccggtaacccggtacgtacgggaaccgtacccggtacccgtccgtaacccccgg

SEQ ID NO: 83930 - DNA, 878 bp, Homo sapiens
  misc_feature: GYAE6OF01B8P4U.36.23.C01.1.454.CMB.1.raw
tcagtacgctgtctcacgaccggtgctcgatttagtacacgtgattagggagttgggggggggtctcagggaggcagcgctctcaggacatctccaccatggcctgggctctgctcgctccctccaccctcctcacgtcgacgggcacgtacggggtccgtcggggcccaggttccgtcgggcctagaccacgacggcccttcggtcccttccggtgttccgtagaaccgtaccttccgtaggaactacgggtcactaccaacctacttcctcgttcgaccgtaccggtacggaaccgagaccgtaagggttcggtacgggtttcgttacgttaacttttaagttaatttcgttccgttaccgtttcgtaccgtaaccaatacgtaccttaagttcgaacggtaccgaacccggtacccgtaaacccgttaaactttcttttaaacgtttcggtacggtttccggtttttcccggttcccggttaccccgggtccggtttacgggttttacggtttaccttcgggttaccctttcgttaccggtcccggtaccgttaccggtaaccgttccggttacgaaaccgttaccccggtacccgttccctaacccgttactaaccctacgttacccgtaaccgtaaccgtaccggtaacggtacgggtacgaacggggtaacgggacccgtcgggttaccttacggttaacttaagtttcggtacgacttacgtacttaacgtaacttacgtaacgacggttaccacaaccgttcgtaccgttaccggttccggttaccggtaccggtaaccgtccggttaacgaccggttatcccgttagttcggtaaccggtccaaaccccggactaccggtaacccctac

SEQ ID NO: 83931 - DNA, 829 bp, Homo sapiens
  misc_feature: GYAE6OF01DZJKP.36.23.C01.1.454.CMB.1.raw
  modified_base (178)..(178): a, c, t, g, unknown or other
  misc_feature (178)..(178): n is a, c, g, or t
  modified_base (205)..(205): a, c, t, g, unknown or other
  misc_feature (205)..(205): n is a, c, g, or t
  modified_base (222)..(222): a, c, t, g, unknown or other
  misc_feature (222)..(222): n is a, c, g, or t
  modified_base (730)..(730): a, c, t, g, unknown or other
  misc_feature (730)..(730): n is a, c, g, or t
tcagtacgctgtctcacgaccggtgctcgatttagtacacgtgattagggagttgggggggggtctcaggaggcagcgctctcaggacatctccaccatcggccgtgggctctgctgcctcctcaccctcctcactcgacgggcacgagggtcctgggccccagtctggcctgacacngcctgcctccgtgtctgacgtcttccnggacagtcgatccaccntcctcctgcctactcggaaccagctaggtgtacggttgtcgtctttaataatttagtcgttacctttccgttacgggttacccaaacgacgtacctacgtttccggaaggcccgtaacgggaccccggttaaccccccgttaaaaattttaccgtttttaaaagtttttcggtaccgggtttaacgggtttttccctttttccggggccccggttaccccgtttcggggttaacggggtttttccttaacggttcccggtttcctttccggtaccccggtcctttaaccggtaaacggttcccgtacgggtaaccccgtaaaccggtcccccggttaaccccttccccgtaacgtacccttaacgttccccgttacgtaaaccggtaccctacccggacggtacgtaacgggaacgggtacccgaacgggttcgttacggtaactttacggtttactcggactacgttacaccgtaattacgtacgtagaacctacgtagtaccggtntacctaggtccggtcgttcggggttcggaccgggttaacggtaacccgtaggttcccggtaccgttacgtacgggtacaccggacccgtagggtccccc

SEQ ID NO: 83932 - DNA, 907 bp, Homo sapiens
  misc_feature: GYAE6OF01C8LKX.36.23.C01.1.454.CMB.1.raw
  modified_base (257)..(257): a, c, t, g, unknown or other
  misc_feature (257)..(257): n is a, c, g, or t
tcagtacgctgtctcacgaccggtgctcgattagtacacgtgattagggattgggggggggtctcaggaggcagcgctctcaggacatcctccaccatggcctgggctctgctgcctcctccaccctcctcactcgagggcacagggtcctcgggcccagtctggcctgacacgacgcctcgcctccgtgtctagacgtcctccgtaggactaggtccgactccacctacttcctcgtagacctacgtacggaaacncggacgttaggtacggttacggtttcggtacgttaccttaaattaactttacgtcgttcccgtttccgttacgggttaaccaacgtacgtacctaacgtttcggaacggtaccgacccgggtaccccgtaaaccccgttaacgttttaacttttaaacgtttaggttacgtttaccgggttttccggtttccgggtacccggttaccggttacggttacggggtttctacggttccgttccgttccggtcccggtaccgttacgtacggttcgtaccgggtaccaaccggtaccccggtccctacccgtacgtaacctaccttccgttaccgtaccgaccgttaccggtacggtacggtacgggacgggtaaccggtacggtaccgttacgttaacgtttaacgttaccgttcgtacctaaccggtacgttaaacttaaccgttaagttaaccggtaaggttaaaccgttaacggttaacggtttacgttaacccgttacgtaccgggttaccggttccgggtttaacggggaccggggttaccggggtaaacccgggttacgttaaccggggttacccggttaaccccggttacggttacccgggtaacccgtcccggtaaaacccggggtcccggttaaccccccggg

SEQ ID NO: 83933 - DNA, 825 bp, Homo sapiens
  misc_feature: GYAE6OF01CP7HG.36.23.C01.1.454.CMB.1.raw
  modified_base (723)..(723): a, c, t, g, unknown or other
  misc_feature (723)..(723): n is a, c, g, or t
  modified_base (808)..(808): a, c, t, g, unknown or other
  misc_feature (808)..(808): n is a, c, g, or t
tcagtacgctgtctcacgaccggtgctcgattagtacacgtgattagggagttggggggggtctcaggaggcaccgctctcaggacatctccaccatggcctgggctctgctgctcctcacctcctcactcagggcacagggtcctgggcccagtctcggcctgacacagcctcgcctccgtgtacgtggacgtaccgtccctaggggaacctaggttaccgaacttccaaccctacttccttacccgtcgacctaccgtacgggaaccctaggtaccgtaagtcggtaccggttgggtacttacgtttaattaatttagttcgtaccgttccgttaccgggtttacccaaacgtacgtaccttaaggttccgaggaccgaccgtaacccggaccccgtaaacttacttttaaatttcgtacggtacgttcccgttttcggtacccggtcccttacgggttaacggggtttccttacggtccgtaccgtttccggtccccggtaccttaacccgtaaggtttcccgacggtaacccaacccggtacccgggtccccctttccggaccgtaccctgtttaccctccgtaacgtaccccggtacccgaggggacccttaggggaaccgggaaacggtgggtactagtaaacgtttacttaggtccacgtaccgtactaactaacgttacgtatttaaccggaacgttactagttacgtcctaacncgttacggcgttcgggtacggagggtaacccgaaacggttacgttacccggtacgtttaccgcggaacccggtaccaaccccggnggtccccgttacccggg

SEQ ID NO: 83934 - DNA, 695 bp, Homo sapiens
  misc_feature: GYAE6OF01CRSKV.36.23.C01.1.454.CMB.1.raw
  modified_base (313)..(313): a, c, t, g, unknown or other
  misc_feature (313)..(313): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacgagggtcctgggcccagtctggcctgacacagcctgcctccgtgtctgagactcctggacagtcgatcaccatctcctgcactggaaccagcagtgacgttgtgacttaataattatgtctcctggttccaacagcattcgaggcacgccgaccccgtaaactctttaatttanggtaggttcttcgtccggtccctcgtagggtttcctagtccgtctttccgtcccggctaccctaaggttcgtacggaccaaaccgtacccggtccccttcccgtacgtaccctacttcccttactaaccgtaccttcccgaagggcttagggaaacgggtacggtacggacccggttaagtaacctttaagtttatttcggaactacgttcttaacctaattaacttaacgtaggtaactttacgaaacgttgttaacgtcccgtagtcggtcgttcgggtttacggggccgggtaaacggggtaaccgtaacgggtttcccggtaacccggttacccgtttaagggtacccgtaaccggccccggttaagggtacccccgg

SEQ ID NO: 83935 - DNA, 743 bp, Homo sapiens
  misc_feature: GYAE6OF01BUA3I.36.23.C01.1.454.CMB.1.raw
  modified_base (226)..(226): a, c, t, g, unknown or other
  misc_feature (226)..(226): n is a, c, g, or t
  modified_base (251)..(251): a, c, t, g, unknown or other
  misc_feature (251)..(251): n is a, c, g, or t
  modified_base (631)..(631): a, c, t, g, unknown or other
  misc_feature (631)..(631): n is a, c, g, or t
  modified_base (703)..(703): a, c, t, g, unknown or other
  misc_feature (703)..(703): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcgagggcacgcgggtcctcgggcccagtctggcctgacacacgcctgcccttccgtgtctggacgtacctccgtaggacacggtcgactcaaccnttcctcctgcctacgtacggaaccngacgaggttgtacggttggtctaactttaataaatttcgtcgttccgtttccgtacggttaccaaagcgtctaagtccgaaggccgaccgtacccggtaaccccttaaatttcttttaaaagtttgacggttacggttttcccgttttaccggcccggttacccgttgggttaacgggtttctacggtccttaccgttccgtccgtacctacgtaacggttcaccggtacacccgacgttcccctactaccgacttactacccgttaacgtacgtacccgtacggagtaccggtacggaacgggcggtaacgtaccgtaagttaccttaagttacgtacgtacgtaagtctaactagttaactaacggtagtaaaccgtntaacgtacgttaccgtccgtaggacgttcggtccgggttaacggacgggtacggtacccgtacggttaaccnccggtttaccgacgaccgtaccgccggtaaccggtccccg

SEQ ID NO: 83936 - DNA, 882 bp, Homo sapiens
  misc_feature: GYAE6OF01EXQPJ.36.23.C01.1.454.CMB.1.raw
tcagtacgctgtctcacgaccggtgctcgatttagtacacgtgattagggattgggggggggtctcaggaggcagcgctctcaggacatctccaccatggcctgggctctgctgctcctcaccctcctcactcgacgggcacgacgggtcctcgggcccagtctggcctgacacacgcctgccctcgtgtctgacgacctccgtaggacaggtccgactaccaacctacttccttcctcgccacgtacggaaccagcgtaggtcgtacggttggtagtactttaataattatcgttccttccgttacggttaccaactcggtactaacgtttcggacggccaccggtaccccggaaccccgttaaatttactttaaagtttacgtagggttaccggtttccgtttaccggtcccggttaccccgttacgggttacgggttttcctacggttccgttaccctttcccggtacccggtccttaaccggtaacggttccggtaacggaaccccgtaacccggtaccccggtcccttaccccgtacgtaaccctttccgtaccctttaccgtaacgtaccccgttaccgggtacgggtaccgttaacggggaacgggttaaccggacgggttacccgttaagttaacccgttttaagtttacggttccaacggtctaccgttaactaacgttaacgttaaccggttaaggtaaaccgtttagtaaacggttaccggttaaccgtaccgtaaccggtttccgggtaccggtttacggggggtacccggggtaacggggtaaccggttaacccgtacggggtttaccccgacccggggtttaccgtaacgggcccgttaaccggtaacccccggtagggtccccccgg

SEQ ID NO: 83937 - DNA, 664 bp, Homo sapiens
  misc_feature: GYAE6OF01COVYQ.36.23.C01.1.454.CMB.1.raw
  modified_base (170)..(170): a, c, t, g, unknown or other
  misc_feature (170)..(170): n is a, c, g, or t
  modified_base (207)..(207): a, c, t, g, unknown or other
  misc_feature (207)..(207): n is a, c, g, or t
  modified_base (268)..(268): a, c, t, g, unknown or other
  misc_feature (268)..(268): n is a, c, g, or t
  modified_base (415)..(415): a, c, t, g, unknown or other
  misc_feature (415)..(415): n is a, c, g, or t
  modified_base (651)..(651): a, c, t, g, unknown or other
  misc_feature (651)..(651): n is a, c, g, or t
tcagtacgctgtctcacgaccggtgctcgattagtacacgtgattagggagttgggggggggtctcaggaggcaccgctctcaggacatctccaccatggcctgggctctgctgctcctcaccctcctcactcagggcacaggggtcctgggcccagtctcggcctgacncagcctcgcctccgtgtctgacgacctccgtggaccnggtccatccaacctagtcctcgtcgctacgtacgaacctagacgtagtcggtacgttggtntacgttaattaattacgtgtccttcgttcgtaacaacgagtctagtcgaaggccacggcccgtacccgtaaacttcttaaatttggcgttacggtttcctttccgggccgttcccgtggttacgggtttactcggttcctccgttcnccggtctacgtagtccgtacgacccaacgtccgtcccttccgcgaccctgttccgtacctacggaccttcggaacgtcgtaggacggtacggacggtgttaacgtccttaagttacgttcgtacgaacctcgtattaatacgtaacgtacggtaagtacgtaactggtactaccgtgtcgtcgtgggtccggacggaggtaccgtagtcggtaccctgtaccgacgacccggccgngtcccggttccgg

SEQ ID NO: 83938 - DNA, 936 bp, Homo sapiens
  misc_feature: GYAE6OF01CON48.36.23.C01.1.454.CMB.1.raw
  modified_base (250)..(250): a, c, t, g, unknown or other
  misc_feature (250)..(250): n is a, c, g, or t
tcagtacgctgtctcacgaccggtgctcgatttagtacacgtgattagggattgggggggggtctcaggaggcagcgctctcaggacatctccaccatgcctgggctctgctgctcctcaccctcctcactcagggcacgagggtcctgggcccagtcgtggccctgaccacacgcctcgcctccgtgtctgacgtacctcgtacggacacgtcgactccacctactcctcctgaccacgtacggaaccngacgtaaggtcggtacggttggtacgtactttaaagttaactttagttcgttccctttacccgttcggttaacccaacgtacgtacttacgttacgacgggtcccaaccggccccggttaaccccgtaaatttaccttttaaaggtttacgtcggtttaaccggttttccgtttaccccgggtacccggttaccccggtttacgggttacgggggtttttacctaccgggtttccgttacccgttttcccggtaccccggtacttaaccccggttacggttaccggtacggggtaaacccgtaaacccgggtcccccggttacccccgttacccgtaccgggttaacccccttaggttaccccgttaacggttaaccccgtaaccccggttcggggtaacgggttaccggtaggggaaacccgggttacgggtaccggttacgttaaccgttaccgtttaagttaccgtaccggtacgtaccgttacctacctaaagtttaccgtaacggttacgttaacgtaaacgtttacggttccgtaaccttccggtaccggttaccggggttccgttaaccgggggtacggtaaccgggttaacgggtaaccggtttaacccgggttccgtaacccgggttaaccgtacgggacccgtaacccgggtaacccggtcccgtttacccccggg

SEQ ID NO: 83939 - DNA, 898 bp, Homo sapiens
  misc_feature: GYAE6OF01CYWLS.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggccacgacgggtcctgggcccagtctggcctgacacagcctgcctccgtgtctgacgactccgtggacagtcgatcaccatcctctgcacgtcggaaccaggcaggtgtacggtttggtgtactttaagttaaactttagttacgttcccttaccgtttacggtttacccgaaactacggtaccttaacgtttccggaacggggtacccaaccgggacccccggtaacccccgttaaaaaccgtttacctttttaaaagtttttaacgtcgggttttaacccgggttttaccggtttttccggtccccggggttaccccgttaccgggtttaacgggggtttttacccttacggtttcccggttacccgttttcccggtcccggggttccctaacccggttaaacggttccggtaaccgggtacccgtaaaccggttaccccggtccccgttacccccgttacgggtaacccttacgtttacccttaccgttaaccgtcccgttacccgacggtccgttagggaacgggtaccggagtaccgttacgtaacctttagttttacgtcgaccgtacgtaccgttaataacgttaacttaacgtagtaaacgttccgttaaacggtttcggttaacccttaccgtaccgtcgggttaaccgttccggggttaacccgggggacgtaaccggggttaaaacccttacggggtttaccggaccggtttaccgacgggttcaaaccgggtacccgaaccgggttccccg

SEQ ID NO: 83940 - DNA, 135 bp, Homo sapiens
  misc_feature: GYAE6OF01EA7DX.36.23.C01.1.454.CMB.1.raw
  modified_base (124)..(124): a, c, t, g, unknown or other
  misc_feature (124)..(124): n is a, c, g, or t
  modified_base (130)..(135): a, c, t, g, unknown or other
  misc_feature (130)..(135): n is a, c, g, or t
tcagtacgctgtctcacgaccggtgctcgatttagtacacgtgattagggattgggcacagcggccctgggctgcctggtcaaggactacttccagacagcgtactgagcgggctggcaaggcncatagnnnnnn

SEQ ID NO: 83941 - DNA, 751 bp, Homo sapiens
  misc_feature: GYAE6OF01DEP8O.36.23.C01.1.454.CMB.1.raw
  modified_base (348)..(348): a, c, t, g, unknown or other
  misc_feature (348)..(348): n is a, c, g, or t
  modified_base (553)..(553): a, c, t, g, unknown or other
  misc_feature (553)..(553): n is a, c, g, or t
  modified_base (619)..(619): a, c, t, g, unknown or other
  misc_feature (619)..(619): n is a, c, g, or t
tcagtacgctgtctcacgaccggtgctcgatttagtacacgtgattaggggagttgggggggggtctcaggaggcagcgctctcaggacatcctccaccatcggccgtgggctctgctgcctcctccaccctcctcactcgacgggcacgtacgggtccgtcgggcccagtcgtcggcctagacacacgtcctcgtccgtccgtgtctgacgtacctccgtggaccgagtaccgactaccaaccacttcctacctcgcctaaccgtacggaaccgacgcgtaaggtggtacggttggtacgttacttaattaatacttccgtcctttccggtacgttacccaaacgtnactaagtacgaggacacggtccccgaaaccttaaactttatttaatttagtcgttacggttttaccgttcggtacccggtcccgtttagggttacgggtttcctaggtcccgtcctttaccggcccgtactacggtaagttccgaccggactaacccggcccggttccctaccgtacgacctatacccgactaaccgccgtacgnggtacgacgggacgacggtagtacttaggtactagttctaggactatcctaagttaactacgtaanagtaacgttcaaggtttcgaactaccggtagttccggtacggttcggggtaaccgggaagggttaccggaaacgtttaaccgtcccgtacggttaccgtaacggccgtaacccggacgtaccgggtcccccg

SEQ ID NO: 83942 - DNA, 836 bp, Homo sapiens
  misc_feature: GYAE6OF01E141L.36.23.C01.1.454.CMB.1.raw
  modified_base (240)..(240): a, c, t, g, unknown or other
  misc_feature (240)..(240): n is a, c, g, or t
tcagtacgctgtctcacgaccggtgctcgattagtacacgtgattagggattgggggggggtctcaggaggcaccgctctcaggacatctccaccatggcctgggctctgctgctcctcaccctcctcactcagggcacgagggtcctgggcccagtctcggcctgacacagcctcgcctccgtgtctgacgtctccgtggacaggtcgatccacctatcctcctgcacgtacggaaccngcagtgtacggttgtgtacttaattaattagtcgttaccttccgttacggttaccaaacgtacgtacctaagttacggacggaccgaccggtaccccgtaaaccccgttaaaactttacgttttaaatttacggttacggttacggttttccgtttaccggtccgggttcccgttacggttacgggttttcctacggttccgttccttccggtaccgtcctaacgtaacggttccgacggtaacctaacccggccggttaccctccgtacgaaccttacgttcctaacgtacgtaccgtcggaacggtcgtaacgggaacggtacggtaccggtacgttaacgtaacgttttaacgttacggtacgacccgttaggtacccttaataacgtttaaccgtaaccggtaaggtaaaccgtttaacggttaagttacccgggttactaccccgggtcgtttacggggttaccggttaccgggggttaccggggaccgggggttaaaaccgggtccgtttaaacccggggttcccgtaaaccgggttcgtaacgggttaaccacccggggttaacgtacccgggtccgttaccccccggg

SEQ ID NO: 83943 - DNA, 739 bp, Homo sapiens
  misc_feature: GYAE6OF01DQPTJ.36.23.C01.1.454.CMB.1.raw
  modified_base (218)..(218): a, c, t, g, unknown or other
  misc_feature (218)..(218): n is a, c, g, or t
  modified_base (229)..(229): a, c, t, g, unknown or other
  misc_feature (229)..(229): n is a, c, g, or t
tcagtacgctgtctcacgaccggtgctcgatttagtacacgtgattagggagttggggggggtctcaggaggcagcgctctcaggacatctccaccatggcctgggctctgctgctcctcaccctcctcactcagggcacagggtcctgggcccagtctggcctgacacagcctgcctccgtgtctgacgactcctggacagtcgatcaccatctccngcactgaaccngcaggtcgacgttggtgtactttaataattagtgttcctccgttacggttaccaacagtctacgttacgacggcacggcccgtaaccccgtaaattacctttaagtttatcggtaggtttcctttccggtccgtcccgttacggtaggggtttcctacggtccgtcgttcccgtccggtacctaccgtaacgtcgtacggaccaaacccgtaccggtccccttacccgtacgtaacccgtacttcccttacgtaaccgaccgttacccgagggtcctagggtaaccgggacggtaggtaccgtaggttaacctttagttttaactcggaactacggtaccttaataacgttaacgtaaccgttagtaaaccgttacttaaacggttcggtaacttacccgtacgttcggtaacgtttcgggttacgggaccgggtaacgggtaccgtaaacgggtttcccgaaccgtttaccgggacgtaaccggacccggtcccgtaaggtcccccggg

SEQ ID NO: 83944 - DNA, 772 bp, Homo sapiens
  misc_feature: GYAE6OF01C4JVH.36.23.C01.1.454.CMB.1.raw
  modified_base (176)..(176): a, c, t, g, unknown or other
  misc_feature (176)..(176): n is a, c, g, or t
  modified_base (242)..(242): a, c, t, g, unknown or other
  misc_feature (242)..(242): n is a, c, g, or t
  modified_base (260)..(260): a, c, t, g, unknown or other
  misc_feature (260)..(260): n is a, c, g, or t
tcagtacgctgtctcacgaccggtgctcgatttagtacacgtgattagggagttggggggggtctcaggaggcagcgctctcaggacatctccacatcggcctgggctctgctgcctcctccaccctctcactcgagggcacgtaggggtccgtcgggcccagtctcggcctgacncacgcctgcccgttccgtgtctggacgtacctccgtggactaggtcgactccaccacttccttccncgacacgtacggaaaccnggtcagggtcgtacgggttggtacgttactttaattaactttcgttcgttacccgtttccgttaccggttaccaaacgttaacgcgttacgttacggaacgggtccaccggaccccgtaaacccgttaaactttaacttttaacgttttacgtacggtttaccgggttttccgtttccgggtcccggttaccccggtttacgggtttacggggttttcctacggttccgtcgtttacccgtccggtctacgtacgtccgtacggacctaaccgccgtcctaccgtacgactccgttactccgtaacgtccgacgtacggtggtacggaacggtcggacgtctacgtactttagtcgtcgactacgcttacgtaacttagtacgtaggtaactacgtaggtcttacgacgttcggtacggttgttacggggtaccggaacgggtaacggtaacgttacgggttctaccggttaccgggtactcccggaacggtaaccggtccgggttaccccg

SEQ ID NO: 83945 - DNA, 656 bp, Homo sapiens
  misc_feature: GYAE6OF01AUAM8.36.23.C01.1.454.CMB.1.raw
  modified_base (519)..(519): a, c, t, g, unknown or other
  misc_feature (519)..(519): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacgagggtcctgggcccagtctggcctgacacagcctgcctccgtgtctgagactcctggacagtcgatcaccatcctcctgcacgtcggaaccagctagtgacgttggtgacttaattaacttatcgtctccgtggtccaactacgctattcaggcacgccgaccccgtaaacgttctttaatttagtgtacggttcttaccgtcggcccgtcgtacgggtttctacgttcgtccgttcgttcccgtcgtaccaacggttcgttacggaccgtaaacctacccggtccccttcccgtacgtaccctacttacgtacctacgtaacgtacccgaggtacgcggacgggaccggacggtactcgtaacttattacgttcgtancgactcaattacgtactaggtaactacgtaatcgtaacgtcacgttcggtacgttcggttccggggaggaaccgggtaaccgtacgggttacgaccccggtaccgttacggacgacccggacccgtacgtccccggg

SEQ ID NO: 83946 - DNA, 587 bp, Homo sapiens
  misc_feature: GYAE6OF01A72J2.36.23.C01.1.454.CMB.1.raw
  modified_base (187)..(187): a, c, t, g, unknown or other
  misc_feature (187)..(187): n is a, c, g, or t
  modified_base (209)..(209): a, c, t, g, unknown or other
  misc_feature (209)..(209): n is a, c, g, or t
  modified_base (227)..(227): a, c, t, g, unknown or other
  misc_feature (227)..(227): n is a, c, g, or t
  modified_base (266)..(266): a, c, t, g, unknown or other
  misc_feature (266)..(266): n is a, c, g, or t
  modified_base (298)..(298): a, c, t, g, unknown or other
  misc_feature (298)..(298): n is a, c, g, or t
  modified_base (331)..(331): a, c, t, g, unknown or other
  misc_feature (331)..(331): n is a, c, g, or t
  modified_base (420)..(420): a, c, t, g, unknown or other
  misc_feature (420)..(420): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctcgtgtctganactcctggacagtcgatcaccntctcctgcactggaaccngcagtgacgttgtgacttatattatgtctctgtccaacngcattcagcagccgcccgaaactctaatttanagtaggttcttcgtccgccttcgtacgggtttnacgtcgcttctccggctcgaacgtctcgcacgccggtacctcctagacctagtcctacgtacgacctccggaggtctaggaaggacggngaccgttagaccttaagttactttgactacgtctactaacgttataccgttagacgttacaacggtagtacttcccagttcgtaacgttcgggttccggcggggtacggtacccgtaggttaccgtccccgttacgtacggtaccaccggtccgtacgggtcccccg

SEQ ID NO: 83947 - DNA, 1059 bp, Homo sapiens
  misc_feature: GYAE6OF01BFL14.36.23.C01.1.454.CMB.1.raw
  modified_base (230)..(230): a, c, t, g, unknown or other
  misc_feature (230)..(230): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacgagggtcctgggcccagtctggcctgacacagcctgcctccgtgtctgagactcctggacagtcgatcaccatcctcctgcacgtggaaccngcagtgacgttggtgcttataatttatgtctcctggttaccaacagcattcaggcagccgacccgaacttcttaatttatgtagttctttcgtcggtccctcggtacggggtttctacggtcgtctttcgtcccggtctacccgtaacggttcgttcgggacctaaaccgtaccgggtccccttccccgttacggtaacccctacgttaccctttacccgttaaccggtaaccccgttacccccggtaacggggtccccgttaacgggggtaaacccggggggtaaaccccgggggttaaccgggggttcccggttttaacgggggtttaaaacccccgttttttttaaaacggttttttaaaaccggttttttacccggggttaacccccgttaaacggggtttaccccctttaacccgggtttaaaaacttttttaaaaccccgtttaaacccggggttttttaaccgggtaaaaaaccggggttttaaaccccgttaaaaacggggtttttaacggggggttttaaaaccccgttttttaaaccccccggtaaaacccgggtttttccggggggtttaaacccccgggttttttaccgggggggggttttttaacccccggggggtaaacccggggggggggtttaaaccccgggggggttaaaaaaccccccgggtttaaacccgggggtttttaaaccggggtttaaacccccccgggggttttaacccccgggttttaaaaccggggggtttacccccggtaaaccccggggggttaaacccccccgggttaaaaaccccggggggttttcccccccccgggg

SEQ ID NO: 83948 - DNA, 792 bp, Homo sapiens
  misc_feature: GYAE6OF01BRVZA.36.23.C01.1.454.CMB.1.raw
tcagtacgctgtctcacgaccggtgctcgattagtacacgtgattagggattggggggggtctcaggaggcaccgctctcaggacatctccaccatggcctgggctctgctgcctcctcaccctcctcactcagggcacagggtcctgggcccagtctggcctgacacagcctcgccctccgtgtctgacgacctccgtggacagtcgactcaccatcctcctagcacgtggaaccagcagtgacggttggtcgtacttaataattatcgtccttcgttcggttaccaaacgagtctagttcgacggacaccggacccgtaaccccgtaaactttactttaaagttttacgtagggtacgtttcccgtttcggtccccggttacccttacgggttagggttttaccgtcggtccgttccgtttcccgtacccggtcccttaccggtaaacgtttccgtacggtaaccctaaacccgtccccgggttccccttacccgtacccgtaacccttacttcccgttacccgttaaacgtacccgacccggtaacgggtccgttaaacgggaacggggtaaccgacggggttacttaaccggtccgtttaagttttaccgtggtcctaacgtacctttacgatttaacgtacggtaagtaagtttaacctaagttcggtccaacgttacggtcggtacgttacggggttccggggaaaccggttaggtaaacccggtcgttccggaaacccgttccgtacggaccgaccggtacccggtacggtcccgtaaccccggg

SEQ ID NO: 83949 - DNA, 887 bp, Homo sapiens
  misc_feature: GYAE6OF01CJKQZ.36.23.C01.1.454.CMB.1.raw
  modified_base (855)..(855): a, c, t, g, unknown or other
  misc_feature (855)..(855): n is a, c, g, or t
tcagtacgctgtctcacgaccggtgctcgatttagtacacgtgattaggggagttgggggggggtctcaggaggcagcgctctcaggacatctccaccatggccgtgggctctgctgctcctcaccctcctcactcgagggcacgtagggtccgtcgggcccagtcgtcggcctagacacacgcctgcctccgtgtctgacgtacctccgtggacgagtacgactccgacctactcctcctgccacgtacgggaaaccagcgtaggtcggttacggtttggtcgttaactttaaattaacgtttccttacgttcccgttacccgttacggttacccaaacgtacgtccttaacgttccgaacgggtccacggaccccccgtaacccttaaacgtttcttttaaaccgtttagggtcggttaccggtttcccggtttcccggcccggtccgttacgggtttacggggttttcctacgggttcccttacccggtttccggaccccgtttaccgtcgtaacggtccgttacggaccctaacggtccccccgttcctccgtaacgtaaccctcgttaccgttacccgtacgaacccgtccggtacggtcggacgggaacgggtaccggtacgggttacctaagttaacccgtttacgtttacgttccgtacgtacccgtacgtttaaccgtaactttacgtaacgttaacggtaacttaacgttaacggtttaccgtaacccgtccggttacgtttccgggttacgttacccgggggtaaccgggggacccgggttaaaccgggttaaccggttaccggttaacggttaccccccggttagggtacccgggttaacccncccggggttacccggttaccggggtacccccg

SEQ ID NO: 83950 - DNA, 660 bp, Homo sapiens
  misc_feature: GYAE6OF01DLEXC.36.23.C01.1.454.CMB.1.raw
  modified_base (236)..(236): a, c, t, g, unknown or other
  misc_feature (236)..(236): n is a, c, g, or t
  modified_base (275)..(275): a, c, t, g, unknown or other
  misc_feature (275)..(275): n is a, c, g, or t
  modified_base (364)..(364): a, c, t, g, unknown or other
  misc_feature (364)..(364): n is a, c, g, or t
  modified_base (377)..(377): a, c, t, g, unknown or other
  misc_feature (377)..(377): n is a, c, g, or t
  modified_base (506)..(506): a, c, t, g, unknown or other
  misc_feature (506)..(506): n is a, c, g, or t
  modified_base (544)..(544): a, c, t, g, unknown or other
  misc_feature (544)..(544): n is a, c, g, or t
  modified_base (550)..(550): a, c, t, g, unknown or other
  misc_feature (550)..(550): n is a, c, g, or t
  modified_base (556)..(556): a, c, t, g, unknown or other
  misc_feature (556)..(556): n is a, c, g, or t
tcagtacgctgtctcacgaccggtgctcgatttagtacacgtgattagggagttggggggggtctcaggaggcagcgctctcaggacatctccaccatcggcctgggctctgctgcctcctccaccctcctcactcgacgggcacgtacgggtccgtcgggacccctagttcgtggccctagaaccaacgtagcccttcgcccttccgtgttctaggacgtacctcctgggaaacncggtcatcaccgtattccgcctgacctacgcggaaaccngctagtgtacggtttggttagttaattaacgtttgttccttacgtacggtaaccaacggacgccaccggtacaactccgaaccccaatntatagtatttcgngtacgtctactcacgtcggtaccgttacggttacgggttactacgtctcttacgtctacactactccgtagtccgtacgacgtaaccgacctcccttaccggacgttcctacgttcctcgggtcgtacnccgaggcgtaaggacggacgtgtaacttattacgtttntacgtnacgtanactacaccaacgtacactatctagtacgtcgtacggtcggacggtaacgactacggtcctaccgtaacgttccgtaacgtacgaccgtcggccgtccgtccccg

SEQ ID NO: 83951 - DNA, 845 bp, Homo sapiens
  misc_feature: GYAE6OF01D2OYY.36.23.C01.1.454.CMB.1.raw
tcagtacgctgtctcacgaccggtgctcgatttagtacacgtgattagggattgggggggggtctcaggaggcagcgctctcaggacatctccaccatggcctgggctctgctgctcctccaccctcctcactcagggcacgacgggtcctcgggcccagtcgtcggcctgaccacagcctcgcctccgtgtctgacgcctccgtggacagtcgactccaacctactcctcctgcctacgtacggaaccagcagtgtacggttggtatactttaataatttacgttcgttccttccgttcggttacccaactacgtctacttacggacggtccgacggtacccggtaaccccgttaaactttaccttttaaagtttacgtcggttaccggttttacctttccgggttacccggtaccccgtttacgggttacggggttttaccgttacggttccgttaccggtttcccgtacccgggtacctacccggtaacggttccgtacggaccctaacccgtcccggtcccttaccccggtacgacccttacttaccgttacccgtaacgtacccgtacccgaagggttccgtaagggtaaccgggaacggtacgggtacgttaacgttactttaacgtttacggttacgacgtacgttctaacgttaacgttacgttaacgtaagtaacgttaacgtaagtttacggttacctaccgttacgtcgggttacgtttacgggggaccgggtaacggggaaccgggttaaaccggttaaccggtttaccgggttaaccccggttaccgggttaacggtcccgaaaccggtaccccgggtacggttacccccgg

SEQ ID NO: 83952 - DNA, 874 bp, Homo sapiens
  misc_feature: GYAE6OF01D2WWV.36.23.C01.1.454.CMB.1.raw
tcagtacgctgtctcacgaccggtgctcgattagtacacgtgattagggattgggggggggtctcaggaggcagcgctctcaggacatctccaccatggcctgggctctgctgctcctcaccctctcactcgaggcacgagggtcctcgggcccagtcgtcggccctgaccacagcctcgtccctccggtgtcctagacgtacctccgtggactagtcgaactccaacctacttcctacctgacctaacgtacggaacccaggctaaggtcgtaccggttggtacgtactttaataacgttagttccgttaccttccgttacggttaacccaacgtacgtaccttacgttacgacggaccgaccggtaaccccgtaacccccgtttaaaattacccttttaaagttacgtaccgggttacgtttcccggtttaccgggttccccggtacccggtttacggttacggggtttacctacgttcccggttcctttacccggtcccgtacccgttaccgtaaacggtttcccggaacgggtaccgtaaacccggtaccccggttccccttaacccgtaccgtaaccgttaccgtttaccgtacccgttaacggacccggttaccgtaagggtaccgttacgggaacggttaaccgggacggtaccttaacgtaactttactttacggtcgtaacctacggttctaaagtacttaaccgttacggtaacgttaaccgtacgttaacgttacggtaaccttccggtaacgttcggtaaccggttggggtttaacccggggacgggttaccggtaaaacccgttcggttaccggtaccggttaccgttacgggacctaaccggtacccgaaggttcccccg

SEQ ID NO: 83953 - DNA, 668 bp, Homo sapiens
  misc_feature: GYAE6OF01BDHHI.36.23.C01.1.454.CMB.1.raw
  modified_base (171)..(171): a, c, t, g, unknown or other
  misc_feature (171)..(171): n is a, c, g, or t
tcagtacgctgtctcacgaccggtgctcgatttagtacacgtgattagggagttggggggggtctcaggaggcagcgctctcaggacatctccaccatggcctgggctctgctgctcctcaccctcctcactcagggcacgagggtcctgggcccagtctggcctgacacngcctgcctccgtgtctgacgacctccgtggacaggtccgaatccaccattcctaccgtgactacgtggaaccagcaggtcgtacgttggtgtcttataattatgtctcctgtaccaacagctatcgaggcgacgccgaccctaacttacttaattataggtcgttcgtttcgtccggtccttcggtacgggtttcgtacgttcgtcgttccgtccggtcttaccgtaacgtcgtacggacctaaaccgtaccggtcccttacccgtacgtaaccctacgttccttactacgtacctccgacggtccgtaggacggtaccgacggtacgtagtacttacgtacttcgacctacgtcttaaccattactaacgtgtaacgtactaagttaccggtactaccgtgtacggtcgttacgggttccgggaaccggcgggtaacccgtaggttacccggacccgtttccggtaacggtcctaccggtacccgaaccggtcccg

SEQ ID NO: 83954 - DNA, 683 bp, Homo sapiens
  misc_feature: GYAE6OF01EPH1V.36.23.C01.1.454.CMB.1.raw
  modified_base (162)..(162): a, c, t, g, unknown or other
  misc_feature (162)..(162): n is a, c, g, or t
  modified_base (271)..(271): a, c, t, g, unknown or other
  misc_feature (271)..(271): n is a, c, g, or t
  modified_base (557)..(557): a, c, t, g, unknown or other
  misc_feature (557)..(557): n is a, c, g, or t
  modified_base (573)..(573): a, c, t, g, unknown or other
  misc_feature (573)..(573): n is a, c, g, or t
  modified_base (648)..(648): a, c, t, g, unknown or other
  misc_feature (648)..(648): n is a, c, g, or t
  modified_base (673)..(673): a, c, t, g, unknown or other
  misc_feature (673)..(673): n is a, c, g, or t
tcagtacgctgtctcacgaccggtgctcgatttagtacacgtgattagggattgggggggaaatactttctgagactcatggacctcctgcacaagaacatgaaacacctgtggttcttcctcctcctggtggcagctcccagatgggtcctgtctcaggtnccagctgcagtcaggtcgggcccagggagtggagaacgccgttcgggacgaccctcgtcccctcgaccttgccgcgtgtgtccgtggacgtccctcccgtcgggcgganagtggtaagttgggtggtaggtttccgggcccgtccgaccggtaccccggaggggaacgggtcgtaggcggttggtacggttaggtacgtaaaagtaacgtggacgggaccggggaccaacgaaccgtacgacgtacgtcccgtccgtaggacgggtacgagtaccactactagtcgtacgcgtaacgaccgtaacgtaacaaaccgtaacctacctttaccgtcccgtagtccgtagtaccgtacgttactcggtaaccgcgaacccgcgggtactccggacttntagtttactagttgtncgtaagtttggtttcgacgttggtattcgggtgggttcgaggttacggtccgtggttacggggtacagggtaccncggtacgcacgttccgtcctagccncgcctaccgg

SEQ ID NO: 83955 - DNA, 852 bp, Homo sapiens
  misc_feature: GYAE6OF01C5ZA3.36.23.C01.1.454.CMB.1.raw
  modified_base (149)..(149): a, c, t, g, unknown or other
  misc_feature (149)..(149): n is a, c, g, or t
  modified_base (192)..(192): a, c, t, g, unknown or other
  misc_feature (192)..(192): n is a, c, g, or t
tcagtacgctgtctcacgaccggtgctcgatttagtacacgtgattagggagttggggggggggtctcaggaggcagcgctctcaggacatctccaccatggcctgggctctgctgcttcctccaccctcctcactcgacgggcaacgngggttcctcggggccctagtccgtcgggccctaggaaccaccncgccttcgccccgttccggttgttccgtaggaacgtaccctttccggtaagggaaacgtacgggtttaccgaacttaccaaacccgtacttccgttaacccgcggtacaaccgtaacggggaaacccaagaccgtacggggttacggttaaccgggtttggttaacgttaaccttttaaagttaaatttaccgttcgttaaccgtttcccggttaacggttaaccccaaaggtacggtaccttaacggttcgaacgggacccgttacggaacccccgtaaaccccggttttaaaacctttagttttaaagttttacggacgggtttacggtttaccttttacccggggttcccgtacccggttacggttttaacggggtttccttaacggtttccggcgttttcccgacccgggttactaaccgtaacggttcctacggaacccacgtacccggtcctaaccgacgtaacctacttaccgttacgaacgtccgtacgtacgattacgggacgagacgtcctagaacttatcgtcgatacgctataacttgaaacgtgtaacttacgacgtagcctaacgtcgacggttcgtcgggtacggtaccgggagtaacttacggtccgaacgttcgtaacggaccgtccggagacgttaccccgg

SEQ ID NO: 83956 - DNA, 642 bp, Homo sapiens
  misc_feature: GYAE6OF01BNOSG.36.23.C01.1.454.CMB.1.raw
tcagtacgctgtctcacgaccggtgctcgatttagtacacgtgattagggattggggggaagaggaagactgacggtcctgtctcaggtgcagctgcagcagtcgggcccaggagtggtgaagccttcggagaccctgtccctcacctgcgctgtgtctggagcctccctcggcggagatgaagtggtggagttgggtccgccacgcccccgagggaagggctgagttggattggtagaaataaatggaacggaccgggggcaaccaactacaatgcgtccctcgaggggtcgagtcaccatatctgcagacaagtccaagaacctacttcctcccgtagacggctcgacctcgtgtcgacccgccgcggacgtcgccatatattattgtgcgtagttgtttttgcgtaggtacgttcgggttcggggcggttacgtacggtacggttcggttaggggtacgaagggtactccgacggtctacgtccgtcctccgtcacgtccctaccgacccgtaaccgggccctacgttcccggttcccttcccccggtcgcccgtcccgtcgtcctccgacggccgacccgtacccgtacggacgacgccgaccgcggacccggcccggtcgggtccgtcggtacccgg

SEQ ID NO: 83957 - DNA, 684 bp, Homo sapiens
  misc_feature: GYAE6OF01EUQQN.36.23.C01.1.454.CMB.1.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
  modified_base (529)..(529): a, c, t, g, unknown or other
  misc_feature (529)..(529): n is a, c, g, or t
tcagtacgctgtctcacgaccggtgctcgatttagtacacgtgattagggattgggggggggtctcaggaggcagcgctctcaggacatctccaccatggcctgggctctgctgctcctccaccctcctcactcagggcacgagggtcctcgggccctagtctgggcctagacacagtcctcgccctccgtntctgacgacctccgtgacagtcgancacatctctgacaacgacgacagcgagttagacgttggtctacttaattaattattacgtcctacgttcgtaccaaactcgactagttcaagcgacgccgaacccgtaaaccttatttaattacgtacgttacggttcgttttccgccggtcctacggtacggtttacacgtccgtccttctaccggtacctacgtaacgttccgtaggtaccaaccgtacggtcccttacccgtacgtaaacccttgtacccttacgtaacgacctccggaagtcgtagacggacgtagcgtagtatttagtacgttacgnaccgtcttaagactaacgttactaagtaacggttctaaaagttcgttaaccgaccttaaccggtggtaccgtttcggggtccggaagggtaccggtaaactacgggtttacggacccgttacgaccggtacaacccggtccgttaaaggtccccg

SEQ ID NO: 83958 - DNA, 733 bp, Homo sapiens
  misc_feature: GYAE6OF01AGBFT.36.23.C01.1.454.CMB.1.raw
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagacctcctggacagtcgatcaaccatcctcctgcacgtggaaccagcagtgtacggtttggtgtactttataaatttagttcgttccttccgttcggttaccaacgagctattcgaggtcaacgcccgacccctaaacttactttaaatttagtgtacggttcctttccgtcggtcccttcggtacgggtttctacggtcgtctttaccgtccggcttacccgaaggttccgtggacctaaacgtacccggtcccttacccgtacgacctacttactccgtacgacctccgaggtccgtacggaacgggtaccggtacggtccgtacgtaacgttatttacgtttaccggctaacgtcgtactaagttacgttaacgttaggtaacgttacttaaacgttcgggtacttacccggtacgttaccgggttcgtttaccggggttcggggtaacccggggtacggggttaaccccgttaagggtttacccggacccggttaacccggttaacggtaccggacgtaccccggtaaacgggtcccccgg

SEQ ID NO: 83959 - DNA, 697 bp, Homo sapiens
  misc_feature: GYAE6OF01DF0XC.36.23.C01.1.454.CMB.1.raw
tcagtacgctgtctcacgaccggtgctcgatttagtacacgtgattagggattgggggggggtctcaggaggcagcgctctcaggacatctccaccatggcctgggctctgctgcctcctcaccctcctcactcagggcacagggtcctgggcccagtctggcctgacacacgcctgcctccgtgtctgacgacctccgtggacacgtcgatccaccattcctcctgccactacggaaccagcgagtcggtacgttggtcgtactttaattaattattcgttaccttccgttacggttacccaaactacgtactacgttcgacggccgacggacccgtaaccccgtaaacttactttaatttacgtggtaacgtttcgtttccggtccggtacccgttcggttacgggtttacgtcggtccgtccttccggtcccgtcttaccgtaacggtccgtacggacctaaccgacccggtacccttcccgtcgtacctacgttcctacgtaactccgtacccgagtcgtacggaacgggacgacggtactacgtacttattactcgcgtacgctactaattacgtactagtacgtactaacgtgtactacctcgtcggtcgtgggtaccgggacgggtacggtaaccgttacggttaccggtacccgttaccgtacggttccaaccggtccgacgtccccgg

SEQ ID NO: 83960 - DNA, 998 bp, Homo sapiens
  misc_feature: GYAE6OF01BNUJB.36.23.C01.1.454.CMB.1.raw
tcagtacgctgtctcacgaccggtgctcgatttagtacacgtgattagggattgggggggaaatactttctgagactcatggacctcctgcacaagaacatgaaacacctgtggttcttcctcctcctggtggcagctcccagatgggtcctgtctcaggtgcagctgcagcgaggtccgggccagggagtgggtgaacgtccgttcggacgtacccgttccgtcccctcaccgtggtccgtcgttgtcgtcgtacgggaccgtccccgtcccggtcgggacggaagtagtacggtaaggttgggtacggttacggttccgggacccggtacccgaacccggtaccccgggtaagggggacggggtacggtacggttaggttagggttaggtttaacgggtaagtaaaacgtaaaggttacggggaaccggggtaacccgggggaaccaaacccgtaaacgtaaaccgtaacggttacccggtacccggttccccgtaacgggtaccgggggtaccgtaaccggtaaccctaaacccgtaacgtacgttaccgtacggaaccgtaacggaaaacccgtaaaccggttaaacccgaaaaacccggtaaacccctttaccccgtttaacccggttcccgttaacggggtacccggttaacccgtttaccgtaacccccggtttacggttaccgggtacccggtaccccgggtaccccggggtaaccccggtaacccggttaccccggtaccgtttaaagtttaaccgtttaacgtttttaacggttcgggttaacgggttacggtttaacggggttttcgttttaacggggaacgtttaacggttaccgggtttcgggttaccgggggttaacgttacgggttaccgggttccgggttaacgggggtacgggtaaacggttaaccggggtacttaccggtaccgggtcgttaaccgtcccgttacccgtacccctaggtaccccgtacccctaacccggg

SEQ ID NO: 83961 - DNA, 822 bp, Homo sapiens
  misc_feature: GYAE6OF01EM0VH.36.23.C01.1.454.CMB.1.raw
tcagtacgctgtctcacgaccggtgctcgattagtacacgtgattagggattgggggggggtctcaggaggcaccgctctcaggacatctccaccatggcctgggctctgctgctcctcaccctcctcactcgagggcacgagggtcctgggcccagtctggcctgacacagcctgcccttccgtgtctgacgtacctccgtaggacaggtcgactaccacctattcctcctggacctaacgtacgggaaccagcaggttcggtacggtttggtcgttactttaaagttaagtttagttcgtcccgtttaccggttacggttaacccaacgtacgtacctacgtttaccggagggtacccgacgggtacccccggtaaacccctttaacgtttaacgtttttaaaggtttacgttacgggtacggtttttccgttttacccggtccccggttcccggtttacgggttacggggttttcctacggttcccgttccgtttccgtacccgggtcctaaccggtaacgttccgtacggacctaacccggtccggtacccctccgtacgtaccctacttccgtactaccgtaccgaccgtggtacgtaggaacgggcggtagtacgttacgtaacgttagtttacgacggtctaccgtcttaacgtaattacgtacggtagtaaccgtattaagtcgttaccgtaccgttaggtcggttcgggtaccgggttacggggaccgggtaaccgggttacgttacgggtaccgttacccggttacggtacgttaccccgacgggaacccgtaccggttccctacccccggg

SEQ ID NO: 83962 - DNA, 759 bp, Homo sapiens
  misc_feature: GYAE6OF01AU75Z.36.23.C01.1.454.CMB.1.raw
  modified_base (645)..(645): a, c, t, g, unknown or other
  misc_feature (645)..(645): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacgagggtcctgggcccagtctggcctgacacacgcctgccctccgtgtctgacgacctccgtaggacagtcgatccacctattcctcctgactacgtacggaaccagcaggttcgacggtttggtactacgtttaattaatttagtgttaccttccgttacggttaccaaacgtacgtactaagttacgaacggccaaccggtacccgaaccccgtaaaatttccttttaaattacgtacggtaacggtttacttccggtaccggtccttagggttacggggttttcaacggttcctccgtttaccgtccggtactaacgtacggtccgtacggtaccaaccgtccggtcccctaccgtacgtacctacgttcctacgtaacgtaccgtacgtacggtaccgtacgggaacgggtacgtacgggtacttacgtaactttagttacttcgacgtacgacgttactaacgttactaacgtaagtaaacttacgtaacgtacgttaaccnccggttaacgtccgggtaagttcccggggttaccgggaacggggtaacggtaaacccttaggttacccgtaccgttacggtacgtacccgaaccgtccggtaaccggtccccgg

SEQ ID NO: 83963 - DNA, 1025 bp, Homo sapiens
  misc_feature: GYAE6OF01BAUG2.36.23.C01.1.454.CMB.1.raw
tcagtacgctgtctcacgaccggtgctcgatttagtacacgtgattagggattggggggggggtctcaggaggcagcgctctcaggacatctccaccagtggcctgggctctgctgctccctccaccctcctcacctcgacgggcacgacgggtccgtcgggccctagtctcggacctgacacacgtccctcgcccgtccgtgtctacggacgtaccttccgtagggaccacggttacgacttaccacctacttcctacctcggacctaccgtacggaacccaaccgacggtacctaggttacggtacgggttttggtacttaactttaaatttaacgttacgttccgttacccgttaccggtttaccgtttaacccaacgtacgacgtttaacgtccggaacggacccgtaaccgggaccccccggtttaaccccgttaaacctttaacgttttttaaagtttcggttagggtttaccggttttaccttaccggtaccggttcccgggttacccctttacggggggttaaccggttttccgttaaccggtttccccgttacccgtttcccggtaccccggttcctttaaacccggtaacgggtttcccgggacctaaaccccggtacccggtacccccggtttacccctaccgtacccgttaacccctaacggtttaccccacgggtaaacccttaccccggtacgaaccgggggtgaaaccccggggtacggaacccgggtttaacccggtaccgtttacggttaaacccttttgttttacggtacccgtaacggttaccgtaccctttaaacgttaacccttttaaaaccgtcgggtttaaaaccgggtactttaaacgggttaacgttaccccggtaaaccgttccgttaaccggttcggggtaacccggtttaggggtacccgggggtaaaccgtaacccggggttaacgtttaaacccgggttcgggtaaaccccggtttacccggggaacgttaaccccggtaaccgggtaacccggg

SEQ ID NO: 83964 - DNA, 841 bp, Homo sapiens
  misc_feature: GYAE6OF01B2E73.36.23.C01.1.454.CMB.1.raw
  modified_base (243)..(243): a, c, t, g, unknown or other
  misc_feature (243)..(243): n is a, c, g, or t
  modified_base (258)..(258): a, c, t, g, unknown or other
  misc_feature (258)..(258): n is a, c, g, or t
tcagtacgctgtctcacgaccggtgctcgatttagtacacgtgattagggagttgggggggggtctcaggaggcagcgctctcaggacatctccaccatggcctgggctctgctgcctcctcaccctcctcactcgagggcacgacgggtcctcgggcccagtccgtcggccctgacacacggccctcgcccttccgtgttctagacgtacctccgtggacctaggtcactccaccatcctcngctacgtacggaccngcaggtcgtacggttggtctacttataagttctcgttccttccgtaggtacccaagcgtactagtcggagaccgaccggtacccgtaaccccgttaaaacttcgttttaaacttggtacggttaacggttttcccgttcccgggtacccggtcccgtttagggttacgggtttccacggttcccgttacttccccggtcccgtacgttaacccgtacgggtaccgttacgaacccgtaaacccgggcccgttcccccgttaaccaccgttaccctagttccccgttaactaccggacccgtcggtaacggtcgtacgggaaccgggtacggcgtacttaacggtacccttttagttccgagacccttacgtctaaacttaagttaaccggttacgttaggtaaacctagttaaaggttccgttaacccgtcgttacggggtacggttacccggggtttcgggaacccggggttaaccggggaaccgggtttttaaaccgcgggttttaccccggaaacccggggttttctaaaccggggtaccccccgaacggggttcccgtaaaccccgggttaccccccgg

SEQ ID NO: 83965 - DNA, 672 bp, Homo sapiens
  misc_feature: GYAE6OF01BGX75.36.23.C01.1.454.CMB.1.raw
  modified_base (236)..(236): a, c, t, g, unknown or other
  misc_feature (236)..(236): n is a, c, g, or t
  modified_base (250)..(250): a, c, t, g, unknown or other
  misc_feature (250)..(250): n is a, c, g, or t
  modified_base (276)..(276): a, c, t, g, unknown or other
  misc_feature (276)..(276): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagacctccgtggacagtcgatccaaccatcctcctgcacgtaggaaccngcagtgacgttggntctatattatgtctcctggtaccaangctattcgaggcacgcccgacccgtaaactcttttaattagtgtacgttctttccggtcccggtccttcggtagggtttctacggtcctccgttcgtccggctacccgtaagtccgtagacctaaccgccggtccctcctacgacctacttctactacgtactccgaggtctacggacggtacgagggtcctagaccgtttattacgtcgtacacgtacttacgtaataacgtttactaacggtactaactaagttcggtaactccgtacggttcgggtccgttacgggttcccggggacgggtaaaccgggtacccgttaacgggtttaccccggtacccgttaaccgggttaccgggaccgtaacccgggtaaccccggtaacgggttcccccg

SEQ ID NO: 83966 - DNA, 727 bp, Homo sapiens
  misc_feature: GYAE6OF01CG3BX.36.23.C01.1.454.CMB.1.raw
  modified_base (127)..(127): a, c, t, g, unknown or other
  misc_feature (127)..(127): n is a, c, g, or t
  modified_base (166)..(166): a, c, t, g, unknown or other
  misc_feature (166)..(166): n is a, c, g, or t
tcagtacgctgtctcacgaccggtgctcgatttagtacacgtgattagggagttggggggggtctcaggaggcagcgctctcaggacatctccaccatgcctggctctgctgctcctcaccctcctnactcaggcacaggtcctggcccagtctggcctgacacancctgccctcgtgtcctgacgtacctccgtaggacctaggtccactcctaaccgtatcctctgcctacgtacggactagcgtagtgtacgttggtgtacttaagttaattacgtcgttaccttcctagggtttacccaaacgtcgtactacgttccgaggcacggtcccgaacccgtaaaactttcgtttaatttacgtacgtcgtttccgtttaccgtcgacccgtttaggtacgggttttctacggttccttcttcccgtaccggcttacccgtagtcgacgtacaaccgtacccggtccctccgtacgacccgtactcccgtaacgtaccgtaccgtacccggtagtacgtcggtaacgggaccggtacgcgtaacgttacctttaagttacgttacacgtcttccgtaacccttaattaacgtacgtacgttaaagtactaacgttcgacgtccctagtcggttaaccgttccggtaccgggtacgggtaaccggttaccgttacgggttaaccgttccggtaccgtacggttacctacggtaaccgtcggtaccccg

SEQ ID NO: 83967 - DNA, 976 bp, Homo sapiens
  misc_feature: GYAE6OF01C2XSN.36.23.C01.1.454.CMB.1.raw
  modified_base (208)..(208): a, c, t, g, unknown or other
  misc_feature (208)..(208): n is a, c, g, or t
tcagtacgctgtctcacgaccggtgctcgatttagtacacgtgattagggattgggggggggtctcaggaggcagcgctctcaggacatctccaccatggcctgggctctgctgcctcctcaccctctcactcgacgggcacgagggtccgtcgggcccagtcgtggcctgacacagcctgcctccgtgtctgacgactccgtggacncgtacgactcaccactcctcctgccacgtacggaaccagcgagtcggtacggttggtacgtacttttaattaactttagtcgtttcccgtttccgttaccgggtttaaccaaacgtacgtactaacgtttcgaacgggggtccaaccggtacccggtaaccccttaaaactttctttttaaagttttacggttaggttaaccggttttccgtttaccgggtaccccggtacccggtttacggtttacggggttttaccgttacggtttccggttcccttttacccgggtcccggttaccttaccggtaacggttccggtacccggacccgtaaccggtacccccgggttccccttaacccggtacctacccgttaacctttaccgtacccggttaaccgttaccccgtaacccggttaccggggtaccggttaacggggtaaaccgggtaccgggtaaccgggttaacctttacggggttaacttttaaacgtttacgttccggaacgggttaccctacgtttaaccttaacggttaaccctttaacggtaaaccgggttaaacgttaaccggtttaaccggttacgggttaaccctccccgggtttaaacggttccggggtttaaccgtaccggggggtttacccggggaaccgggggttaaacgggttaaccccgggttaagggtttccccgggtaacccggtttacccggggtacgggttaaccccgtaacccggggtaaccccgttaacccgggtaccccccgg

SEQ ID NO: 83968 - DNA, 876 bp, Homo sapiens
  misc_feature: GYAE6OF01EN1EI.36.23.C01.1.454.CMB.1.raw
tcagtacgctgtctcacgaccggtgctcgatttagtacacgtgattagggattggggggggaaatacttttctgagactcatggacctcctgcacaagaacatgaaacacctgtggttcttcctcctcctggtggcagctccagatgggtcctgtctcaggtgcagctgcagcagtcggccaggagtggtgaagccgttcggagtaccctgtccctcacctggcgctgtgtctcggacgccgtccacggcggagagttgaagtggtaggtacggttcgggtacccgacccgacgaccccggaagggggtaacggggtccgtggtaaggttacggtagttggggtaaacgtaaaagtaaacgtacggacggggtaaccccggggtaccgtaaccgaaaaaccttaaccgtaagttacggccgtaccccggtacggtcggggtacgacggtacctaaccacgtacttcgtacgactaacggaactaaacgttacccgaaacggtaaaacccttaccgttcccttaccccaacggtaccggttaaccgttccggacccgttacttacgggtaccggggaccccgtaccccgggcggggtaacccctccgggtacctaaacgtttaacgtttaacgttttagtttaccggttaggtacggttaacggttttacggttttttacggaccggttaaagggtcgttttaacggggtttcggggggtaacgggttacgtttaccgggtacccgggtttaccgggtttacgggggttaacccggaaacgggggttacgttaacccgggttaaccggtaaccggtccgttaaccccgggtttccgttaccccccggtcttaaccccggtcccccgtaaaccccggg

SEQ ID NO: 83969 - DNA, 840 bp, Homo sapiens
  misc_feature: GYAE6OF01BPR4L.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacgacgggtcctgggccccagtctggccctagacactacgcccttcgcccttcccgtgttcctaggacgtcctccgtagggacctaggtccgtatccaacctacttccgtcctcgaccgtaccgttacggaaaccacgcgtacggtggttacggtttgggtctacttttaattaatttacgtcgttccttccgttacggttacccaacgacgtacctagttaccgacggccgaccggtacccgtaacccccggttaaaacttttacctttaaagttttacggttacggttaaccggttttccgtttcccgggttcccgtaccccgtttacgggtttaacgggtttccttacggtccgttccttacccgtccggtcctaccgtaacgtcgtaccggacctaaccggtacccgttcccctaccgtaccgtaaccttacgttacccttaccgttaacggtacccgttaccggaccgggttacggtaaccggggaacgggtaaccggtaccggtacggttaacctacgttttaacggttacttccggaacgtcgtaacttccgttaattaacgttaactaggtaacgttacgtaagtcgttaactcgtacgtccggtcgttcgggttaccggacgggtacgggttacaacccgggttcgttaacccggtacccggttagaccccggtacgtcccggacgttccccgg

SEQ ID NO: 83970 - DNA, 791 bp, Homo sapiens
  misc_feature: GYAE6OF01BLRIB.36.23.C01.1.454.CMB.1.raw
tcagtacgctgtctcacgaccggtgctcgatttagtacacgtgattagggagttgggggggggtctcaggaggcagcgctctcaggacatctccaccatggcctgggctctgctgctcctcaccctcctcactcgagggcacgagggtcctgggcccagtcgtggcctgacacacgcctgccctccgtgtctgacgtactccgtggactagtcgatccacctatcctcctgccactacggaccagctagtcggtacgttgtcgtacttaattaattacgtgttccgttccgttacggttacccaactagtccgtacttcgacgggtctaccggacccgtaccccgtaaactttacgtttaattttacgtcggtacggtttccggtttaccgtcccggtccccgttaaggttacggggttttacctacggttccgttccgtttcccgtccggtacctttccggaacgttccgtacggacctaacccgtccggtcccttacccgttacgaacccttactccttaccgtaccgtaccgtccggtacgtaccggtacggtaaccgggaccggtacggttaccgtacggttaactttaacgtttacgttacgaccgtacgtaccttaactaacgtttataaccgttaacgaagttaaccgtaacgttacgttctaccgttacgttccgggttggttaccggggtcgggtaccggggttaaaccggtaacggttaccggttaacggtacccggttccggtacgggtaccccgaacggtacccgacgggttcccccgg

SEQ ID NO: 83971 - DNA, 899 bp, Homo sapiens
  misc_feature: GYAE6OF01BOK4R.36.23.C01.1.454.CMB.1.raw
tcagtacgctgtctcacgaccggtgctcgatttagtacacgtgattagggattgggggggggtctcaggaggcagcgctctcaggacatctccaccatggcctgggctctgctgctcctcaccctcctcactcgagggcacgagggtcctcgggcccagtctggcctgacacagcctgccctcgtgtactgagtacctccctaggacaggttccgactcaaccctatccctccgtgaccacgtacgggaaccctaggccgaggtcggtaccggtttgggtacggtactttaattaaagtttactacggttccttacccgttcggggtttacccaaacgtaaggtcctaacgtttacaacggggacctacggaccccggaaccccgtaaaacttacgttttaaatttacgtgggttacggtttccttttccgggtccggttccccgttcgttacggggttttacctacggtaccgttccgttcccgtaccggtcccttaccggtaacgtccggttacggaacccgtaaaccggtaccccgggtcccctttacccccggttaccgaaacccgttccgtttaccccgttaccgttaaccggaaccccgttaccccggtaacgggggtaccgtaacggggttaacggggggaaaccccggtacggggtaccggttacggtaaaccctttttaaacggtttacgttacggtcccgtacgtaaccgttactaaagtttaacttaacgtaacggtaacgttacttaacgggtcggttaacctccgtacggtttcgggaccgtttaccggggtccggggtacgggaacggggttaaccgttacgggttaaccccgaccggttacccggttaggacccgtacggtaacccccgggtaaggtcccccgg

SEQ ID NO: 83972 - DNA, 912 bp, Homo sapiens
  misc_feature: GYAE6OF01CAZB8.36.23.C01.1.454.CMB.1.raw
  modified_base (227)..(227): a, c, t, g, unknown or other
  misc_feature (227)..(227): n is a, c, g, or t
tcagtacgctgtctcacgaccggtgctcgatttagtacacgtgattagggagttggggggggtctcaggaggcagcgctctcaggacatctccaccatggcctgggctctgctgctcctcaccctcctcactcgagggcacgacgggtcctcgggccctagtctcggcctgacacacgcctgcctcgtgtcgtgacgacctccgtggacaggtccaactccaaccgnttcctccgtgaccgaacgtacgggaaacctgactaaggtcggtacggttggtacgtactttaattaattagttcgttaccgttcccgttacggttaccaaaacgtgtacctaagttcgacgggactaccgacccgaacccctaaatttccgtttaaagttctacggtacgtttcccgttcggtacccggtcccggttaacggttcgggttttaccacggtttccgtaccgttttcccgggaacccggttcctaacccggtaacgttcccggtacggggtaaacccaaacccggtacccgggttcccccttaacccggtactaaaccccggtcttttaccggaacccgttacggtaccccgtaaccggaccccggggtcttaaggggtaaacccggggaggtaacccgggttagttaaccttaaaccggtttaagttttacccgtcgggaactaaccgttcttaacccgtaaatttacccgttaaagtacggttaaacgttacctaaacggggtttctaaaccctacgggttaaccggttcgggtacccggttttaaggggggtccccggggaaaacgggtaccccggggttaaacgtttaaccggggtttccccgggtaaaccccttacggggtaccggtaaacccgttaacccggaccccgggggtaaacctttccccccgggg

SEQ ID NO: 83973 - DNA, 805 bp, Homo sapiens
  misc_feature: GYAE6OF01BCR3H.36.23.C01.1.454.CMB.1.raw
  modified_base (171)..(171): a, c, t, g, unknown or other
  misc_feature (171)..(171): n is a, c, g, or t
  modified_base (308)..(308): a, c, t, g, unknown or other
  misc_feature (308)..(308): n is a, c, g, or t
  modified_base (315)..(315): a, c, t, g, unknown or other
  misc_feature (315)..(315): n is a, c, g, or t
  modified_base (321)..(321): a, c, t, g, unknown or other
  misc_feature (321)..(321): n is a, c, g, or t
  modified_base (352)..(352): a, c, t, g, unknown or other
  misc_feature (352)..(352): n is a, c, g, or t
tcagtacgctgtctcacgaccggtgctcgatttagtacacgtgattagggagttggggggggtctcaggaggcagcgctctcaggacatctccaccatggcctgggctctgctgctcctcaccctcctcactcgaggcacgagggtcctgggcccagtctggcctgacacngcctcgccttcgtgtctgacgtaccttccgtggacctagccgatccacctattccgtaccgtgaccgacgtacggaccagtcgtaggtgtacgttggtcttattaataatttatcgttccttcgtcgtaccacagtntacgtcncggacnccgaccgaaccctaatttacttaatttacgngttacggtttccttccgggtacccgtccgtttacgggttacggtttaccgttacgtccggttcccttacccgggttcccggacctttaccgtaacggtttccgacccgggtacccgtaacccggaccccggttccccttaacccgtcgttaaccctcttaccgttaaccgttaccgtacctaccggtacggtacgtacgggtaacggtaccggtacggtacgttacgttaacgtttacgtttacgtacgtaccgtacgttcgtaacttaacgttaacgttacggttaacgttaacgtaggttaacgtttacgttaacgtaccgttaacggtcggttaccgttacggggtaccgggtaacggggtacccggtaaaccggttaaccgggttacccgtacccggtttaccgtacccgggttaccgaacccgggtcccggtaaaccgggtcccccgg

SEQ ID NO: 83974 - DNA, 750 bp, Homo sapiens
  misc_feature: GYAE6OF01BX0D7.36.23.C01.1.454.CMB.1.raw
  modified_base (210)..(210): a, c, t, g, unknown or other
  misc_feature (210)..(210): n is a, c, g, or t
  modified_base (222)..(222): a, c, t, g, unknown or other
  misc_feature (222)..(222): n is a, c, g, or t
  modified_base (249)..(249): a, c, t, g, unknown or other
  misc_feature (249)..(249): n is a, c, g, or t
  modified_base (608)..(608): a, c, t, g, unknown or other
  misc_feature (608)..(608): n is a, c, g, or t
  modified_base (666)..(666): a, c, t, g, unknown or other
  misc_feature (666)..(666): n is a, c, g, or t
tcagtacgctgtctcacgaccggtgctcgatttagtacacgtgattagggagttgggggggggtctcaggaggcagcgctctcaggacatctccaccatgcctgggctctgctgcctcctcaccctcctcactcgaggcacgacgggtcctcgggcctacgtcgtcggcctgaacacacgcctcgcctccgtgtctgacgtctctggacngtcatccacctnttcctcctcgcctacgtaccggaaccncgtctaggtcggttacgttggtacttacttaattaatttgttccgttccgttccctttacggttaacccaaacgtacgtaccttaaggtacgacggaccgaccggtccccgtaaaccccgtttaatttacgttttaaatttcgttaacggttcggttttcccgtttcccggtccggtaccccgttgggttaacggtttccgtaccgtttccgtccctttcggaccccgttccgtacggtaacgttcgaccggtactaacccgtcccggtacccctccctacgtaaccctttactcccgaacgtacggaccctgtaacggcttaagggacggacggtctacgtacgttactaggtttacncgtacgtactacttataatacgtacgtagtaaacttacgtagtaccgttacctacggnttacgggtcgtaccggtcgggaagggtacgttaccgttaagtccgtaccgtacgtacgacccggacctcggtacccgtccccgg

SEQ ID NO: 83975 - DNA, 820 bp, Homo sapiens
  misc_feature: GYAE6OF01CMX3Z.36.23.C01.1.454.CMB.1.raw
tcagtacgctgtctcacgaccggtgctcgattagtacacgtgattagggagttgggggggggtctcaggaggcagcgctctcaggacatcctccaccatggccgtgggctctgctcgcctcctccaccctcctcactcgacggcacgcggggtccgtcgggccctaggtcctcggcctgaaccacacgtcctcgtcccgtccgtgtcctagacgtacctccgtggaccgtacggtcgataccaacctactcctccgtcgcctaccgtacggaaccagaccgtaggtcgtacggtgttcgtacttaagttaattctcggttccttaccgttcggtacctacgatccgtataccgacggtccacccggtacccgtaaaccccgttaattactttaaagtttcgtacggttaccgtttcccgttccggtcccggtaccggtttcgggttacggtttcctcgttacccggttcctccggtacctccgtacgtaacgtccgacggtaaccctaccggttacccccgtcctacccgtaacgtcccttacttcccgtaccgtaccgtacccgtaccggtacggtccggtaaagggtccgggaccgtaacgtcgtaacccggttaatttcgttactcggtacctaaccgtcgttaacttaacgttacgttaaaccggtagttaaccttacgttaagttaccggtaacgttacccgttggtaccgttaccggggttccggtaacgggggtaacggtaacccggttaactcgggggttacccctaaccggtcccggtaaacgcccgaacgggtccccgtacggtcccccg

SEQ ID NO: 83976 - DNA, 977 bp, Homo sapiens
  misc_feature: GYAE6OF01BWRS6.36.23.C01.1.454.CMB.1.raw
tcagtacgctgtctcacgaccggtgctcgatttagtacacgtgattagggagttggggggggtctcgaggaggcagcgctctcaggacatctccaccagtcggccgtgggctcgtgcttgcctcctcctaccctcctcactcgaggcacgtagggtccgtcgggccctgtctcggacctgaccacgcgtcctcgccctccgtgtctgacgtctccgtaggactcggtcgtactaccaacctctccgtcctcgacgtaaccgtacggaccagcgtaggtcggtacggttggtattacgttaatttacgtttacgtcgttccgttcgttacggttaccaaacgtacgttccgtattaccgacggaccgtaccggtacccgtaacccccgttaaaatttacgttttaaacgttttaccggtaggtttaccgggttttcccgtttccggggttccccggttacccgtttagggtccgggttttaaccgtccggtaccgtttcctacccggttccgtaacccgtacggttacggtcgtaccgaccggtaccgtacccgggtcccttaacctacggtaaccctacttaccggtacccttaacggtccggttaacccggtaccgggtacgttaaccgggggaacccggttaaacggggtaaccgtacggttaaaccgtttacgtttaaacggtttaccggtacgtaacgtttaccgggttacttaaaccgtttacctaacggttttaaccgggtacggtttaaaccgttaaacggttaaacccggttactttaaacccgggtaggttttaacccgggccggtttaccgggggtttacccgggttaaacgggggtaaccccgggggaacccgtttaaaccggggttaaacccgggttttacccgtaccccggggttaaaaccggggtttcccggtaaccccggtaaacccggggtacccggttacccccgggtttacccccccgg

SEQ ID NO: 83977 - DNA, 633 bp, Homo sapiens
  misc_feature: GYAE6OF01BSU6K.36.23.C01.1.454.CMB.1.raw
  modified_base (175)..(175): a, c, t, g, unknown or other
  misc_feature (175)..(175): n is a, c, g, or t
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (233)..(233): a, c, t, g, unknown or other
  misc_feature (233)..(233): n is a, c, g, or t
  modified_base (247)..(247): a, c, t, g, unknown or other
  misc_feature (247)..(247): n is a, c, g, or t
  modified_base (255)..(255): a, c, t, g, unknown or other
  misc_feature (255)..(255): n is a, c, g, or t
  modified_base (266)..(268): a, c, t, g, unknown or other
  misc_feature (266)..(268): n is a, c, g, or t
  modified_base (273)..(273): a, c, t, g, unknown or other
  misc_feature (273)..(273): n is a, c, g, or t
  modified_base (290)..(290): a, c, t, g, unknown or other
  misc_feature (290)..(290): n is a, c, g, or t
  modified_base (297)..(297): a, c, t, g, unknown or other
  misc_feature (297)..(297): n is a, c, g, or t
  modified_base (327)..(327): a, c, t, g, unknown or other
  misc_feature (327)..(327): n is a, c, g, or t
tcagtacgctgtctcacgaccggtgctcgatttagtacacgtgattagggattggggggggtctcaggaggcagcgctctcaggacatctccacgactggcctgggctctgactgctcctcaccctcctcactcgagggcacgagggtcctgggcccagtcgtcggcctgacacngcctgcctccgtgtctgacgctcctggacngtcgatcacntctcctgcagtggaaccngcagtgacgttgtncttatatngtctctgtcannnatcgngcacgccgacccaattnttaattngtagtcttcgcgcctgtcggttctacgtcncttcgtccgctaccgtagtctaggaccaacgtccggtccctcctcgaacctcgttacctacgtaacgtaccttccgaggtcgtacggaagggacgtggaccttagtaactttagttacgttcgactagtctataacgtacgttacgtaagtaacgttactaaggttacgtacctaccgtcgttacgggtaccgttcggggtaccggtaaccgggggtaaccggttaaccgtaacgggttaccccggttaacccgttaccgggttaaacggtcccgaaccggtaaccccgggtcgttaccccccggg

SEQ ID NO: 83978 - DNA, 727 bp, Homo sapiens
  misc_feature: GYAE6OF01BEQS7.36.23.C01.1.454.CMB.1.raw
  modified_base (260)..(260): a, c, t, g, unknown or other
  misc_feature (260)..(260): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacgagggtcctgggcccagtctggcctgacacagcctgccctccgtgtctgagacctccgtggacagtcgatccaccatcctcctagccacgtcggaaccagctaggtcgtacggtttgggtntacgtttaattaatttatcgttccttccgttcggtttacccaaacgtagacctacgttccgaacgggccaacggccccgtaaacccccggtaaaactttaccttttaaagttttacgtacgggttaacgggtttcccgttttaccgggttacccggtccccgtttacggttacgggggttttccttaacgggttccgttcccgtttcccggtcccggtaccgttaccgtaaacggttccgtcggaacctaaacccggtcccggtccccttacccgtacgaaccctagttcctaccgtacgacccttccgaggtacgtaggaacgggacgacggtacttacgtaccttattacgtcgacctgtacctactattactacgtaagtacgtataagtcgtactccgtagtcggtcgttcggtcgggacggacggtacgtaggtcgaccgtgtacggacacgacgtgtcccg

SEQ ID NO: 83979 - DNA, 990 bp, Homo sapiens
  misc_feature: GYAE6OF01E1F3H.36.23.C01.1.454.CMB.1.raw
tcagtacgctgtctcacgaccggtgctcgatttagtacacgtgattagggattggggggggggtctcaggaggcagcgctctcaggacatctcccaccatggcctaggctctgctgctccctccacccctcctcactcgacgggcacggtacgggttccgtcgggccccagttccgtcggccgtgaccacacgcctcgcccgttccgttgtctagacgtcctccgtggacaggtctactccaacctacttccctccgtcgactacgtacggaaccacgtcgtaaggttcggtacggtttggttacttactttaaattaagtttacgttccggttcccttccggtttacggtaacccaaacgtacgtacttaccgtttaccggaggtaaccgtaccggtaccccgtaaacccccggtttaaaacttttaaccgtttttaaaagttttacggtacgggttttaaccggtttttcccgggttttttcccggtaccccgggtttccccggtttacggggttttaaccggggggttttacccgtttaacgggttccccggtttcccgttttcccgggttaccccggtttacccgtttaacccggttaaaggttccccggtaacggtaaccccgtaaacccggtaccccggttccccctttaaccccggttaacccgtaacctttacccgtttacccctttaacccggtaccccgtaacccggttaccgggtaacgggttcgtaacgggggtaaaccgggtaaccgggtaccgggtaccttaaccgggttaactttttaaccgtttacgtacggtacccgtaaccgtacttaacttaacttaaccggttaacgttagtaccgttaagtaacggttaccggtacttaccggtggtttacgtacggggttcgggttacggggaaccgggttaaccggtacggttaaccgttcccggtacggtacccgtacgtacgaaccgtaccggacccggtccccg

SEQ ID NO: 83980 - DNA, 1073 bp, Homo sapiens
  misc_feature: GYAE6OF01ENXSZ.36.23.C01.1.454.CMB.1.raw
tcagtacgctgtctcacgaccggtgctcgatttagtacacgtgattagggattgggggggggtctcaggaggcagcgctcgtcaggacatctccaccagtggcctgggctctgctgctcctcaccctcctcactcgagggcacgaggggttcctcgggcccagttcgtcggcctgaacacacgtcctcgcccttccggtagttcgtaggacggtaccgttcccgtagggacctacggtaccgaattaccctaacctacgtttccgttcccggttcggacccgtaaccgttaacgggaaaccctagggtaccggttaaaggggttcgggttaaccgggttttcggggttacggttaaccgtttttaaagttttaaaacgtttttaacgtttccggttttaccccgtttacccggttttaaccggggtttaacccctaaaacgttaacggtaccgttaacggttttacccggaacgggtaccggtaaccgggtacccccggttaaacccccggttaaaacgttttaaccgttttaaaagtttttacggttagggtttaaccgggttttacccgttttacccgggttaccccggttaccccggtttaccggtttaccgggggttttaccgttaaccgggttcccggttccgtttacccgggttacccgggtaccttaaccccggttaaacggttccggttaaccgggtaaacccgtaaaccggtaccccgggttaccccgtttacccgttaacgggttaccttaccggttaacgtttacccgttaaccggtaaccggttaccccggttacccgggtaacggggtacggtaacgggggaaccggggtaacggtacgggttaaccgttacggtttaaccgtttacgttacggtttacggaccgttacgtaccgttaacttaacgtttaacgttaacgttaggttaaaccgttacgttaacggttaccgtacgttaccgtacggttaccggtacgggtttacggttacggggaacggtaccgggtaacgttacgggttaccgtaccggttacgtacggtcgaaccggtcccgtaaccgg

SEQ ID NO: 83981 - DNA, 744 bp, Homo sapiens
  misc_feature: GYAE6OF01A0JTQ.36.23.C01.1.454.CMB.1.raw
tcagtacgctgtctcacgaccggtgctcgatttagtacacgtgattagggagttggggggggtctcaggaggcagcgctctcaggacatctccaccatggcctgggctctgctgcctcctcaccctcctcgactcgagggcacgagggttcctcgggccctagtcgtcggcctgacacgagcctcgtccctccgtgttccgtagagtcccttccgtgggaacctaggtccgataccgacctattcctcgtcgaccgtacgtcggaaccagcgtaagtcggtacgttgtgtactttaagttaattacgttgtccgttcccgttcggtaccaacggtagtctagttcggaacggtcaccgtaccccggtaacctaaacgtttactttaagttcgtgtaccgtttcctttcgccgtccgttagttacggttcgacgtcgtcttaccgcggtctaccaagtcgtacggaccacgtaccgtccctaccgtacgaccgtcgtaccttctaacgtacctaccggtacggtcgtacgggtaccgaccgtacggtcttacggtaattcgtttaaccttcgttacctctaacgtcgtaaccgtagaccgggttcgttaccggttcgttccgttccggggaccggtacccgaaccggttccgtaaccggtccgtacccggttaagccggtaacccgacccggttaccgcccgttaccccgacccgttaccggtcctcccgttcgggttacccccc

SEQ ID NO: 83982 - DNA, 817 bp, Homo sapiens
  misc_feature: GYAE6OF01AYWU7.36.23.C01.1.454.CMB.1.raw
  modified_base (165)..(165): a, c, t, g, unknown or other
  misc_feature (165)..(165): n is a, c, g, or t
  modified_base (210)..(210): a, c, t, g, unknown or other
  misc_feature (210)..(210): n is a, c, g, or t
tcagtacgctgtctcacgaccggtgctcgattagtacacgtgattagggagttggggggggtctcaggaggcagcgctctcaggacatcctccaccgatggcctgggctctgctgctcctcacctcctcactcgacgggcacgagggtccctgggcccagtccgnggcctgacacacgtcctgccctcgtgtcgtagagtaccgttccgnggaacagtcgactccaacctacttccgtccgtgaccctaacgtacgggaaacccaggtaccgtaacgggttaggtaccggttttagggtcggttaaccttttaaaagtttaagtttaaccgttccggttaccgtttaccgtttacggttaaaccaaacgacggtaccttaaacgttcccgaaggtccgaaccggtaccccggtaaacccccttaaagtttacttttaagttaccgtggtaacggtttccgtttaccggtcccggtcccgtttagggttacgggtttactacgtcccgttacttacgggtccccgtaactaccgtacgttccgacgaaccgtacccgtacccgttcctccgaacgtacctcgtacgtacgtacgtaccgtaccgtacggtacggtaggacggtaccgaggttaccgaagttacttaagttcgacgtacaacttacgtactagtacgttacgtaggtaacttacgtaacggtagtaccgttacgaccgtaggtacccgttagggtacccggagggttaaccggccgttaaccggttagtaacccccggtaggtaacccttaccggtaaacccgtcgtaaccggtccccg

SEQ ID NO: 83983 - DNA, 938 bp, Homo sapiens
  misc_feature: GYAE6OF01A5H1P.36.23.C01.1.454.CMB.1.raw
tcagtacgctgtctcacgaccggtgctcgatttagtacacgtgattagggagttgggggggggtctcaggaggcagcgctctcaggacatctccaccatggcctgggctctgctgctcctcaccctcctcactcgagggcacgtcgggtccgtcgggcccagtcgtcggcctgaacacacgcctcgcccgtccgtgtccgtagacgtaccttccgtaggactagttccgataccaaccctattccctcctgacctaacgtacggaaacctggaccgtaggttaccggtacgggtttcggttcgttaactttaaatttaagtttacgttacgtttacccgttccgttaaccggtttaaccaaaccgtaacgtacgttaacttaccggaacggtaccgaacccggaaccccgtaaaccccccgtttaaaacttttaaccgtttttaaaacgttttaggttaccgggtttaaccggttttccccgttttaccgggttacccccggttaccccgtttacgggtttaaccggggttttactacggtttacccgtttcccggtttacccggtaccccggtacctttaaccccggttaacggtttccgtaccggggtaacccctaaaccgttacccccggggtaccctttacccccgggttaacgtacccttaccgttaccgtttaaccggtaaccgttacccgtaaccggtacgggtaccggtaagggaaaccgggacggtaacggtcccgtttagtaacgtttaaacttcgtaacgtcgtacgtacgttacctaaacgttacgttaacggaacgttaacgttacgttaacggttaccgttactaccgttaccggttggtaccggttacggtcgggaaccgggtacgtaaccgtacgtccggtaaccctccgggtagaaccgtccgccggtaaccgtcccccgg

SEQ ID NO: 83984 - DNA, 1026 bp, Homo sapiens
  misc_feature: GYAE6OF01BE2N3.36.23.C01.1.454.CMB.1.raw
tcagtacgctgtctcacgaccggtgctcgatttagtacacgtgattagggattgggggggggtctcaggaggcagcgctctcaggacatctccaccatggcctgggctctgctgctcctcaccctcctcactcgagggcacgagggtcctcgggcccagtctggcctgacacagcctgcctccgtgtctgacgtactccgtggacagtcgactcgaaccattcctcctcgacctacgtacggaacccagcctaggtacgtacggttggtagtactttaagttaattattcggttaccttcccgttaggtttaacccaaactacggtcctaaggttccgacggtaccggaaccggtacccccggttaaccccccgttaaaatttaccgtttttaaaatttttaccggtaacggggtttaccgggttttaccccgttttaccgggtcccccgggttacccccgtttaccgggttttaagggggttttacccttaaccgggtttcccgttacccggtttccccgttaccccgggtacctttaccccggtaaacggtttccggacccggttaccctaaaacccgggtccccgggttcccccctttaccccgttagaacccttaccgttacccgttaccgtaacccggttaccccgtacccgaacggttccgtacggggaaaccgggtaacggaccgggttacttaaccgggtaactttaacggtttaatttcggaacccggttacgtaccgtttaactaacggtttaaccctaacggttaacgggttaaaccgtttaacgtaacgggttttaaccgtaccgtttaccccggtaaccggttttaccggggttaacccgggtttcccggggggttaaccgggttaaaccccggggggtaaacggttaaaccccgggttttaaccgggggttaaaccccggtttaacccccgggtttaacccgggggttaacccgggtaaacccccggtaaccccggggtaccccggggttaaaccccgggtttccccccggg

SEQ ID NO: 83985 - DNA, 593 bp, Homo sapiens
  misc_feature: GYAE6OF01AOOBO.36.23.C01.1.454.CMB.1.raw
  modified_base (275)..(275): a, c, t, g, unknown or other
  misc_feature (275)..(275): n is a, c, g, or t
tcagtacgctgtctcacgaccggtgctcgattagtacacgtgattagggattgggggggggtctcaggaggcaccgctctcaggacatctccaccatggcctgggctctgctgctcctcaccctcctcactcagggcacagggtcctgggcccagtctggcctgacacagcctgcctccgtgtctgagacctcctggaccagtcgatcaccatctcctgcactggaaccagcagtgacgttggtgcttaataattatcgtctccgtgttaccaanagcattcaggcacgccgaccccgaaacttcttaatttatgtagttctttcgcgccctgtacggtttctacgtcgtcttcgtccgctcgaagtctgactacgacggtccctcctcgacctactcttctaacgacctccgaggtctaggacgggacgacggtacgtacgtacttaattagttagcagtcctaactaattaacttaacgtgtaaagttctaaagtcgtactaccgtagtcgtaccgttgggttaccgggacggacgggtacctaggtaccggtaccctacgttacggaccaggacccggagccgtccccgg

SEQ ID NO: 83986 - DNA, 851 bp, Homo sapiens
  misc_feature: GYAE6OF01AY03V.36.23.C01.1.454.CMB.1.raw
tcagtacgctgtctcacgaccggtgctcgatttagtacacgtgattagggattgggggggaaatactttctgagactcatggacctcctgcacaagaacatgaaacacctgtggttcttcctcctcctggtggcagctcccagatgggtcctgtctcaggtgcagctgcagcaggtccgggcctaggagtggtgacgccttcggacgaccctgtccctcacctgcgctgtcgtctgggactccctcccgtcggacggacgtatggtaacgtgggtgggtaacgggttccgggtcccggcccgtacccggtacccccgggaagggggaacgggggccgttagggtaggttacgggtaagtttaggggtaagtaaaaacggttaaacggtacggaaccggggtacccggggggaacccaaaccgtaaacccttaacggtaacgtccggtccggttaccccgtacgggtaccgggggttaccgtaccggtacctaaccgtacttaccgtcgtacggacacggtaaacctaacgtaaccgaaaccgtaaccctaccgtttaccctacccgtacgaacgggttcctaccggttacccgttccgtacgggtacccggtaccccggtacccggtacccgggtacccggttaccgggaccccttagtttacttaaacgtttccgttaggtcggtacgttaacgggtttagttttcggacgggtaggttacgttcggggttaccggggtacggttacttccgggtaaccgggttgggttaggggtaaccgggttagggtaccggttaccggtcgtaacggtccgttccgtaccttccgacgtcccggaccttaccccggg

SEQ ID NO: 83987 - DNA, 870 bp, Homo sapiens
  misc_feature: GYAE6OF01ATEP0.36.23.C01.1.454.CMB.1.raw
  modified_base (129)..(129): a, c, t, g, unknown or other
  misc_feature (129)..(129): n is a, c, g, or t
  modified_base (263)..(263): a, c, t, g, unknown or other
  misc_feature (263)..(263): n is a, c, g, or t
tcagtacgctgtctcacgaccggtgctcgatttagtacacgtgattagggattggggggggtctcaggaggctagcgctctcaggacatctaccaccatggcctggctctgctgctcctcaccctcctnactcagggcacgagggtcctgggcccagtctgggcctgtaacacagccctcgccctccgtgttccgtgaacgccttccgtaggacctagtccgactccaacctagttccttcccgagacctactcgggaacccnggtccaaggttgtacggtttggtacgtctttaagttaactttcgttcgtaccgttccgttcggtttaacccaaacgtacgtactacgtttacgacggtacctaccggacccgttaacccccgttaaaacgtttccttttttaaaagttttacggttacgggttaaccgggtttttcccgtttttacccgggtaccccgggttcccgttttaccggggttaaccggggtttttccttaacgggtttccccttccgttttacccggtaccccgggttacctttaaccggtaaaccgggttccggtacgggaaacccgtaaacccgtccgggttacccccttacccggtacgtacccgtactaccgttaccgtaccgtaccgtaccgtacggtcgtacggacggtacggtacgtcgtacgttacgttattacgtacggtacgtacgtacgtacgtacgttacgtacgtacgtaacgtaacgtacgttactacggggggggggtacctaccgttacggtacgttcggttacgggtacgggtaaccgggttacgttaacggttacggtaccggttaccggtaccgtaccgtaccgtaccgaaccggtacccg

SEQ ID NO: 83988 - DNA, 855 bp, Homo sapiens
  misc_feature: GYAE6OF01B0NUC.36.23.C01.1.454.CMB.1.raw
  modified_base (181)..(181): a, c, t, g, unknown or other
  misc_feature (181)..(181): n is a, c, g, or t
  modified_base (200)..(200): a, c, t, g, unknown or other
  misc_feature (200)..(200): n is a, c, g, or t
  modified_base (259)..(259): a, c, t, g, unknown or other
  misc_feature (259)..(259): n is a, c, g, or t
tcagtacgctgtctcacgaccggtgctcgatttagtacacgtgattagggagttgggggggggtctcaggaggcagcgctctcaggacatcctccaccatggcctggctctgctgctcctccaccctcctcactcgagggcacgagggtcccgtgggccctagttcgtcggccctgacacncgcctcgtccctcgtgtcngacgtactcgtgactggtacgactccacctacttcctccgtgacctaactacggaaccngcgtaggtcggttacggttggtcgttacgtttaattaatttacgttcggttccttcggttaccgttaccgaacgtactcctacgttaccgacggccgtaaccggtaccccggtaaccccgttaaacctttactttaacgttttaggttaccggttaccggttttaccgtttcccggttacccgggttaccccgttacgggttttaccgggtttacgttaccggttccgtttcccgtttcccggtacccggttacccgttacccggttaacgttccggtaccgtaaccggaaccccgtcccggtcccctacccgtacgtaacccttacttacctaccgttacccgtaccgttacccggtaggtaccggttaacgggacggtaaccgggtaccggtacgtttaacgtaacgtttacgtttacgtacgtaccggtactacgtaccttagttacgttacgtagtaaccgttaaggtacgttacttacgtccgttacgtcgggtaccgttccgggtacgggaccgggttaacggtaaccggttacggttaccgtaccgttacggtacggtacccgtaccggtaaccggtcccgtaccccgg

SEQ ID NO: 83989 - DNA, 800 bp, Homo sapiens
  misc_feature: GYAE6OF01DM4QS.36.23.C01.1.454.CMB.1.raw
tcagtacgctgtctcacgaccggtgctcgatttagtacacgtgattagggagttggggggggtctcaggaggcagcgctctcaggacatctccacatgcctggctctgctgctcctcaccctcctcactcgagggcacgagggtcctgggccctagtctggcctgacacagtccctgcctccgtgtactgacgtacctccgtggacctagtccgaatccacctactcctcctgacctacgtacggaaaccaggtcctaaggtggttaacggttggttacgttacttttaaattaaacgtttcgtccggttccgtttaccctacggggttaccaacgtagtcctaagttccgacggaccgtacgacccgtaacccgaaatttctttaacgtttaggcgttaacgttccgtttccgtccgacccgttggttaacgggtttcctacggttcgtaccgtttcgtcccggtacttacccgtaacggtcgtaccggaaccgtaacccgacccggtaccctcctaacggacctacgtacctaccgtaaccgtccgtaccgtacggtcgtaacggaacggtacgggtacgtaccgttagtaaccgtttaagttccgttagacccgtaacgttactaaccgttaagtaactttaacgtagttaacgtactaagttccgtaacgttacccgtagggtacgtacggttacgggttacccggggtaacgggtaaccggttaaccggttacggttaccgtaaccggttacccggtaaggttacccccggaacggtcccggtaaacggtccccg

SEQ ID NO: 83990 - DNA, 683 bp, Homo sapiens
  misc_feature: GYAE6OF01A6NCJ.36.23.C01.1.454.CMB.1.raw
  modified_base (211)..(211): a, c, t, g, unknown or other
  misc_feature (211)..(211): n is a, c, g, or t
  modified_base (231)..(231): a, c, t, g, unknown or other
  misc_feature (231)..(231): n is a, c, g, or t
  modified_base (247)..(247): a, c, t, g, unknown or other
  misc_feature (247)..(247): n is a, c, g, or t
  modified_base (258)..(258): a, c, t, g, unknown or other
  misc_feature (258)..(258): n is a, c, g, or t
  modified_base (274)..(274): a, c, t, g, unknown or other
  misc_feature (274)..(274): n is a, c, g, or t
tcagtacgctgtctcacgaccggtgctcgatttagtacacgtgattagggattggggggggtctcaggaggcagcgctctcaggacatctccaaccatggcctggctctgctgctcctcaccctcctcactcagggcacagggtcctgggcccagtctcggcctgacacagcctgcctccgtgtctgagtctccgtggacagtcatcaccntcctctgcacgtacgaaccngccagtgtacgttgtntcttataattntgtctctcgtacaacngctatcgacgcacgcccgtacccctaattctttaaagtttatcgttagtttccgtttacggtccgtacccgttggttacgggtttctacggttccgtccgtttcgtcccggtcttaccggtaacgttccgtacggaaccctaccgtaccccggtccccttcccgtaacacccgttacttccgtaaccgtaccgaccgttcccgtaacggtccgttagggaacggtaccgtacggtcgttacgtaaacgttttagtttagtcggacttacgtcctaacgttaattacgtacttagtaaactcgtaagttacgtcctaccgtcgtaggtccttgggacccgggaggtacggtaacccgttagtacccggtaccgtaacgttacggacccaaccggacccgtcggtaccccg

SEQ ID NO: 83991 - DNA, 784 bp, Homo sapiens
  misc_feature: GYAE6OF01EG88Z.36.23.C01.1.454.CMB.1.raw
  modified_base (116)..(116): a, c, t, g, unknown or other
  misc_feature (116)..(116): n is a, c, g, or t
  modified_base (557)..(557): a, c, t, g, unknown or other
  misc_feature (557)..(557): n is a, c, g, or t
tcagtacgctgtctcacgaccggtgctcgatttagtacacgtgattagggagttgggggggggtctcaggaggcaccgctctcaggacatctccaccatcggcctgggctctgctncctcctccaccctcctcactcgacgggcacgacggtcctcgggccctagtcgtcggcctagaccaacacgtcctcgccttccggtgtaccgtagtacgtaccgttccgtacggactacgttacgactaccaacctcttccgttaccgtacgccgtaacgtacggaacccgagtcgtaacggtacggttacggttagggtactaatttaagttaattacgttccgtccgttaccgtttacgtaccaaagtactactacttcggaacggtacaccggaccccgtaacccgttaaatttaccgttttatttagtaccggtttcggttccgtttcggcccggtccggtttacggttagggttttccacggtttccgtacttccggtaccggtcctactacggtccgtaccgacgtaaacccgcccggttcctaccggactaaccnccttacgttcgaaccgtaccgcgtacgggtaaccggtcggaacggacgggttccggacttaggttacttacgttaccgttgaacctgtacctaacttaagtaacgtacgtaacgttacgtacttagggactaacgtcggtactcggtacgggttggtacccgggcggtaacggtagtcggttaacgtccccggaggttaccacgtaccgacgtacgtcccgtcccgg

SEQ ID NO: 83992 - DNA, 908 bp, Homo sapiens
  misc_feature: GYAE6OF01A2Y4H.36.23.C01.1.454.CMB.1.raw
  modified_base (591)..(591): a, c, t, g, unknown or other
  misc_feature (591)..(591): n is a, c, g, or t
  modified_base (837)..(837): a, c, t, g, unknown or other
  misc_feature (837)..(837): n is a, c, g, or t
tcagtacgctgtctcacgaccggtgctcgatttagtacacgtgattagggagttggggggggaaatactttctgagactcatggacctcctgcacaagaacatgaaacacctgtggttccttcctcctcctggtggcagctcccagatcgggtcctgtcctcgaggtgccagctgacagtcgacggtccgggaccgtagggtagtggtaggtaacggccgttacggacgtacccgttcgtcccctcaccgtggtccgtcttaggtctacgtcggacccgtcccgtcccgtacggggaccgtaagtacttaggaaggttcgggtacggtacggggttcggtcccgaccggacccggtaccccggaagggggacggggttaccttagggttaggttgggtagtttacgggtaaagttaaaacgtaagtaccggggaacggggacccggggtaaccaaaccgtaaactaaccgtaacggttccggtcccgttaccgacgggtacggggttaccgacgttaccgaaacccgtagttactcggtaaggaccgaagaaccgtaacgtaacccgtaaacgtaaccctaccgtttcccncgggttacggtaccgttccgtaaccgtccggtttaccggtacggttaacccggcccggtacccgggtacccgtaccggtccggtaacgttaaacgtttaccgtttaagtttcgtaggttcggtaagttaacggttttacggtttaccgaacgggttaacggtttcggttacgggggttacggggtacgttaccggtccgggtttaaccgggtcggggttaaacggggtacggttaaccgggttacnccccgggttaaagggttccctacggtttacccgccctttaccggaaccttcccggtaaccccggtaaccgg

SEQ ID NO: 83993 - DNA, 749 bp, Homo sapiens
  misc_feature: GYAE6OF01CTG4K.36.23.C01.1.454.CMB.1.raw
  modified_base (274)..(274): a, c, t, g, unknown or other
  misc_feature (274)..(274): n is a, c, g, or t
  modified_base (330)..(330): a, c, t, g, unknown or other
  misc_feature (330)..(330): n is a, c, g, or t
  modified_base (386)..(386): a, c, t, g, unknown or other
  misc_feature (386)..(386): n is a, c, g, or t
tcagtacgctgtctcacgaccggtgctcgatttagtacacgtgattagggattgggggggaaatactttctgagactcatggacctcctgcaacaagaacatgaaacacctgtggtcttcctcctcctggtgcagctccagatggtcctgtctcgaggtcacacgctagcagcgagttacgggcccagggagtggtgaacgaccgttcggacgtaccctgtcccctcacctcggacgtctgtcgttcctggggactcccgtcccgtacggcganacgtagactggtaggacgttcggggtcccgccgacggaccccgaggggtaaccggngtcggagtggtaagttcggtagaaataagtacgacggaccgggacacgaaccgtanaacgtcgccgtacccgtgacgggtcgtactacgtaccacgtacgtcgtcgactaacgaacgaacgtaacctaaaggtaaaccctacttctaccccgtcggtaccggtaccgtactacccttcgtacggtaccgacccggtacccggcccgaacgttccggaccgttaacgttacttaagtttacgttaggtcgtaaccggtaggttacgttttacggacgtacgggttagttccgggttacggggtacgttacggtccggtaacggtttacgggtggggttaccgaaacgggttcctacccgggtaacgggttaccctacgttccgttaacccttccgtaacccaggtccccttaacccccgg

SEQ ID NO: 83994 - DNA, 136 bp, Homo sapiens; identical to SEQ ID NO: 83554
  misc_feature: GYAE6OF02IQCRQ.36.23.C01.1.454.CMB.1.raw
  modified_base (136)..(136): a, c, t, g, unknown or other
  misc_feature (136)..(136): n is a, c, g, or t

SEQ ID NO: 83995 - DNA, 500 bp, Homo sapiens
  misc_feature: GYAE6OF02G0DRX.36.23.C01.1.454.CMB.1.raw
  modified_base (425)..(425): a, c, t, g, unknown or other
  misc_feature (425)..(425): n is a, c, g, or t
tcagtacgctgtctcacgaccggtgctcgatttagtacacgtgattagggattggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaatttatgaggtctttcgtcggccctcaggggtttctagtcgcttctccggctccaagtctggcaacacggcctccctgaccatctctagactccaggctgaggacgaggctgactattattgcagctnatatactgaagtcaatggtatccatggctgttcggcggagggcctaagttgaccgtctaggtcagcccaaggtcc

SEQ ID NO: 83996 - DNA, 513 bp, Homo sapiens
  misc_feature: GYAE6OF02GJSQW.36.23.C01.1.454.CMB.1.raw
tcagtacgctgtctcacgaccggtgctcgatttagtacacgtgatttagggattggggggtcgtcgaggaggcagcgctcgtcagggaccatctccaccatggcctgggctctgcctgctcctccaccctcctcactcagggcacagggtcctgggcccagtctggcctgacacgagcctgcctccgtagtctgagactcctggacagtcgatcaccatctcctgcactggaaccagcagtgacgttggtgcttataattatgtctcctggttccaacagcattcaggcagcgccccgaaactcttaatttaggaggtctttcgtcggccctcaggggtttctagtcgcttctcggctccaagtctggcaacacggcctcctgaccatctctagctccaggctgaggacgaggctgactattattgcagctcatatactgaagtcaattggtatcactggctgttcggcggagggaccaagttcgaccgttctaggtcaggcccaggctccgg

SEQ ID NO: 83997 - DNA, 493 bp, Homo sapiens
  misc_feature: GYAE6OF02F5VRD.36.23.C01.1.454.CMB.1.raw
  modified_base (323)..(323): a, c, t, g, unknown or other
  misc_feature (323)..(323): n is a, c, g, or t
tcagtacgctgtctcacgaccggtgctcgatttagtacacgtgattagggattgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactctaatttatgaggtctttcgtcggccctnaggggtttctagtcgcttctccggctcaagtctggcaacacggcctccctgaccatctctagactcagctgagacgagctgactattatgcagctcatatactgaagtcaatggtatccatgctggttcggcggaggaccaagttgaccgtctaggtcagcccaaggtcc

SEQ ID NO: 83998 - DNA, 494 bp, Homo sapiens
  misc_feature: GYAE6OF02FY7XJ.36.23.C01.1.454.CMB.1.raw
  modified_base (227)..(227): a, c, t, g, unknown or other
  misc_feature (227)..(227): n is a, c, g, or t
tcagtacgctgtctcacgaccggtgctcgatttagtacacgtgattagggattgggggggtctcaggaggcagcgctctcaggacatctccaccatggcctgtgctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggcagcgccccgaaactcttaatttatgaggtctttcgtcggccctcaggggtttctagtcgcttctccggctccaagtctggcaacacggcctcctgaccatctctagactccaggctgagacgaggctgactattattgcagctcatatactgaagtcaatgtatccatggctgtcggcggaggacaagttcgaccgtcgtaggtcagccaacgg

SEQ ID NO: 83999 - DNA, 650 bp, Homo sapiens
  misc_feature: GYAE6OF02GIKN0.36.23.C01.1.454.CMB.1.raw
  modified_base (298)..(298): a, c, t, g, unknown or other
  misc_feature (298)..(298): n is a, c, g, or t
tcagtacgctgtctcacgaccggtgctcgatttagtacacgtgattagggattgggggggggtctccaggaggctaccgctctcaggacatctccaccatggcctgggctctgctgcttccgtctacccgtcctcactccaggggtccacagggtcctgggtacccagtctggcctgacacagcctgcctccggtgttcgtgagacttccgtggggaccaggtcgatccaccatccgtcctgcacctggaaccagcagtgacgttggtgcttataattatgtctcctggttccaacgngcatttcagggtcagccgaccccgtaaaactcctttaaatttagtgtaggttccttttacgtccgggtcccttcgtaggggttttcctaggtcgacgttccgtccggtctccaagtctcggaccaacgacggccctacccgtgaaccctaatcctactacgtacctaccgaggctggacggacgaggccgtaggacctagttactgcagtctcattatactgtaagtctaagtttgtactccgtacgttggtcttcgggttaccgggcgggtaacgggtacccgtaaggtttcggaaccccgtttccggtaagggttcccgtaacggtccccgtaacgggtccttaccccgg

SEQ ID NO: 84000 - DNA, 521 bp, Homo sapiens
  misc_feature: GYAE6OF02IOEQ6.36.23.C01.1.454.CMB.1.raw
tcagtacgctgtctcacgaccggtgctcgatttagtacacgtgattagggattgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaatttatgtaggttctttcgtcggccctcgtaggggtttctagtcgctttctccggctccaagtctggcaacacggccctccctgaccatctctagactcaggctgagacgaggcttaattatttctgcagttcatataacaaccagacaacactctgctagttccggacggaggaccgaagtctacgaaccgtcctaagtcacgcccaaggctcgcccctcgg

SEQ ID NO: 84001 - DNA, 501 bp, Homo sapiens
  misc_feature: GYAE6OF02FT687.36.23.C01.1.454.CMB.1.raw
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
tcagtacgctgtctcacgaccggtgctcgatttagtacacgtgattagggattgggggggtctcaggaggcagcgctctcaggacatctccaccatggcctgggctctgctgctcctcaccctcctcactcagggcacagggtcctgggcccagtctggcctgacacggcctgcctccgtgtctgagactcctggacagtcgatcaccatctcctgcactggaaccngcagtgacgttggngcttataattatgtctcctggtttccaacagcattcaggcagcgccccgaaactcttaatttatgaggtctttcgtcggccctcaggggtttctagtcgcttctccggctccaagtctggcaacacggcctcctgaccatctctagactccaggctgaggacgaggctgactattattgcagctcatatactgaagtcaatggtatcactgctgtcggcggaggaccaagttgaccgtctaggtcagcccaggctaccgg

SEQ ID NO: 84002 - DNA, 506 bp, Homo sapiens
  misc_feature: GYAE6OF02GRASG.36.23.C01.1.454.CMB.1.raw
  modified_base (424)..(424): a, c, t, g, unknown or other
  misc_feature (424)..(424): n is a, c, g, or t
tcagtacgctgtctcacgaccggtgctcgattagtacacgtgattagggattgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaatttatgaggtctttcgtcggccctcagggtttctagtcgcttctccggctccaagtctggcaacacggcctccctgaccatctctagactccaggctgaggacgaggctgactattattgcagctnatatactgaagtcaatggtaatccactggctggttcggcggtagggaccaagttcgaccgtctaggtcagcccgaggtcccg

SEQ ID NO: 84003 - DNA, 532 bp, Homo sapiens
  misc_feature: GYAE6OF02IPWPH.36.23.C01.1.454.CMB.1.raw
tcagtacgctgtctcacgaccggtgctcgatttagtacacgtgattagggattgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaatttatgagttctttcgtcggccctgtagggttctagtcgcttctccggctcaagtctggcaacgacggcctcctgaccatcctcagacctcaggctgaggacgaggtctgactattatgacagctctattactactagaagttctaaagtggtaatcctagtcggcttggttcgggcggacgggtaacctaaggttcggaccgttccgtaggtccgacgacccgaaggtcccg

SEQ ID NO: 84004 - DNA, 500 bp, Homo sapiens
  misc_feature: GYAE6OF02HBGXC.36.23.C01.1.454.CMB.1.raw
  modified_base (402)..(402): a, c, t, g, unknown or other
  misc_feature (402)..(402): n is a, c, g, or t
tcagtacgctgtctcacgaccggtgctcgatttagtacacgtgattagggattgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaatcttaatttatgaggtctttcgtcggcctcgagggtttctagtcgctttctccggctccaagtctgcaacacggcctccctgaccatctctagactccagctgaggacgnggctgactattatgcagctcatatactgaagtcaaagtgtaatccagtgctggtcggcggagggaccagttgaccgtcgtaggtcacgcccaaggtcc

SEQ ID NO: 84005 - DNA, 510 bp, Homo sapiens
  misc_feature: GYAE6OF02ITVLM.36.23.C01.1.454.CMB.1.raw
  modified_base (241)..(241): a, c, t, g, unknown or other
  misc_feature (241)..(241): n is a, c, g, or t
  modified_base (464)..(464): a, c, t, g, unknown or other
  misc_feature (464)..(464): n is a, c, g, or t
tcagtacgctgtctcacgaccggtgctcgattagtacacgtgattagggattggggggggtctcaggaggcaccgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggngcttataattatgtctcctggttccaacagcattcaggcagcgcccgaaactcttaatttatgagtctttcgtcgccctcgaggggtttctagtcgcttctccggctccagtctggcaacacgcctccctgaccatctctagactccaggctgaggacgaggctgacttattagttgctagctcattatactgaagtcaattggtatccatggctgttcgggnggaggaccaaggttcgaccgtcgtacggtcagcccgaggctcccgg

SEQ ID NO: 84006 - DNA, 624 bp, Homo sapiens
  misc_feature: GYAE6OF02H94NT.36.23.C01.1.454.CMB.1.raw
tcagtacgctgtctcacgaccggtgctcgatttagtacacgtgattagggagtttggggggggtcctacaggacggcaggcgctcctcaggacatctcccaccatggcctgggctctgctgctccttcaccctcctcactcagggcaacagggtcctcgggcccagtctggcctagacacagcctgcctccgtgtctgagactcctgggacaggtcgatcaccatcctcctgcactcggaacctgcagtgacgttggtgtcgttataattatgtccttccgtggttaccaactgctattcagggcaggccgaccccgtaaactcttaatttatgtaggttctttcgtcggccctgtagggtttctagtcgcttctccggctccaagtctggaccaacgccggccctccctagaccctatccttactacgactaccgaggtctaggaggacgaggctggaccttattacttgtactacgtctacgtaattagtacgtagtaagttacgtaagtcggttaacttaccgtacgttacggtctttcgggttccgggaccgggtagggtaacccgtaaggttccggtacccgttaccggtacggtaccgaccgtaccccgaaggtcccg

SEQ ID NO: 84007 - DNA, 812 bp, Homo sapiens
  misc_feature: GYAE6OF02HXVHN.36.23.C01.1.454.CMB.1.raw
tcagtacgctgtctcacgaccggtgctcgatttagtacacgtgataggattgggggggtcgtcacggaggccaggcgtcctacgtcaggtaccattcgtccaccatggcctgggctactgctggcctcctccacctccgtctacggtcagggcactaggggtttccctgggtccctaggtcctaggaccgtgaccactcgccttgcctccgtgtctggaggacgttccgggtggactaggtccgacgggtcacctaagtccttcctcgctacgtcggaaccacgtccgaagtcgacggttggttcgacctttaagtaacttttagtcgtttcctccgttcgggggtttaccccaaccgaggccttaacgtttcgggaaggggcctagggacccggtccccggtaaaacttcgtttaaactttaagtggtacggttccttttcggtcgggtaccccttggtaaggggttttcgtacgtccggtccttttccgtccgggcgttaccctaagttcggttcgggacgtaacctacgggtccctaccgtcgaacctctacgtacgtaacgtacctacccgaagtacctcggtaaggaccgtaggtcctacgtaaccgttagttacgttacgacctaggacgtaccgaacgtaccgtaaccgtacggtaaaccgtttaacctaaagtttacggttaacttcccgtacgtccgggtacgttacgggttaccggttaccgggaacgggtacccgttaaaggttccggtacccggttccgggttaacgggtcccgtacggtaccccgtaacgggtccccgg

SEQ ID NO: 84008 - DNA, 489 bp, Homo sapiens
  misc_feature: GYAE6OF02IB5G5.36.23.C01.1.454.CMB.1.raw
  modified_base (227)..(227): a, c, t, g, unknown or other
  misc_feature (227)..(227): n is a, c, g, or t
  modified_base (269)..(269): a, c, t, g, unknown or other
  misc_feature (269)..(269): n is a, c, g, or t
  modified_base (416)..(416): a, c, t, g, unknown or other
  misc_feature (416)..(416): n is a, c, g, or t
tcagtacgctgtctcacgaccggtgctcgatttagtacacgtgattagggattgggggggtctcaggaggcagcgctctcaggacatctccaccatggcctgggctctgctgctcctcaccctcctcattcagggcacagggtcctgggcccagtctggcctgacacagcctgcctccgtgtctgagactcctggacagtcgatcaccatctcctgcactggaaccngcagtgacgttggtgcttataattatgtctcctggttccaangcattcaggcagcgccccgaaactcttaattatgagtctttcgtcggccctcgagggttctagtcgcttctccggctccaagtctggcacacggcctccctgaccatctctagactccaggctgagacgaggctgactattatgacngctcatatactgaatcaatggtaactcatgctgtcggcgaggaccagtcgaccgtctaggtcagcccgagtcc

SEQ ID NO: 84009 - DNA, 494 bp, Homo sapiens
  misc_feature: GYAE6OF02IZDMR.36.23.C01.1.454.CMB.1.raw
tcagtacgctgtctcacgaccggtgctcgattagtacacgtgattagggattgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaatttatgagtctttcgtcggcctcagggtttctagtcgcttctccggctcaagtctggcacacggcctcctgaccatctctagactccagctgaggacgaggctgactattattgcagctcatatactgaagttcaatggtatccactggcttgtcggcggaggaccaagttgaccgtctaggtcacgccaaggtcc

SEQ ID NO: 84010 - DNA, 887 bp, Homo sapiens
  misc_feature: GYAE6OF02HEHS2.36.23.C01.1.454.CMB.1.raw
tcagtacgctgtctcacgaccggtgctcgatttagtacacgtgattagggattgggggggtactcaggaggcagcgctctcaggacatctccaccatggcctgggctctgctgctcctcaccctcctcactcagggcacagggtcctgggcccagtctggcctgacacagcctgcctccgtgtctgagaccctcgacgactcgacgtactaccactcttcctcgtcgacctacggtaaccgaacgacgtacgtaggtacggttacggttggtcttaactttaaagtttaattagttccgttcccgttccggtttccggtaacccaaaggtacgtacttacgttacggacggtacgaccggtacccccggtaaaaccccgttaacttttaaccgtttttaaagtttacggtaacgggtttaccggtttttcccggtttacccgggtcccccggttaccccgttaacgggggtttttacgggttttaccgttaaccggttcccgtttacccgttttccccgggtacccgtaccctttaaccggttaccgttccggtaccgaaccaaacccgggtcccgttacccccttaccgaaccgtaaccttccttacccgttacgaaccgtacccctacgggtcgtacggaaggggaaccggaccgggtcgtcgttaacttaactttaagtttcgtccacggtccttactaacttaagttaactaggtaacgttaacgtaacgttagggttacgttaacccaccggttacggtccggtttacggtttacccgggggttaccggggaaccgggtaacccggtaaaccggtttagggttacccccggtaccccgtttagggtaccgacccgacccggtaacccggtccgttcccccgg

SEQ ID NO: 84011 - DNA, 568 bp, Homo sapiens
  misc_feature: GYAE6OF02GJCF8.36.23.C01.1.454.CMB.1.raw
  modified_base (246)..(246): a, c, t, g, unknown or other
  misc_feature (246)..(246): n is a, c, g, or t
tcagtacgctgtctcacgaccggtgctcgatttagtacacgtgattagggagttggggggtctcaggaggcaggcgactctcaggacatctccaccatgggcctgggctacctgctgctcctcacctcctcactcagggcacagggtcctgggcccagtctgccctgactcagcctgcgtccgtgtctgggtctcctggacagtcgagtcaccatctcctgcactggaaccagcagtgactttggngtaacaatcatgtctcctaggtaaccaacgacgtacccaggccaaagcccccaaactcatcattttggacgtcggtagtcggcctcaggtaatttctaatccgcttctctggctcaagtctgccaacgacgcctccctgaccatctctcggctccacgcctgacggtacgaggctagtattattactgttcctcactattacaagtccggtagttacgttcggtcgttttccggcgggtccggtacccgaccgtcgggaccgtccgtacggtcacggtcccgaagggcctcggccccgtcggtccaccgtcctcgttccccg

SEQ ID NO: 84012 - DNA, 512 bp, Homo sapiens
  misc_feature: GYAE6OF02HIZOL.36.23.C01.1.454.CMB.1.raw
  modified_base (228)..(228): a, c, t, g, unknown or other
  misc_feature (228)..(228): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggcagcgccccgaaactcttaatttatgagtctttcgtcggccctcagggtttctagtcgcttctccggctccaagtctggcaacacggcctccctgaccatctctagactccaggctgaggacgaggctgactattattgcagctcattatactgaagtcaatggtaatccatgcttggttcggcggagggacctaagttcgaccgttcctaggtccacgcccgaaggtcccg

SEQ ID NO: 84013 - DNA, 494 bp, Homo sapiens
  misc_feature: GYAE6OF02FQ3JW.36.23.C01.1.454.CMB.1.raw
  modified_base (320)..(320): a, c, t, g, unknown or other
  misc_feature (320)..(320): n is a, c, g, or t
  modified_base (358)..(358): a, c, t, g, unknown or other
  misc_feature (358)..(358): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgcccgaaactctaatttatgagtctttcgtcgcctnagggtttcagtcgcttctccggctccaagtctgcaacncggcctccctgaccatctctagactccagctgaggacaggctgactattattgctagctcatatactgaatcaatgtatccatggctggttcggcggagggaccaagttcgaccgtctaggtccaggcccaggtcc

SEQ ID NO: 84014 - DNA, 686 bp, Homo sapiens
  misc_feature: GYAE6OF02IXORU.36.23.C01.1.454.CMB.1.raw
  modified_base (228)..(228): a, c, t, g, unknown or other
  misc_feature (228)..(228): n is a, c, g, or t
  modified_base (243)..(243): a, c, t, g, unknown or other
  misc_feature (243)..(243): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtntcttaatattatgtctccgtgttaccaacagctatcgagcacgaccgtaccccgtaaacttactttaatttagtggtacggtttcctttccggtccggtccccgttacggttacgggttttactacgttccgtcctttccgtccggtcctaccgtaacgttcgtacggacctaaccgaccggtcccttacccgtacgaccctacttccctacgtaaccgtacctcccgacgggtccgtacgggaacgggtacggacggtaccttacggtaacctttaatttacgtcgaccacgtctacgtaattacgtacgtagtaacgttactaagttacggttaacctaccgtacgttcgggtacgttcgggttcgggacgggtaacggtaacccgttaaggttccggtaccgttaccgttacggtaccgaaccggtacccggaggtcccg

SEQ ID NO: 84015 - DNA, 618 bp, Homo sapiens
  misc_feature: GYAE6OF02F9PWO.36.23.C01.1.454.CMB.1.raw
  modified_base (240)..(240): a, c, t, g, unknown or other
  misc_feature (240)..(240): n is a, c, g, or t
tcagtacgctgtctcacgaccggtgctcgattagtacacgtgattagggattgggggggtctcaggaggcaccgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggngcttataattatgtctcctggttccaacagcattcaggcagccgcccgtaaatcttaatttatgaggtctttcgtcgcctcgtagggtttctagtcgtcttctccggctccaagtctggacaacaccggcctccctgacctatcctactacgacctccaggtctaggacggtacggaggtctaggtaaccttatttagttcgaccagtccttacaacttaacttacgtagtaaagttcctaaagttcggtaacttcccgtacgttgggtccgttacggttaccggggcgggtaacgggtaacccttaagggtttaccgtaaccccggttccgttacgggtacccgaaccggtcccccgtaaggtcccttacccccggg

SEQ ID NO: 84016 - DNA, 501 bp, Homo sapiens
  misc_feature: GYAE6OF02F5NXH.36.23.C01.1.454.CMB.1.raw
tcagtacgctgtctcacgaccggtgctcgattagtacacgtgattagggattgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaatttatgaggtctttcgtcggccctcaggggtttctagtcgcttctccggctccaagtctggcaacacggcctccctgaccatctctagactccaggctgaggacgagctgactattattgcagctcatatactgaagtcaatggtatccactgctggttcggcggagggacctagttgaccgtctaggtcagcccgaaggtcc

SEQ ID NO: 84017 - DNA, 560 bp, Homo sapiens
  misc_feature: GYAE6OF02J2MTV.36.23.C01.1.454.CMB.1.raw
  modified_base (269)..(269): a, c, t, g, unknown or other
  misc_feature (269)..(269): n is a, c, g, or t
  modified_base (346)..(346): a, c, t, g, unknown or other
  misc_feature (346)..(346): n is a, c, g, or t
  modified_base (367)..(367): a, c, t, g, unknown or other
  misc_feature (367)..(367): n is a, c, g, or t
  modified_base (426)..(426): a, c, t, g, unknown or other
  misc_feature (426)..(426): n is a, c, g, or t
tcagtacgctgtctcacgaccggtgctcgattagtacacgtgattagggattgggggggtcgtcgaggaggcaccgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctctggttccaanagcattcaggcagcgccccgaaatcttaatttactgagttctttcgtcggcccttgaggggtttctagtcgctttcnccggctccaagtctggcaacncggcctccctgaccatctctagacctccgaggctgacggacgaggctgactagttattncagtcctacagttatactagaagtactaagtggtaactccacgttggtcctggtttccggacggggtaggtaaccgtaaggtttcgacccgttaccgttacgggactaacggtccccgaaggtcgttaccccgg

SEQ ID NO: 84018 - DNA, 557 bp, Homo sapiens
  misc_feature: GYAE6OF02IPXIX.36.23.C01.1.454.CMB.1.raw
  modified_base (303)..(303): a, c, t, g, unknown or other
  misc_feature (303)..(303): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctctggttccacagcattcaggcagcgccccgaaactcttaatttangagttctttcgtcgcctcgtagggttctagtcgcttctccggctcagtctgcaacacggcctcctgaccatctcgtgggctccgaggctgaggacgaggtacttaattatttcgtgctagttcattaactaccaaccgtagaccaactacctctagtcttagttccgggacgggtaacgggaaccgaaggtccctaggtaacccgtaccttaaaggtccacggacccaagggccctacccggtccccctccggg

SEQ ID NO: 84019 - DNA, 558 bp, Homo sapiens
  misc_feature: GYAE6OF02GTRVZ.36.23.C01.1.454.CMB.1.raw
  modified_base (306)..(306): a, c, t, g, unknown or other
  misc_feature (306)..(306): n is a, c, g, or t
  modified_base (437)..(437): a, c, t, g, unknown or other
  misc_feature (437)..(437): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgaccccgaaactcttaatttangtagtctttcgtcggtccctgtagggttctagtcgcttcgtcgctcaagtctgacaacgcggcctcccgtgaccatcctctagacctccgaggctggaggacgaggctagacttattagttgactagctanacttatactagaacgttcaaagttggtaactccgacgttggccttgggttcgggacgggtacggtaaccgtaaggttcgaacccggttcgtaacggtccaacggtacccgtaaggtccccg

SEQ ID NO: 84020 - DNA, 513 bp, Homo sapiens
  misc_feature: GYAE6OF02IK5ID.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaattatgaggtctttcgtcggccctcgtagggttctagtcgcttctccgctcaagtctggcaacacggccctccctgaccatctctagacctccaggctgacggcgaggctgactattattgcagctcatatactgaagtcaagtgtaactccagtgcttggttcggcggagggacctagttcgaccgtccgtaggtcgacggcccaaggtcccg

SEQ ID NO: 84021 - DNA, 504 bp, Homo sapiens
  misc_feature: GYAE6OF02F8QLK.36.23.C01.1.454.CMB.1.raw
  modified_base (227)..(227): a, c, t, g, unknown or other
  misc_feature (227)..(227): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggcagcgccccgaaactcttaatttatgaggtctttcgtcggccctcaggggtttctagtcgcttctccggctccaagtctggcaacacggcctccctgaccatcctctagactccaggctgaggacgaggctgacttattattgcagctcatatactgaagtcaatggtatccatggctggttcggcggagggacctagttgaccgtctaggtcagcccaggtccg

SEQ ID NO: 84022 - DNA, 537 bp, Homo sapiens
  misc_feature: GYAE6OF02IA6JI.36.23.C01.1.454.CMB.1.raw
  modified_base (364)..(364): a, c, t, g, unknown or other
  misc_feature (364)..(364): n is a, c, g, or t
tcagtacgctgtctcacgaccggtgctcgatttagtacacgtgattagggattggggggaagaggaagactgacggtcctgtctcaggtgcagctgcagcagtcgggcccaggagtggtgaagccttcggagaccctgtccctcacctgcgctgtgtctggagcctccctcggcggagatgaatggtggagttgggtccgccagcccccagggaaggggctgagttggattggtgaaataaatgagaccgggggcaccaactacaatgcgtccctcaggggtcgagtcaccatatctgcagacaagtccaagaaccacttctccctgaggctgacctctgtgaccgccgcggactcggccatanattattgtgcgagagtttttgctaggatcttggggcggtatcgacgtctggggtcaagggatcacggtcatcgtctcctcagcctcaccaaggcccatccggtcttccccctggccgccctgcctccaggacgcacctccgagacgcacacgccggcccgtgggcctgtcccg

SEQ ID NO: 84023 - DNA, 539 bp, Homo sapiens
  misc_feature: GYAE6OF02G6HQX.36.23.C01.1.454.CMB.1.raw
  modified_base (227)..(227): a, c, t, g, unknown or other
  misc_feature (227)..(227): n is a, c, g, or t
  modified_base (324)..(324): a, c, t, g, unknown or other
  misc_feature (324)..(324): n is a, c, g, or t
  modified_base (364)..(364): a, c, t, g, unknown or other
  misc_feature (364)..(364): n is a, c, g, or t
tcagtacgctgtctcacgaccggtgctcgattagtacacgtgattagggattggggggggtctcaggaggcaccgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggcagccgcccgaaactcttaatttatgaggtctttcgtcggccctnaggggttctagtcgcttctccggctccaagtctggcaacncggcctccctgaccatctctagactccaggctgacggacgaggctgacttattagttgctagctcataatactgaagtcaatggtactaccacgtggcttggttcggacggtaagggtacctaaggttcgtaccggtaccgtacggtcgaacggcccgtaaggccgttaccccgg

SEQ ID NO: 84024 - DNA, 496 bp, Homo sapiens
  misc_feature: GYAE6OF02GUG1U.36.23.C01.1.454.CMB.1.raw
tcagtacgctgtctcacgaccggtgctcgatttagtacacgtgattagggattgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaatttatgagtctttcgtcggccctcagggtttctagtcgctttctccggctcaagtctggcaacacggcctccctgaccatctctagactccaggctgaggacgaggctgactattattgcagctcatatactgaatcaatgtatccatgctggtcggcgagggaccaagttgaccgtctaggtcagcccaaggtccg

SEQ ID NO: 84025 - DNA, 504 bp, Homo sapiens
  misc_feature: GYAE6OF02I8MD9.36.23.C01.1.454.CMB.1.raw
  modified_base (421)..(421): a, c, t, g, unknown or other
  misc_feature (421)..(421): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaatttatgagtctttcgtcggcctcagggtttctagtcgctttctccggctccaagtctggcaacacggcctccctgaccatcctctagactccagctgaggacgaggctgactattattgcngctcatatactgaagtcaatgtatcactgtctagttcggacggaggaccgaagttgaccgttctaggtcacgtcccaggtccg

SEQ ID NO: 84026 - DNA, 501 bp, Homo sapiens
  misc_feature: GYAE6OF02HHRB5.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaatttatgagtctttcgtcgccctctagggttctagtcgcttctccggctcaagtctgcaacacggcctccctgaccatctctagactccaggctgaggacgaggctgactattatgcagctcattatactgaagtcaatggtatccatgcttggttcggcggaggaccaagttgaccgtcgtaggtcacgacccgaggtccg

SEQ ID NO: 84027 - DNA, 540 bp, Homo sapiens
  misc_feature: GYAE6OF02HZXMQ.36.23.C01.1.454.CMB.1.raw
  modified_base (271)..(271): a, c, t, g, unknown or other
  misc_feature (271)..(271): n is a, c, g, or t
  modified_base (351)..(351): a, c, t, g, unknown or other
  misc_feature (351)..(351): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacngcaattcaggcagcgaccccgaactcttaatttatgaggtctttcgtcggcctcaggggtttctagtcgctttctccggntccaagtctgcaacacgcctccctgaccatctctagactccaggctaggaggacgaggctgacttaattattgcagctcaattatactgaagtcaaatggtaactcctacgtggacttcggttcggaccgggagggaaccgtaagttaccggaccgttaccgtaggtaccgacggtacccaaggtcccg

SEQ ID NO: 84028 - DNA, 499 bp, Homo sapiens
  misc_feature: GYAE6OF02ISUDY.36.23.C01.1.454.CMB.1.raw
  modified_base (228)..(228): a, c, t, g, unknown or other
  misc_feature (228)..(228): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctgttccaacagcattcaggcagcgccccgaaactcttaattatgagtctttcgtcgcctcgagggttctagtcgcttctccggctcagtctgcacacggcctcctgaccatctctagctcaggctgaggacgagctgactattattgcagctcatatactgaagtcaatggtactccatgtctcggtcggacggagggacctaggttcgaccgttccgtaggtcacgcccgaggtcccg

SEQ ID NO: 84029 - DNA, 537 bp, Homo sapiens
  misc_feature: GYAE6OF02I0DK1.36.23.C01.1.454.CMB.1.raw
  modified_base (242)..(242): a, c, t, g, unknown or other
  misc_feature (242)..(242): n is a, c, g, or t
  modified_base (360)..(360): a, c, t, g, unknown or other
  misc_feature (360)..(360): n is a, c, g, or t
tcagtacgctgtctcacgaccggtgctcgattagtacacgtgattagggattggggggggtctcaggaggcaccgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagccagtgacgttggngcttataattatgtctcctggttccaacagcattcaggcagcgccccgaaactcttaattatgagttcttcgtcgcctgtagggttctagtcgtcttctccggctccaagtctgcacncgcctcctcgaccatctctacgactccagctagacggacgtaggcgtagtactattacgttgctagtctcgattatacgtagaacgtcaagttggtactccagttcggcttggtcggcggtaacggacctaaggttcgtaccgtcgttaacggtccgacggaccgtaaggctcccgg

SEQ ID NO: 84030 - DNA, 534 bp, Homo sapiens
  misc_feature: GYAE6OF02JAKH6.36.23.C01.1.454.CMB.1.raw
  modified_base (377)..(377): a, c, t, g, unknown or other
  misc_feature (377)..(377): n is a, c, g, or t
  modified_base (424)..(424): a, c, t, g, unknown or other
  misc_feature (424)..(424): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgaccccgaactcttaattatgagtctttcgtcggcctcgtagggtttctagtcgcttctccggctcagtctggcacacggcctccctgacctntctctagctccaggctgaggacgaggctgacttattattgcagctanatatcgtagaagttcaattcggtatccacgttcgtcttcgggttcgggccgggtaagggtacccgtaagtttcggacccgttaccgttaggtccacggcccgaggtcccg

SEQ ID NO: 84031 - DNA, 792 bp, Homo sapiens
  misc_feature: GYAE6OF02I1GVL.36.23.C01.1.454.CMB.1.raw
  modified_base (235)..(235): a, c, t, g, unknown or other
  misc_feature (235)..(235): n is a, c, g, or t
tcagtacgctgtctcacgaccggtgctcgatttagtacacgtgattagggagttggggggggtctcaggaggcagcgctctcaggacatctccaccatggcctgggctacctgctgctcctcacctcctcactcaggcacgagggtcctgggcccagtctgcccttgactcagcctgcgtccgtgtctgggtctcctggactagtcgaagtcaccatcctcctgcactggaaccngcagtgtactttggagtaacaatcatcgtctacctaggtaaccaacacgtaccaggtaccaaacgccccaaactcattactagttttacggacgttacggtacgttccggaccctacgacggtaactttcgtaaactccgtacgttactcgttcggtccttacccgtaacggttcgttacggtacccgtaaaaccggtacccggtccccgtacccttaccggtaaccctacgttacccgtcccggttacgggtccccttacccgtaaacgggtccccgtttaggggaaaccggggtaacccggtaagggttacccgtttaacggttaaacgttttaaaccgttaccgtttaccggtttacccgttacgtaaccgtttaacgttttaaccgaaaccgggttacccgggtaaaggtttaacccgtttcgggttaccgttttaccgggaccgggtaccgtaacccgtaccggtacggtacccgttaccggtcgggtacaccgtacccgaaggtccgtacccgtccccggtacgtacctaccgttcctaccggttcccccg

SEQ ID NO: 84032 - DNA, 502 bp, Homo sapiens
  misc_feature: GYAE6OF02ICVFA.36.23.C01.1.454.CMB.1.raw
  modified_base (304)..(304): a, c, t, g, unknown or other
  misc_feature (304)..(304): n is a, c, g, or t
  modified_base (418)..(418): a, c, t, g, unknown or other
  misc_feature (418)..(418): n is a, c, g, or t
  modified_base (427)..(427): a, c, t, g, unknown or other
  misc_feature (427)..(427): n is a, c, g, or t
tcagtacgctgtctcacgaccggtgctcgatttagtacacgtgattagggattgggggggtcgtcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaatcttaatttangagtcttcgtcgccctctagggttctagtcgcttctccggctccaagtctggcaacacggcctccctgacccatcctctagacctccaggctggaggacgaggctgacttattnttgcagctnatatactgaagtcaatggtatccatgctggttcggcggaggaccagttgaccgtctaggtccagcccgagtcccg

SEQ ID NO: 84033 - DNA, 501 bp, Homo sapiens
  misc_feature: GYAE6OF02IKPPZ.36.23.C01.1.454.CMB.1.raw
tcagtacgctgtctcacgaccggtgctcgatttagtacacgtgattagggattgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaatttatgaggttctttcgtcggccctcgagggtttctagtcgctttctccggctccaagtctgcaacacggcctccctgaccatctctagactccaggctgaggacgaggctgactattattgcagctacatatactgaagtcaatggtatccatgctggtcggcggagggacaagttgaccgtctaggtcagcccgaggccg

SEQ ID NO: 84034 - DNA, 527 bp, Homo sapiens
  misc_feature: GYAE6OF02GO3LF.36.23.C01.1.454.CMB.1.raw
  modified_base (240)..(240): a, c, t, g, unknown or other
  misc_feature (240)..(240): n is a, c, g, or t
  modified_base (436)..(436): a, c, t, g, unknown or other
  misc_feature (436)..(436): n is a, c, g, or t
tcagtacgctgtctcacgaccggtgctcgattagtacacgtgattagggattgggggggtctcaggaggcaccgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggngcttataattatgtctcctggttccaacagcattcaggcagccgccccgaaactcttaatttatgaggttctttcgtccggcccttcgtaggggttttctagtcgtcttcgtccggtctccaagtctggcaacacggcctccctgaccatcctctagactccaggctgaggacgagtctgactattattgcagctnatatactagaatcaattgtactccgactggcttggtcggcggaacggtaccaaggttcgaccgtcgtaggtcacgacccgaggtcctccgg

SEQ ID NO: 84035 - DNA, 685 bp, Homo sapiens
  misc_feature: GYAE6OF02ITAUJ.36.23.C01.1.454.CMB.1.raw
  modified_base (229)..(229): a, c, t, g, unknown or other
  misc_feature (229)..(229): n is a, c, g, or t
tcagtacgctgtctcacgaccggtgctcgatttagtacacgtgattagggagttggggggggtcgtcaggaggcagcgctctcaggacatctccaccatggcctgggctctgctgctcctcacctcctcactcagggcacagggtcctgggcccagtctggcctggctcagcctgcctccgtgtctgggtctcctggacagtcgatcaccatctcctgcactggaaccngcagtgacgttggtggttataattgtctctggtaccaacagcgacccggcaatcgacccccaaaatcatgatttatgagtcactcatcggcctcgtagggttctaatcgtcttctctgctataccaagtctacggacaaccgaccggtccctacccgttcgaaccctactccttcggtcgggtacccttcccgacgggtacgttacggacgggtaaaccgggtacgggtaaccctttaaattttaacgtttacgttacgtccgttaacgtttacctaaattaactttaaacccaaacccgttaagaaccctaaacctaaccttccgtacgtaccgtttacggtttacccggggacgggtaaccgggaaacccgggtaactccggtaacggtaccccgttacggtaaaacgttcccgaacggttaccccgaaacggtccgtaccgttcccccccggg

SEQ ID NO: 84036 - DNA, 490 bp, Homo sapiens
  misc_feature: GYAE6OF02HW3M9.36.23.C01.1.454.CMB.1.raw
  modified_base (268)..(268): a, c, t, g, unknown or other
  misc_feature (268)..(268): n is a, c, g, or t
  modified_base (277)..(277): a, c, t, g, unknown or other
  misc_feature (277)..(277): n is a, c, g, or t
  modified_base (300)..(300): a, c, t, g, unknown or other
  misc_feature (300)..(300): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctctgttcaacngcattcagnagcgcccgaactcttaattatgngttctttcgtcggccctgagggtttctagtcgcttctcgctcagtctgcacacggcctcctgaccatcctactacgactccaggctggaggacgaggctcgactagttattgcagctcatatactgaatcaatgactcagtgcttggtcggcggaggccagttcgacgtcgtagtcgacgtccgagtccg

SEQ ID NO: 84037 - DNA, 488 bp, Homo sapiens
  misc_feature: GYAE6OF02HBA96.36.23.C01.1.454.CMB.1.raw
  modified_base (199)..(199): a, c, t, g, unknown or other
  misc_feature (199)..(199): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacngtcgatcaccatctcctgcactggaaccagcagtgacgttggtgcttataattatgtctctggttccaacagcattcaggcagcgcccgaaactcttaattatgagtctttcgtcgcctcagggttctagtcgcttctccggctccaagtctgcaacacggcctcctgaccatctctagactccaggctgagacgaggctgactattatgcagctctatatactagaagtcaatggtatcactgctgttcggcggtaggaccagttgaccgtcaggtcacgccagtccg

SEQ ID NO: 84038 - DNA, 539 bp, Homo sapiens
  misc_feature: GYAE6OF02G4W2G.36.23.C01.1.454.CMB.1.raw
tcagtacgctgtctcacgaccggtgctcgatttagtacacgtgattagggattgggggggaaatactttctgagactcatggacctcctgcacaagaacatgaaacacctgtggttcttcctcctcctggtggcagctcccagatgggtcctgtctcaggtgcagctgcagcagtcgggcccaggagtggtgaagccttcggagaccctgtccctcacctgcgctgtgtctggagcctccctcggcggagatgaatggtggagttgggtccgcagcccccagggaaggggctgagttggattggtgaaataaagtgagaccgggggcaccgaactacaatgccgtccctcaggggtcgagtcaccatatctgcagacaagtccaaagaaccacttctccctgagctgacctctgtgaccgccgcggacctcggcccagtactattattgtgcgtagtagtttttgcgtaggatcgttgggcggtatcgacgtcgtggggtcaagggatcgacggtcatcgtctcctcgtagcctacccg

SEQ ID NO: 84039 - DNA, 531 bp, Homo sapiens
  misc_feature: GYAE6OF02G3CCX.36.23.C01.1.454.CMB.1.raw
  modified_base (228)..(228): a, c, t, g, unknown or other
  misc_feature (228)..(228): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggcagcgcccccgaaatcttaatttatgaggtctttcgtcggccctcgaggggtttctagtcgctttctccggctccaagtctggcaacaccggccctccctgacccatcctctagacctccgaggctgaggacgaggccttgacttattattgcagtctacattatacctgaacgtcaagtgtaatccagtggcttggtcggacggaggaccgtaagttcgaccgttcgtaggtcacggtcccaaggtcccg

SEQ ID NO: 84040 - DNA, 570 bp, Homo sapiens
  misc_feature: GYAE6OF02HQVF0.36.23.C01.1.454.CMB.1.raw
  modified_base (557)..(557): a, c, t, g, unknown or other
  misc_feature (557)..(557): n is a, c, g, or t
tcagtacgctgtctcacgaccggtgctcgatttagtacacgtgattagggattgggggggaaatactttctgagactcatggacctcctgcacaagaacatgaaacacctgtggttcttcctcctcctggtggcagctcccagatgggtcctgtctcaggtgcagctgcagcagtcgggcccaggagtggtgaagccttcggagaccctgtccctcacctgcgctgtgtctggacgcctccctcggcggagatgaatggtggagttgggtccgccacgcccccgaggggaacggggctggagttggattggtgaaataaagtggaggaccgggggcaccgaactacaatgcgtccctcgaggggtcgagtcaccatatctgcagacaagtaccaagaaccacttctccctgacgctgacctctgtcgaccgccgcggactcggccatactattattgtgcgtagttagttttgacgtaggtattcggttgggtcgttagtcggacgttcggtcggggtacgaagggtatcgtacggtcagttccgtccttccgtacncgtccctacccgg

SEQ ID NO: 84041 - DNA, 489 bp, Homo sapiens
  misc_feature: GYAE6OF02INNUU.36.23.C01.1.454.CMB.1.raw
  modified_base (361)..(361): a, c, t, g, unknown or other
  misc_feature (361)..(361): n is a, c, g, or t
tcagtacgctgtctcacgaccggtgctcgatttagtacacgtgattagggattgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaatttatgagttctttcgtcggccctcagggtttctagtcgcttctccggctcagtctgcaacncggcctccctgaccatctctagactccaggctgaggacgaggctgacttattattgcagctcatatactgaatcaatgtatcatgctggtcggcggaggaccagttgaccgtctaggtcagcccagcc

SEQ ID NO: 84042 - DNA, 590 bp, Homo sapiens
  misc_feature: GYAE6OF02IRX89.36.23.C01.1.454.CMB.1.raw
  modified_base (215)..(215): a, c, t, g, unknown or other
  misc_feature (215)..(215): n is a, c, g, or t
  modified_base (227)..(227): a, c, t, g, unknown or other
  misc_feature (227)..(227): n is a, c, g, or t
  modified_base (265)..(265): a, c, t, g, unknown or other
  misc_feature (265)..(265): n is a, c, g, or t
  modified_base (344)..(344): a, c, t, g, unknown or other
  misc_feature (344)..(344): n is a, c, g, or t
  modified_base (359)..(359): a, c, t, g, unknown or other
  misc_feature (359)..(359): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcacatctccngcactggaaccngcagtgacgttggtgcttataattatgtctctgtcaangcattcagcagcgccccgaatcttaatttatgtaggttctttcgtcgtcctcgtaggggttctagtcgcttctccggtntccagtctggcaacncggcctccctgacctatcctactacgctcccgaggctaggacggacggagggtctgacttagttattgctagctactattagtactagtaagtctaaattggttaactccgtaacgttcgggtcgtttacgggtttccgggtaccggggtaacgggtaaccccggtaaggtttaccgggaaccccgtttccggttaacgggttccgaacggtacccccgtaagggtccccg

SEQ ID NO: 84043 - DNA, 529 bp, Homo sapiens
  misc_feature: GYAE6OF02IXJNZ.36.23.C01.1.454.CMB.1.raw
tcagtacgctgtctcacgaccggtgctcgatttagtacacgtgattagggattgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcacatctcctgcactggaaccagcagtgacgttggtgcttataattatgtctcctggttccaacagcattcaggcagccgccccgaaaactcttaatttatgtacggttctttcgtcggcccttcgaggggtttctagtcgtcttctccggctcagtctgcacacggcctcctgaccactctctagactccaggctgagacgaggctgacttattattgcagctcatatatagaagtctaatggtactccgtacgtggtcttggttcggacggtaagggtaccctaagttcggaccgtcgtacggtcacggtcccgaaggtcccg

SEQ ID NO: 84044 - DNA, 550 bp, Homo sapiens
  misc_feature: GYAE6OF02IY96N.36.23.C01.1.454.CMB.1.raw
tcagtacgctgtctcacgaccggtgctcgatttagtacacgtgattagggattgggggggaaatactttctgagactcatggacctcctgcacaagaacatgaaacacctgtggttcttcctcctcctggtggcagctcccagatgggtcctgtctcaggtgcagctgcagcagtcgggcccaggagtggtgaagccttcggagaccctgtccctcacctgcgctgtgtctggagccctcccgtcggcggagatgaatggtggagttgggtccgccagcccccagggaaggggctgagttggattggtgaaataaatgagaccgggggcaccaactacaatgcgtccctcgaggggtcgagtcaccatatctgcagacaagtccaagaaccacttctaccctgacggctgacctctgtcgaccgccgcgactcggccatactattattgtcgcgagtgtttttgctaggattcgttgggcgttatcggacgtcgtggggtcgaagggacttcgacggtcacgttcgtccgttcctcgacgtccctacccg

SEQ ID NO: 84045 - DNA, 497 bp, Homo sapiens
  misc_feature: GYAE6OF02HKXQD.36.23.C01.1.454.CMB.1.raw
  modified_base (363)..(363): a, c, t, g, unknown or other
  misc_feature (363)..(363): n is a, c, g, or t
tcagtacgctgtctcacgaccggtgctcgattagtacacgtgattagggattgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaatcttaatttatgtaggtctttcgtcggccctcgagggtttctagtcgcttctccggctccaagtctgcaacncggcctcctgaccatctctagactccaggctgaggacgaggctgactattatgcagctcatatactgaagtcaatggtatccatgctggttcggcggaggacctagttcgaccgtctaggtcacgcccagtccg

SEQ ID NO: 84046 - DNA, 514 bp, Homo sapiens
  misc_feature: GYAE6OF02HMXD7.36.23.C01.1.454.CMB.1.raw
  modified_base (270)..(270): a, c, t, g, unknown or other
  misc_feature (270)..(270): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaanagcattcaggcagccgccccgaaactcttaatttatgagtctttcgtcggcctcgagggtttctagtcgcttctccgctccaagtctggcaacacggcctcctgaccatctctagactccaggctgaggacgagctgactattatgcagctcgatatactgaactcaagtggtatccgatcgtcgttcggtcggcggaggacctaaggttcgaccgttccgtaggtccacgcccgaaggtcccg

SEQ ID NO: 84047 - DNA, 539 bp, Homo sapiens
  misc_feature: GYAE6OF02H7FH5.36.23.C01.1.454.CMB.1.raw
  modified_base (226)..(226): a, c, t, g, unknown or other
  misc_feature (226)..(226): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctcgtgtctgagactcctggacagtcgatcacatctcctgcactggaaccngcagtgacgttggtgcttatattatgtctctggttccaacagcattcaggcagcgccccgaaactcttaatttatgaggttctttcgtcggccctcgtaggggtttctagtcgctttctccggtctcaagtctggcaacacggccctccctgaccatctctacgacctccgaggctggacggacgaggcttgacttattattgcagctcattatactagaagttcaagttcggtactccgtacgtggtcgttggttcgggcggagggtacctaggttcgaccgttccgtagggtcacggtacccgaggtcccg

SEQ ID NO: 84048 - DNA, 512 bp, Homo sapiens
  misc_feature: GYAE6OF02G67DQ.36.23.C01.1.454.CMB.1.raw
  modified_base (227)..(227): a, c, t, g, unknown or other
  misc_feature (227)..(227): n is a, c, g, or t
  modified_base (364)..(364): a, c, t, g, unknown or other
  misc_feature (364)..(364): n is a, c, g, or t
  modified_base (373)..(373): a, c, t, g, unknown or other
  misc_feature (373)..(373): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggtctgacacagcctgcctccgtgtctgagactcctggacagtcgatcaccatctcctgcactggaaccngcagtgacgttggtgcttataattatgtctctggttccaacagcattcaggcagcgccccgaactcttaatttatgagttctttcgtcggccctcgtaggggtttctagtcgcttctccggctcaagtctggcaacncggcctccngaccatctctacgactccaggctgaggacgaggctgacttattattgcagctcatatactagaactacaagtggtactccgactggctggtcggcggaggtaccaagttcgaccgttcgtcggtacacgaccaggtccg

SEQ ID NO: 84049 - DNA, 493 bp, Homo sapiens
  misc_feature: GYAE6OF02G7B2L.36.23.C01.1.454.CMB.1.raw
  modified_base (227)..(227): a, c, t, g, unknown or other
  misc_feature (227)..(227): n is a, c, g, or t
tcagtacgctgtctcacgaccggtgctcgatttagtacacgtgattagggattgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggcagcgccccgaactcttaatttatgaggtctttcgtcggcctcagggtttctagtcgcttctccggctccaagtctggcaacacggcctccctgaccatctctagactccaggctgaggacgaggctgactattattgcagctcatatactgaagtcaatggtatccatgctgtcggcggagggaccagttgacgtctaggtcagcccagtccg

SEQ ID NO: 84050 - DNA, 523 bp, Homo sapiens
  misc_feature: GYAE6OF02G28MC.36.23.C01.1.454.CMB.1.raw
  modified_base (228)..(228): a, c, t, g, unknown or other
  misc_feature (228)..(228): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgccctccgtgtctgagactcctggacagtcgatcaccatctcctgcactggaaccngcagtgacgttggtgcttataattatgtctcctggttccaacagcattcaggcagccgaccccgaaactcttaatttatgtaggtctttcgtcggtccctgtagggtttctagtcgcttctccggctccaagtctgcaacacggcctcctgaccatctctagactccaggctgaggacgagctgactattattgcagctcattatactgaagtcaagttgtactccacgtgcttcggttcggacggaacgggtacctaaggttcgaccgtccgtagtcgacgcccgaaggtcccg

SEQ ID NO: 84051 - DNA, 489 bp, Homo sapiens
  misc_feature: GYAE6OF02HRHWQ.36.23.C01.1.454.CMB.1.raw
  modified_base (228)..(228): a, c, t, g, unknown or other
  misc_feature (228)..(228): n is a, c, g, or t
  modified_base (400)..(400): a, c, t, g, unknown or other
  misc_feature (400)..(400): n is a, c, g, or t
  modified_base (420)..(420): a, c, t, g, unknown or other
  misc_feature (420)..(420): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagcattcaggcagcgccccgaaactcttaattatgagtctttcgtcggccctgagggtttctagtcgcttctccggctccaagtctgcaacacggcctcctgaccatctctagactccagctgaggacgnggctgactattatgcagctnatatactgaatcaatgtatccatgctgtcggcgaggaccaagttcgaccgtcgaggtcacgccagtccg

SEQ ID NO: 84052 - DNA, 567 bp, Homo sapiens
  misc_feature: GYAE6OF02HXI2J.36.23.C01.1.454.CMB.1.raw
tcagtacgctgtctcacgaccggtgctcgatttagtacacgtgattagggattggggggaagaggaagactgacggtcctgtctcaggtgcagctgcagcagtcgggcccaggagtggtgaagccttcggagaccctgtccctcacctgcgctgtgtctggagcctccctcggcggagatgaatggtggagttgggtccgccagcccccagggaagggctgagttggattggtgaaataaatgagaccgggggcaccaactacaatgcgtccctcaggggtcgagtcaccatatctgcagacaagtccaagaaccacttctccctgagctgacctctgtcgaccgccgcggactcgccatatattattgtgcgagtagtttttgcgtaggattcgttggggcggttagtcggtacgtcgtggggtcgaagggtatcgacggtcagtcgtcttcctcacgcctcaccaacgggcccacgtcgtcccttccccgtcggccgcccgtgcctccgacggacgccaccgtccgacgacgcaccgacggccggtcccgtcggcctcgtcccgg

SEQ ID NO: 84053 - DNA, 547 bp, Homo sapiens
  misc_feature: GYAE6OF02IG3ID.36.23.C01.1.454.CMB.1.raw
  modified_base (227)..(227): a, c, t, g, unknown or other
  misc_feature (227)..(227): n is a, c, g, or t
  modified_base (303)..(303): a, c, t, g, unknown or other
  misc_feature (303)..(303): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctcgtgtctgagactcctggacagtcgatcaccatctcctgcactggaaccngcagtgacgttggtgcttataattatgtctcctggttccaacagcattcaggcagcgcccgaaactcttaatttangtagtctttcgtcgcctcgagggtttctagtcgcttctccggctccaagtctggcaacacggcctcctgaccatctctacgactccaggctggaggacgaggctagacttattattgcacggtctacgattactacttagaagttccaagttaggtaactccgtaacgtggacgttggttacgggcggtaacgggacctaaggttcggaccgttccgtacggtaccacggcccgtaaggtcccg

SEQ ID NO: 84054 - DNA, 511 bp, Homo sapiens
  misc_feature: GYAE6OF02F0JPA.36.23.C01.1.454.CMB.1.raw
  modified_base (425)..(425): a, c, t, g, unknown or other
  misc_feature (425)..(425): n is a, c, g, or t
tcagtacgctgtctcacgaccggtgctcgatttagtacacgtgattagggattgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaatttatgaggtctttcgtcggccctcaggggtttctagtcgcttctccggctccaagtctggcaacacggcctccctgaccatctctagactccaggctgagacgaggctgactattattgcagctnatatactgaagtcaatggtatccatgctggttcggcggtagggacctaagttcgaccgttccgtacggtcacgcccgaaggtcccg

SEQ ID NO: 84055 - DNA, 518 bp, Homo sapiens
  misc_feature: GYAE6OF02F34R6.36.23.C01.1.454.CMB.1.raw
  modified_base (307)..(307): a, c, t, g, unknown or other
  misc_feature (307)..(307): n is a, c, g, or t
  modified_base (366)..(366): a, c, t, g, unknown or other
  misc_feature (366)..(366): n is a, c, g, or t
  modified_base (374)..(374): a, c, t, g, unknown or other
  misc_feature (374)..(374): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgaccccgaaactcttaatttangtaggttctttcgtcggccctcgagggtttctagtcgcttctccggctcagtctgcacncgcctccngaccatctctagctccagctggagacgaggctagacttattatgcagtctacattatactgtaagtcaatcggtactccactggctggttcggacggacggacctaggttcgaccgttcgtacggtcgacgcccgaaggtcccg

SEQ ID NO: 84056 - DNA, 526 bp, Homo sapiens
  misc_feature: GYAE6OF02H4IHO.36.23.C01.1.454.CMB.1.raw
  modified_base (271)..(271): a, c, t, g, unknown or other
  misc_feature (271)..(271): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctcctgcactggaaccagcagtgacgttggtgcttataattatgtctcctggttccaanagcattcaggcagccgccccgaaactcttaattatgtagttctttcgtcggccctcgtagggttctagtcgcttctccggctcaagtctgcaacacggcctccctgaccatctctagactccagctgaggacgaggctgactattattgcagctctaatatactgaagttcaatggtatccgactggcttggttcgggacggtacgggaacctaaggttcgacccgttcgtaggtccacgacccgtaaggtcccg

SEQ ID NO: 84057 - DNA, 511 bp, Homo sapiens
  misc_feature: GYAE6OF02F4K7B.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaatttatgaggtctttcgtcggccctcaggggtttctagtcgcttctccggctccaagtctggcaacacggcctccctgaccatctctagactccaggctgaggacgaggctgacttattatgcagctcatatactgaagtcaatggtatccactgctggttcggcggagggacctaaggttgaccgtctaggtccacggtcccgaaggtccg

SEQ ID NO: 84058 - DNA, 662 bp, Homo sapiens
  misc_feature: GYAE6OF02J3ICR.36.23.C01.1.454.CMB.1.raw
  modified_base (186)..(186): a, c, t, g, unknown or other
  misc_feature (186)..(186): n is a, c, g, or t
  modified_base (191)..(191): a, c, t, g, unknown or other
  misc_feature (191)..(191): n is a, c, g, or t
  modified_base (239)..(239): a, c, t, g, unknown or other
  misc_feature (239)..(239): n is a, c, g, or t
  modified_base (333)..(333): a, c, t, g, unknown or other
  misc_feature (333)..(333): n is a, c, g, or t
tcagtacgctgtctcacgaccggtgctcgatttagtacacgtgattagggagttggggggaaagtactttcttgagactcatggacctcctgcacaagaacatgaacacctgtggttcttcctcctcctggtggcagctcccagatgggtcctgtctcaggtgcagctgcagcagtcgggccaggntggtnagccttcggagaccctgtccctcaccgtgccgctgtcgtcctagggcnccctcccgtgggacggagacttgaagtggtcggaggttcgggtccgccgacgcccccgaggggtacgggctggagtggagtggtagaaataagngtacggaccggggacaccgaacgaacgaacgtcgccgtcccgagtacggggaccgagtccaacctatacgtctagacgagaacacggtaccaacgaacctctccgtccctaggacgcgtacgacctactcgtacgaccggcccgcgggtacctccgggacctaattacttactttagtacggttcgaccggtagtttacggtttttacgaccgtaaggttccgtacggttttacggggcggttacgtccggttacgtcggttacggggtacgtaaggactccgtaacggcgttacgtacggtccctacgttccgaccgtcctaaccccg

SEQ ID NO: 84059 - DNA, 521 bp, Homo sapiens
  misc_feature: GYAE6OF02H8J06.36.23.C01.1.454.CMB.1.raw
  modified_base (272)..(272): a, c, t, g, unknown or other
  misc_feature (272)..(272): n is a, c, g, or t
  modified_base (367)..(367): a, c, t, g, unknown or other
  misc_feature (367)..(367): n is a, c, g, or t
  modified_base (422)..(422): a, c, t, g, unknown or other
  misc_feature (422)..(422): n is a, c, g, or t
  modified_base (441)..(441): a, c, t, g, unknown or other
  misc_feature (441)..(441): n is a, c, g, or t
tcagtacgctgtctcacgaccggtgctcgatttagtacacgtgattagggagttggggggggtactcaggaggcagcgctctcaggacatctccaccatggcctgggctctgctgctcctcaccctcctcactcagggcacagggtcctgggcccagtctggcctgacacagcctgcctccgtgtctgagacttcctggacagtcgatcacatctcctgcactggaaccagcagtgacgttgtgcttataattatgtctcctggttccaacngcattcaggcagccgccccgaaactctttaattatgaggttctttcgtcggcctcgagggtttctagtcgctttctccggctcaagtctgcaacncgcctccctgaccatctctagactccaggctgagcgagctagactattatgcagntcatatactagtacgttanaatggtaactccagtgtcgttaggtcggcggaggtacctaaggttcgaccgttccgtaggtccaacgaccccgagtcccg

SEQ ID NO: 84060 - DNA, 615 bp, Homo sapiens
  misc_feature: GYAE6OF02HIKEW.36.23.C01.1.454.CMB.1.raw
  modified_base (228)..(228): a, c, t, g, unknown or other
  misc_feature (228)..(228): n is a, c, g, or t
  modified_base (305)..(305): a, c, t, g, unknown or other
  misc_feature (305)..(305): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgggtctcctggacagtcgatcaccatctcctgcactggaaccngcagtgacgttggtagttataactttgtctctggtaccaacagcaccaggcagacgaccccaaatcatgtatttagngaggtacaagaaacgtccggcctacgtaggggtttctgactcgtcttctctcggctacgaagtcgtggccgacgaccggccctcccgtagaccctagtcctcgtcgggcctccgagtccgtaggacgggaccggaggtcttaggtaatttactacgtcgacctacgtcctacgtaataactaacgaagtacgactacgacctacgttccgttacgtaccgtttaccgggaacgttaccgggaaaccctaacggttacctacgttacggttaccggtacggtaccgaaccggacccgtaacccggaacccc

SEQ ID NO: 84061 - DNA, 540 bp, Homo sapiens
  misc_feature: GYAE6OF02J0KUI.36.23.C01.1.454.CMB.1.raw
  modified_base (230)..(230): a, c, t, g, unknown or other
  misc_feature (230)..(230): n is a, c, g, or t
  modified_base (273)..(273): a, c, t, g, unknown or other
  misc_feature (273)..(273): n is a, c, g, or t
  modified_base (308)..(308): a, c, t, g, unknown or other
  misc_feature (308)..(308): n is a, c, g, or t
  modified_base (488)..(488): a, c, t, g, unknown or other
  misc_feature (488)..(488): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctcctgcacgtggaaccngcagtgacgttggtgcttataattatgtctcctggttccaacngcattcaggcagccgacccgaaactcttaatttangtagttctttcgtcggtccctgtaggggtttctagtcgtcttcgtccggctccaagtctggcaacgacgccctccctgacccatctctacgacctccgaggtctggacggacgcggctgacttattcttgcagtctactatatactgaattcaatggtactctacgtcgcgttggtcggnggacggtaccgttagtcggaccgttcgtacgtcgacggtcccgtaaggtccg

SEQ ID NO: 84062 - DNA, 657 bp, Homo sapiens
  misc_feature: GYAE6OF02JJV95.36.23.C01.1.454.CMB.1.raw
  modified_base (227)..(227): a, c, t, g, unknown or other
  misc_feature (227)..(227): n is a, c, g, or t
  modified_base (265)..(265): a, c, t, g, unknown or other
  misc_feature (265)..(265): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagctcctggacagtcgatcaccatctcctgcactggaaccngcagtgacgttgtgcttatattatgtctctgttccaanagcattcaggcagccgccccgtaaacttcgttaattagtgtacggttctttcgtccggcccttacgtaggggtttcacgttccgtctttctccggtctaccgtaagttcgtaggaccaaaccgaccggtccctcccgtagaccctattcctactacgacgtccgaggtcgtagaacgggtaccgaggtaccgttgtaacctttagtttaacgttcgaccgtaacgtctacctaattaactaacgttaacgaaacgttacgtaaagttacggttaacctaaccgtcgttacggtaccgtttacgggttaccgggacgggtaagggtaaacccgttaggtttacccggaccgttaccgtaacggggttaccaccgggtaccccaacgggtcccg

SEQ ID NO: 84063 - DNA, 529 bp, Homo sapiens
  misc_feature: GYAE6OF02HTSE9.36.23.C01.1.454.CMB.1.raw
  modified_base (228)..(228): a, c, t, g, unknown or other
  misc_feature (228)..(228): n is a, c, g, or t
  modified_base (271)..(271): a, c, t, g, unknown or other
  misc_feature (271)..(271): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacngcattcaggcagccgaccccgaaactcttaatttatgtaggttcttttcgtccggtccctcgtagggtttctagtcgtcttctccggctacaagtctggcaacacggcctcctgaccatcctactagactccaggtctggaggacgaggctagtactatttatgcagtctacatatactagaatcaatgtaatccagtggcttggtcgggacggagggacctaaggttcgaccgttcgtaggtcacgccgaggtcccg

SEQ ID NO: 84064 - DNA, 514 bp, Homo sapiens
  misc_feature: GYAE6OF02FE3U1.36.23.C01.1.454.CMB.1.raw
  modified_base (328)..(328): a, c, t, g, unknown or other
  misc_feature (328)..(328): n is a, c, g, or t
  modified_base (389)..(389): a, c, t, g, unknown or other
  misc_feature (389)..(389): n is a, c, g, or t
  modified_base (424)..(424): a, c, t, g, unknown or other
  misc_feature (424)..(424): n is a, c, g, or t
  modified_base (446)..(446): a, c, t, g, unknown or other
  misc_feature (446)..(446): n is a, c, g, or t
  modified_base (448)..(448): a, c, t, g, unknown or other
  misc_feature (448)..(448): n is a, c, g, or t
tcagtacgctgtctcacgaccggtgctcgatttagtacacgtgattagggattgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtcttcctggttccaacagcattcaggcagcgccccgaaactcttaatttatgaggttctttcgtccggtccctntaggggtttctagtcgtcttctccggctccaagtctgcaacacggccctccctgaccatcnctgggctccagcctgaggacgaggctgattatacngcagctcatatacaagtgacancnctctcgttcttaggacgtcgggaccaaggtcacgtcgtcctaggtccacgcccaggcccaaccccg

SEQ ID NO: 84065 - DNA, 517 bp, Homo sapiens
  misc_feature: GYAE6OF02JHWUT.36.23.C01.1.454.CMB.1.raw
tcagtacgctgtctcacgaccggtgctcgatttagtacacgtgattagggattgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaacccagcagtgacgttggtgcttataattatgtctcctggttccaacagcattcaggcagcgccccgaaactcttaatttatgaggttctttcgtcggcctcaggggtttctagtcgctttctccggctccagtctgcacacgcctcctgaccatctctagacctccaggctgacggacgaggctgacttattattgacagctcatatactgaagttcaattggtactccacgttgcttggttcggcggaggtaccgaagttcgaccgttcgtaggtccacgtcccgaggtccg

SEQ ID NO: 84066 - DNA, 617 bp, Homo sapiens
  misc_feature: GYAE6OF02HN1SX.36.23.C01.1.454.CMB.1.raw
  modified_base (270)..(270): a, c, t, g, unknown or other
  misc_feature (270)..(270): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttgtgcttataattatgtctcctggttccaacngcattcaggcagccgaccccgaaactctttaattatgtacggttctttcgtccggtcctcgtaggggtttctagtccgtcttctccggtctccaagtcgtacgactaaccacggcccttccctgaccctagttcctctaacgtacctccgaggcttggacggacgaggcttagacttattattgctagtctcgtaattactacgtagtaacgttactaaacgttggtaactccctaacgttcggacctttcggggtttccgggaccgggtacggggtaaccctaacgggtttccggtaacccggttacccgtaagggttacccgaaccggtacccgagggtaccccg

SEQ ID NO: 84067 - DNA, 563 bp, Homo sapiens
  misc_feature: GYAE6OF02JDR3V.36.23.C01.1.454.CMB.1.raw
  modified_base (240)..(240): a, c, t, g, unknown or other
  misc_feature (240)..(240): n is a, c, g, or t
  modified_base (303)..(303): a, c, t, g, unknown or other
  misc_feature (303)..(303): n is a, c, g, or t
  modified_base (398)..(398): a, c, t, g, unknown or other
  misc_feature (398)..(398): n is a, c, g, or t
  modified_base (508)..(508): a, c, t, g, unknown or other
  misc_feature (508)..(508): n is a, c, g, or t
tcagtacgctgtctcacgaccggtgctcgattagtacacgtgattagggattggggggggtctcaggaggcaccgctctcaggacatctccaccatggcctgggctctgctgctcctcaccctcctcactcagggcacagggtcctgggcccagtctggcctgacacagcctgcctccgtgtctgagactcctggacagtcgatcaccatctctgcactggaaccagcagtgacgttggngcttataattatgtctcctggttccaacagcattcaggcagccgacccgaattcttaatttangaggtttcctttcgtcggaccccttcgtaaggggttttctagtcgtccttcgtcccggtctcctaagttctggaccaaacgccggcccttcccgngaccctatcgtactagaccttccaggctcgaggtacgaggctaggacttattattacgcagtctacattaactactagaatactaagtcgtatccagtcgcttggtcggnggtacgggaccgtaagttcgaccgttacgttaggtccacgaccgtagcctcccgg

SEQ ID NO: 84068 - DNA, 533 bp, Homo sapiens
  misc_feature: GYAE6OF02FYP2F.36.23.C01.1.454.CMB.1.raw
  modified_base (325)..(325): a, c, t, g, unknown or other
  misc_feature (325)..(325): n is a, c, g, or t
tcagtacgctgtctcacgaccggtgctcgatttagtacacgtgattagggattgggggggaaatactttctgagactcatggacctcctgcacaagaacatgaaacacctgtggttcttcctcctcctggtggcagctcccagatgggtcctgtctcaggtgcagctgcagcagtcgggcccaggagtggtgaagccttcggagaccctgtccctcacctgcgctgtgtctggagcctccctcggcggagatgaatggtggagttgggtccgccagcccccagggaagggctgagttggattggtgaaataatgagaccgggggnaccgaactacaatgcgtccctcaggggtcgagtcaccatatctgcagacaagtccaagaaccacttctccctgagctgacctctgtgaccgccgcggactcggccatatattattgtgcgagtagtttttgcgtagtatcgttgggtcgtagtcgacgtcgtggggtcaagggatcgacggtcagtcgtctcctcgtacgcctacccg

SEQ ID NO: 84069 - DNA, 534 bp, Homo sapiens
  misc_feature: GYAE6OF02FV9SS.36.23.C01.1.454.CMB.1.raw
  modified_base (409)..(409): a, c, t, g, unknown or other
  misc_feature (409)..(409): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgaccccgaaactcttaatttatgaggtctttcgtcgtcctgtagggtttctagtcgtcttctccggctcaagtctggcaacacggccctccctgacctatctctagacctccgagctgaggacgnggtctgactattatgcagctcatatactagaagtcaatcggtatccgactggtctggttcgggacgggtacgggtaacctaggttacgtaccggttaccgtacggtccaacgtcccgaaggtccg

SEQ ID NO: 84070 - DNA, 537 bp, Homo sapiens
  misc_feature: GYAE6OF02HQROJ.36.23.C01.1.454.CMB.1.raw
  modified_base (227)..(227): a, c, t, g, unknown or other
  misc_feature (227)..(227): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttgtgcttataattatgtctcctgttccaacagcattcaggcagccgaccccgaaactcttaaatttatgtagttctttcgtccggcctcgagggtttcagttcgcttctccggctccaagtctggcaacacggcctccctgaccatctctagacctcaggctgaggacgaggctgactattattgacagctcatatactgaagtctaagtggtactccgaactggtcgtggttccgggcggaacgggtaccgtaagttcggacccgttacgtaccggttacacggtacccgaggtacccg

SEQ ID NO: 84071 - DNA, 514 bp, Homo sapiens
  misc_feature: GYAE6OF02FJ7CC.36.23.C01.1.454.CMB.1.raw
  modified_base (324)..(324): a, c, t, g, unknown or other
  misc_feature (324)..(324): n is a, c, g, or t
  modified_base (425)..(425): a, c, t, g, unknown or other
  misc_feature (425)..(425): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaatcttaatttatgagttctttcgtcggccctnagggtttctagtcgcttctccgctccaagtctggcaacacggcctccctgaccatctctagactccaggctggaggacgaggctgacttatattgcagctnatatactgaattcaatggtatccatggctggttcggcggtagggacctaaggttcgacccgttacgtaggtcacgtcccgaaggtcccg

SEQ ID NO: 84072 - DNA, 612 bp, Homo sapiens
  misc_feature: GYAE6OF02I71MH.36.23.C01.1.454.CMB.1.raw
  modified_base (270)..(270): a, c, t, g, unknown or other
  misc_feature (270)..(270): n is a, c, g, or t
tcagtacgctgtctcacgaccggtgctcgatttagtacacgtgattagggattgggggggtctcaggaggcagcgctctcaggacatctccaccatggcctgggctctgctgctcctcaccctcctcactcagggcacgagggtcctgggcccagtctggcctgacacagcctgcctccgtgtctgagactcctggacagtcgatcaccatctcctgcactacggaaccagcagtgacgttggtgcttataattatgtctctggttacanagctattcagcagccgacccgtaaactctttaatttacgtagtaggttctttcgtccggtcccgttcgtacggggtttctagtcgtcttcgtccgtctacctaagtcgtcgacaacgaccggccctcctgacctactcctactacgaacctccgaggtcgtaggacggtacgacggtctacgactttattagttcgactacgactctaacttacgtacgtacgaacgttactaagttaggtaactccgtagtcgtcgttacggttcgggtacggtacgggtaaccgttaaggttacggtaccggttaccgtacggttaccacggtacccggaaggtccccgg

SEQ ID NO: 84073 - DNA, 525 bp, Homo sapiens
  misc_feature: GYAE6OF02IPZ3H.36.23.C01.1.454.CMB.1.raw
  modified_base (227)..(227): a, c, t, g, unknown or other
  misc_feature (227)..(227): n is a, c, g, or t
  modified_base (266)..(266): a, c, t, g, unknown or other
  misc_feature (266)..(266): n is a, c, g, or t
  modified_base (276)..(276): a, c, t, g, unknown or other
  misc_feature (276)..(276): n is a, c, g, or t
  modified_base (417)..(417): a, c, t, g, unknown or other
  misc_feature (417)..(417): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggcagtcgatcacatctcctgcactggaaccngcagtgacgttggtgcttatattatgtctctggttcacngcattcagcngcgcccgaaatcttaattatgagttctttcgtcgcctgtagggttctagtcgtcttcgccgctccagtctgcaacacggcctcctgaccatcctactagacctccgaggtctggaggacgaggctgacttattattcgacngctcattatactagtaagtctaaagttggtaactcctacgtcgtcgtcggttcgggacggacggtaaccgtacgttcgaccgtcgtagtccgacgtccgaacggtccg

SEQ ID NO: 84074 - DNA, 620 bp, Homo sapiens
  misc_feature: GYAE6OF02I93HW.36.23.C01.1.454.CMB.1.raw
  modified_base (305)..(305): a, c, t, g, unknown or other
  misc_feature (305)..(305): n is a, c, g, or t
  modified_base (436)..(436): a, c, t, g, unknown or other
  misc_feature (436)..(436): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttgtgcttataattatgtctcctggttccaacagcattcaggcagcgccccgaaactcttaatttagngtagttctttcgtccgcctcgtagggtttctagtcgtctttctccggtctacaagtcgtgcaacgaccggcctccctcgacctatcctctagacctccgagcctgacggacgaggctgactattactgacngtctacagttactacgtagtaacttacaaagttcgggtaaatcccgtaaccttgggtaccgttacgggtttccggggtaccgggaacggggtaacccgtaaacgggttttaccgggtaaccccggtttacccggtttaacggggtcccgtaaaccgggtaccccggtaaacgggttcccccggg

SEQ ID NO: 84075 - DNA, 560 bp, Homo sapiens
  misc_feature: GYAE6OF02FRQ3Z.36.23.C01.1.454.CMB.1.raw
tcagtacgctgtctcacgaccggtgctcgatttagtacacgtgattagggattgggggggaaatactttctgagactcatggacctcctgcacaagaacatgaaacacctgtggttcttcctcctcctggtggcagctcccagatgggtcctgtctcaggtgcagctgcagcagtcgggcccagggagtggtgaagccttcggagaccctgtccctcacctgcgctgtgtctggacgccctcccgtcgggccggagatgaatggtggagttgggtccgccagcccccagggaagggctgagtggattggtgaataatgagaccggggcaccaactacaatgcgtccctcgacggggtcgagtcaccatatctgcagacaagtccaagaaccactctccctgacggctgacctctgtcgacccgccgcggactcggccatatattattgtcgcgagtagtttttcgcgtaggtattcgttggggtcggttactcggtacgtcggtggggtcgaagggtactcgacggtcgacgttccgtcctcccgtctacgccctacccg

SEQ ID NO: 84076 - DNA, 520 bp, Homo sapiens
  misc_feature: GYAE6OF02GFYUE.36.23.C01.1.454.CMB.1.raw
  modified_base (382)..(382): a, c, t, g, unknown or other
  misc_feature (382)..(382): n is a, c, g, or t
  modified_base (426)..(426): a, c, t, g, unknown or other
  misc_feature (426)..(426): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaatcttaatttatgaggttctttcgtccggccctcgtagggtttctagtcgctttcgtccggctccaagtctggccaacacggccttcccngaccatctctagactccaggctgaggacgagctgacttattatncagctcatatactagaagtcaatggtataccactggcttggttcggacggtacgggacctagttcgaccgtcgtacggcacggaccgagtcccg

SEQ ID NO: 84077 - DNA, 250 bp, Homo sapiens
  misc_feature: GYAE6OF02FP3P5.36.23.C01.1.454.CMB.1.raw
  modified_base (221)..(250): a, c, t, g, unknown or other
  misc_feature (221)..(250): n is a, c, g, or t
tcagtacgctgtctcacgaccggtgctcgatttagtacacgtgattagggattggggggaggaactggctcagttaggacccagacgggaaccatggaagccccagccgcgagcttctcttccacctgctactctggctcccaggactgtggctgcaccatctgtcttccatcttcccgcatctgaagacagcgtactgagcgggctggcaaggcgcatgnnnnnnnnnnnnnnnnnnnnnnnnnnnnnn

SEQ ID NO: 84078 - DNA, 654 bp, Homo sapiens
  misc_feature: GYAE6OF02IKGYB.36.23.C01.1.454.CMB.1.raw
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcacatcctcctgcactcggaaccagcagtgacgttggtgtcttaataattatgttcctccttcggttaccaactagcctattcgaggcacggccgaccccgtaaacttactttaatttagtgtacggttcctttacggtccggtcccttcgttacgggtttctacggttccgtctttccgtcccggtctacctaacgttcgtacggacctaaaccgtccggtcccttcccgtacgtaccctacttcccttaacgttacgtaccgtcccgtagggtcctagggacgggaacggtacggtcttacgtaactttagttaagttcgactacgtctactaattaactacgtagtaacgtaactagtcgtaactccgtacgtcgtacgttcggtcggacggaacgggtaacctaggttcgaccggttcgtacggaccgtacgacccgtaggtcccg

SEQ ID NO: 84079 - DNA, 640 bp, Homo sapiens
  misc_feature: GYAE6OF02IR1YF.36.23.C01.1.454.CMB.1.raw
  modified_base (230)..(230): a, c, t, g, unknown or other
  misc_feature (230)..(230): n is a, c, g, or t
  modified_base (275)..(275): a, c, t, g, unknown or other
  misc_feature (275)..(275): n is a, c, g, or t
  modified_base (485)..(485): a, c, t, g, unknown or other
  misc_feature (485)..(485): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgccactggaaccngcagtgacgttggtgtcttataattatgtcctccgtggtaccaanagctattcgaggcagcccgaccccgaaacttcttaatttatggtacggtttctttccggtccggtcccttcggttacggggttttcctaggttccgtcctttccgtcccggtcctacccgtaagtttccgtcgggtaccaaccgacccgggtccccttaccctgaacccattcctacgtacgaccctccgaggcctaggaacggtacggngtcttagtacttattattcgctagctcaattactacgttgtaaagttctaaagttcggtaatccgtagtggtcgttcgggtccgggacgggtacgggtaacctaggttaccgacccggttcgtacgggttcccacggtaccccgagggttccccg

SEQ ID NO: 84080 - DNA, 510 bp, Homo sapiens
  misc_feature: GYAE6OF02HQJLO.36.23.C01.1.454.CMB.1.raw
  modified_base (375)..(375): a, c, t, g, unknown or other
  misc_feature (375)..(375): n is a, c, g, or t
  modified_base (416)..(416): a, c, t, g, unknown or other
  misc_feature (416)..(416): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagccctgccctccgtgtctgagactcctggacagtcgatcaccatctcctgcactggaaccagcagtgacgttggtgcttataatttatgttctcctggttccaacagcattcaggcagcgccccgaaactcttaatttatgtagttctttcgtcggcccttcgtaggggtttctagtcgctttctccggctccaagtctggcaacncggcctccctgaccatcctctagactccaggctgaggacgnggctgactatttatgcagctctatatactgaatcaatgtatccatgcttgtcggcggaggactaagtcgtaccgtctaggtcacggccagtccg

SEQ ID NO: 84081 - DNA, 552 bp, Homo sapiens
  misc_feature: GYAE6OF02I47VT.36.23.C01.1.454.CMB.1.raw
  modified_base (362)..(362): a, c, t, g, unknown or other
  misc_feature (362)..(362): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataatatgtctctggttccaacagcattcaggcagcgccccgaaactcttaattatgaggttctttcgtcgccctcagggtttctagtcgcttctccggctccaagtctggcaacncggcctcccgtgacctactctactacgactccgaggctggacggacgaggcttcggacttattattgcagtctacattatactgaagtctaaatggtatccgtacgtgtcttcggttcgggcggaaggggtaacctaaggtttccgtaaccggttccgttaacggtcctaacggacccgtaaggtcccgg

SEQ ID NO: 84082 - DNA, 621 bp, Homo sapiens
  misc_feature: GYAE6OF02IZPL0.36.23.C01.1.454.CMB.1.raw
  modified_base (212)..(212): a, c, t, g, unknown or other
  misc_feature (212)..(212): n is a, c, g, or t
  modified_base (230)..(230): a, c, t, g, unknown or other
  misc_feature (230)..(230): n is a, c, g, or t
  modified_base (305)..(305): a, c, t, g, unknown or other
  misc_feature (305)..(305): n is a, c, g, or t
  modified_base (402)..(402): a, c, t, g, unknown or other
  misc_feature (402)..(402): n is a, c, g, or t
tcagtacgctgtctcacgaccggtgctcgattagtacacgtgattagggagttggggggggtcgtcaggaggcaccgctctcaggacatctccaccatggcctgggctctgctgctcctcaccctcctcactcagggcacagggtcctgggcccagtctgccctgactcagcctgcctccgtgtctgggtctcctggacagtcgatccaccntctcctgcactggaaccngcagtgacgttggtacttataactttgtctctgtaccaacagcaccagcagacgaccccaaactcatcgatttanggaggtcaagaaatccggtcctacgtaggggtttctgacttcgctttctcgtcggctctaacgtcgtcggcgaccgacggcccttcccgtgaacccnttacccgtcgtcgggcctcgacgtccgtgggacgaacggtgcgttatatttagtaccgttgctagcttactaagttacttaacgaagttaacgcaacgtcctaacgttccgttaccgttcggttaccggaacggtccgggtaaccgaacggttacacccgtttaggttaccctacggttaccggaccgaaccccgttaaccgggccccctaaaccccgg

SEQ ID NO: 84083 - DNA, 614 bp, Homo sapiens
  misc_feature: GYAE6OF02I968P.36.23.C01.1.454.CMB.1.raw
  modified_base (229)..(229): a, c, t, g, unknown or other
  misc_feature (229)..(229): n is a, c, g, or t
tcagtacgctgtctcacgaccggtgctcgatttagtacacgtgattagggagttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttgtgcttataattatgtctctggttccaacagcattcaggcagccgaccccgaaactctttaaatttatgtaggttctttcgtcggtccctgtaggggtttctacggtcgctttctccggtctccaagttctggccaacgaccggccctccctgaccatctctagactccaggctgaggacgaggctgacttattattcgacagctacattatactagtaacgtactaagttcggttactccgtaacgttcgggtcctttacgggttccggggaccgggtaacgggggtaacccgttaagggttttaccggaaccccggtttacccggttaacgggttacccgtaaccggtaccccggtaaacgggttcccccgg

SEQ ID NO: 84084 - DNA, 534 bp, Homo sapiens
  misc_feature: GYAE6OF02G2994.36.23.C01.1.454.CMB.1.raw
  modified_base (470)..(470): a, c, t, g, unknown or other
  misc_feature (470)..(470): n is a, c, g, or t
  modified_base (503)..(503): a, c, t, g, unknown or other
  misc_feature (503)..(503): n is a, c, g, or t
  modified_base (511)..(511): a, c, t, g, unknown or other
  misc_feature (511)..(511): n is a, c, g, or t
  modified_base (524)..(524): a, c, t, g, unknown or other
  misc_feature (524)..(524): n is a, c, g, or t
tcagtacgctgtctcacgaccggtgctcgatttagtacacgtgattagggattgggggggaaatactttctgagactcatggacctcctgcacaagaacatgaaacacctgtggttcttcctcctcctggtggcagctcccagatgggtcctgtctcaggtgcagctgcagcagtcgggcccaggagtggtgaagccttcggagaccctgtccctcacctgcgctgtgtctggagcctccctcggcggagatgaatggtggagttgggtccgccagccccccagggaaggggctggagttggattggtgaaataaatgagaccgggggcaccgaactacaatgcgtccctcgaggggtcgagtcaccatatctgcagacaagtccaagaaccacttcctccctagacggctgaccctctgtcgaccgccgcggactccggcatatattattgtgcgagtgttttgctagntcgttgggcgtatcgacgtgtggggtcaagggntcgacgtnactcgtctcctcncgccctaccg

SEQ ID NO: 84085 - DNA, 526 bp, Homo sapiens
  misc_feature: GYAE6OF02IHKIP.36.23.C01.1.454.CMB.1.raw
  modified_base (228)..(228): a, c, t, g, unknown or other
  misc_feature (228)..(228): n is a, c, g, or t
  modified_base (363)..(363): a, c, t, g, unknown or other
  misc_feature (363)..(363): n is a, c, g, or t
  modified_base (427)..(427): a, c, t, g, unknown or other
  misc_feature (427)..(427): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctcctgcactggaaccngcagtgacgttggtgcttataattatgtctcctggttccaacagcattcaggcagccgccccgaaatcttaatttatgagttctttcgtcgccctgtagggtttctagtcgcttctccggctcaagtctgcaacncggcctcctgaccatctctagactccgaggtctgaggacgaggctagtactattattgcagctnatatactgaactcaagtggtactccgagtcggtcttcggtcggcggtaacgggtacctaaggttcgaccgtcgttaggtccaacggcccgaaggtcccg

SEQ ID NO: 84086 - DNA, 513 bp, Homo sapiens
  misc_feature: GYAE6OF02HCF97.36.23.C01.1.454.CMB.1.raw
  modified_base (226)..(226): a, c, t, g, unknown or other
  misc_feature (226)..(226): n is a, c, g, or t
tcagtacgctgtctcacgaccggtgctcgattagtacacgtgattagggattgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttgtgcttataattatgtctcctggttccaacagcattcaggcagccgacccgaaactcttaattatgagtctttcgtcgccctgtacgggtttctagtcgtcttctccggctcaagtctgcaacacgcctcctgaccatctctagactcgagctgagacgagctagacttattattgcagtctcagtatactgaatcaatgtatccacgtggctcgttcgggtcggaacgggtaccgaagttcgaccggttcctaggtccgacgacccgaagtcccg

SEQ ID NO: 84087 - DNA, 528 bp, Homo sapiens
  misc_feature: GYAE6OF02F90ED.36.23.C01.1.454.CMB.1.raw
  modified_base (228)..(228): a, c, t, g, unknown or other
  misc_feature (228)..(228): n is a, c, g, or t
  modified_base (267)..(267): a, c, t, g, unknown or other
  misc_feature (267)..(267): n is a, c, g, or t
  modified_base (361)..(361): a, c, t, g, unknown or other
  misc_feature (361)..(361): n is a, c, g, or t
  modified_base (370)..(370): a, c, t, g, unknown or other
  misc_feature (370)..(370): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttatattatgtctctgttccaangcattcaggcagccgaccccgaaatcttaattatgaggttctttcgtcggccctgtagggtttctagtcgcttctccggctccagtctgcaacncggcctccngaccatctctacactccaggctgaggacgaggctgacttattattgcagctcatatacgtgaacgttcaattggtaactccgagttggcttggttcgggacggagggtacctaaggttcgacccggttccgtaaggtccaacggacccgaggtccccg

SEQ ID NO: 84088 - DNA, 493 bp, Homo sapiens
  misc_feature: GYAE6OF02GFP7D.36.23.C01.1.454.CMB.1.raw
  modified_base (358)..(358): a, c, t, g, unknown or other
  misc_feature (358)..(358): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttgtgcttataattatgtctcctggttccaacagcattcaggcagcgccccgaactcttaatttatgagtctttcgtcggccctgagggtttctagtcgcttctccgctccagtctgcacncggcctcctgaccatctctagctccgagctgaggacgagctgactattatgcagctcatatactgaacgtcaatgtatccactgctgttcggacggaggaccgtagttcgaccgtcgtaggcacgccaggtcccg

SEQ ID NO: 84089 - DNA, 502 bp, Homo sapiens
  misc_feature: GYAE6OF02JIC0X.36.23.C01.1.454.CMB.1.raw
tcagtacgctgtctcacgaccggtgctcgattagtacacgtgattagggattggggggggtctcaggaggcaccgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgcccgaactcttaatttatgagtcttcgtcggcctcagggtttctagtcgcttctccggctccaagtctggcaacacggccctccctgaccactctctacgactccgaggtctggacggacgaggctggactattattgcagctcatatactgaatctaagtggtactccactgctgtcggcggaggacagttcgaccgttcaggtcacgccagctccg

SEQ ID NO: 84090 - DNA, 514 bp, Homo sapiens
  misc_feature: GYAE6OF02F7IYO.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaatttatgaggttctttcgtcggccctcaggggtttctagtcgctttctccggctccaagtctggcaacacggccctccctgaccatcctctagactccaggctgaggacgaggctgactattattgcagctcatatactgaattcaatggtatccactggctggttcggcggagggacctaagttgacccgtctacggtcacggtcccaggtccg

SEQ ID NO: 84091 - DNA, 589 bp, Homo sapiens
  misc_feature: GYAE6OF02HSI0T.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgcccgaaactcttaatttatgtaggttctttacgtcggtccctgtaggggtttctagtcgtctttcgtccggctaccgaagttcgtggacaaacgacggccctaccctgaccctatcctctacgactccaggctgaggacgaggctgacttattattgcagctcagttactactggaactctaacgtggttaactcctaacgttggtccgttacggttccgggaccgggtaacgggtacccgtaaaggtttccggacccggttacccggttaagggtcctaacgggaccccgaaggttaccccgg

SEQ ID NO: 84092 - DNA, 854 bp, Homo sapiens
  misc_feature: GYAE6OF02IU18X.36.23.C01.1.454.CMB.1.raw
  modified_base (220)..(220): a, c, t, g, unknown or other
  misc_feature (220)..(220): n is a, c, g, or t
  modified_base (245)..(245): a, c, t, g, unknown or other
  misc_feature (245)..(245): n is a, c, g, or t
tcagtacgctgtctcacgaccggtgctcgatttagtacacgtgattagggagttggggggaaagtactttctgagactcatggacctcctgcacaagaacatgaaacacctgtggttcttcctcctcctggtggcagctcccagatgggtcctgtctcaggtgcagctgcagcaggtcgggcccaggagtggtgaagcccttcggagaccctgtcccctnaccgtgccgctggtgtctagggacnccctcccgtgggacggagatgaactggtggaggttgggtccggccgtacggacccccgaggggaacggggcgtcggaggttggagttgggtgtaaataaagtgacggaccgggggtaccaaccgaaacgtaacgaacgtacggccggtaccccgtcggtaacgggggtacggtaacggttaccgaacccgtaacgttacttacgtacggtacaacggaactaaacggtaccccgaaaagtaacccgaacctttacccgtacccgttaacggacgggtacctaccggtaacccttccggtacgttaccgggacccggacccggcccgggtacggttacccgggaccgtaactaacttaacgtttacgtttacggtaggtaccggtaacggttacggttttttacggaccggttaacgggttaacgtttaccgggtttacggggggtaccggtttacggttaccggttaccgggtttccggttacgggggggttaccgtaaaagggggtccgttaaacccgggtacccggggttttacgtaaacccggtttccgggttacccccggtttaacccgtcccggtttacccgggtacccccctttaaccccggg

SEQ ID NO: 84093 - DNA, 536 bp, Homo sapiens
  misc_feature: GYAE6OF02F1V3E.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctgttccaacagcattcaggcagccgccccgaaacttcttaatttatgagttctttcgtcggccctcgtagggtttctagtcgctttctccggctccaagtctcggcaacaccggcctccctgaccatctctagacctccaggctgaggacgaggctgacttattatgcagctacattatacgtagaagtcaaagtcggtactccactggcttggttcgggcgggaacgggtacctaagttcggaccgttccgtacggtcacgtcccgaaggtcccg

SEQ ID NO: 84094 - DNA, 580 bp, Homo sapiens
  misc_feature: GYAE6OF02F1L4C.36.23.C01.1.454.CMB.1.raw
  modified_base (227)..(227): a, c, t, g, unknown or other
  misc_feature (227)..(227): n is a, c, g, or t
  modified_base (267)..(267): a, c, t, g, unknown or other
  misc_feature (267)..(267): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcttggacagtcgatcaccatctcctgcactggaaccngcagtgacgttggtgcttatattatgtctctgttccaacngcattcaggcagccgaccccgaaactcttaatttatgaggttctttcgtcgccctctagggtttctagtcgctttcgtccggctccaagtctggcaacacggcctccctgaccatcctactagactccgaggctggaggacggaggcttagacttattattgcacgtctcattatacgtagaagttacaagttggtactaccgagttcggcgttacgggtttccgggacgggtaacggggtaacccttaacggtttcggtaaccccggttccggttaacgggtaccaccgggtacccgaaccgggttccccgg

SEQ ID NO: 84095 - DNA, 530 bp, Homo sapiens
  misc_feature: GYAE6OF02G8S2X.36.23.C01.1.454.CMB.1.raw
  modified_base (370)..(370): a, c, t, g, unknown or other
  misc_feature (370)..(370): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgaccccgaaactcttaatttatgtaggtctttcgtcggtccctcgtagggtttctagtcgcttctccggctccaagtctgcaacncgcctccctgaccatctctagacctccaggtctggaggacgaggctgacttattatgcagtctctatatactgaagtcaagtgtactccatggtcttggtcggacgggaggtacctaaggttcgacccggttcgtacggtacgacggacccgaggtcccg

SEQ ID NO: 84096 - DNA, 536 bp, Homo sapiens
  misc_feature: GYAE6OF02G65ZE.36.23.C01.1.454.CMB.1.raw
  modified_base (457)..(457): a, c, t, g, unknown or other
  misc_feature (457)..(457): n is a, c, g, or t
tcagtacgctgtctcacgaccggtgctcgatttagtacacgtgatttagggattggggggggtctcaggaggcagcgctctcaggacatctccaccatggcctgggctctgctgctcctcaccctcctcactcagggcacagggtcctgggcccagtctggcctgacacagcctgcctccgtgtccgagactcctggacagtcgatcaccatctcctgcactggaaccagcagtgacgttggtgcttataattatgtctcctggttccaacagcattcaggcagcgccccgaaactcttaattatgtaggtctttcgtcggtccctcgagggtttctagtcgtcttctccggctccaagtctggcaacacgcctccctgaccactctctacgactccaggctgaggacgaggctgactattatgcagctcatactacgtagaagtacaattggtacnccgtactggtcgtggttcgggcggtacgggtacctaaggttcgaccgttccgtacggtcacggacccgaggcctcccgg

SEQ ID NO: 84097 - DNA, 825 bp, Homo sapiens
  misc_feature: GYAE6OF02G03ZL.36.23.C01.1.454.CMB.1.raw
  modified_base (242)..(242): a, c, t, g, unknown or other
  misc_feature (242)..(242): n is a, c, g, or t
  modified_base (269)..(269): a, c, t, g, unknown or other
  misc_feature (269)..(269): n is a, c, g, or t
tcagtacgctgtctcacgaccggtgctcgattagtacacgtgattagggagttggggggggtctcaggaggcaccgctctcaggacatctcccaccatggcctgggctctgctgctcctcaccctcctcactcagggcacagggtcctgggcccagtctggcctgacacagcctgcctccgtgtctgagactcctggacagtcgatcaccatctcctgcactggaccagcagtgacgttggncttataattatgtctctggttccaacngcattcaggcaggccgaccccgtaaacttctttaaatttacgtaggtacggttccttttaccggtccgggtccccttcggttacgggggttttcctaggttccgtccgtttccgtcccgggtccttacccgtaacggttcctcgggacctaaacccgtacccgggtccccttaccccgttcgggaacccctaacgtttcccgttacccgtaacggtaaccccgtttccccgtaacggggtacccttaggggaaacccggggtaaccggtaaccgggggttcccttaacggggtaaaccctttttaagttttaacggtttccggaccgtaacggttaccttaccgtaactttaaacgttacccgtttaagggtaaaccggtttaccgtaaaacggtttacgggttaaaccttccccgaacggtttcgggtacccgtttacgggtttaccggggaccggggttaacggggtaacccgtaagggttttcccgggaacccggtttacccgttacgggtacccgtaacggtaccccgtaacggggtcccttacccccgggg

SEQ ID NO: 84098 - DNA, 776 bp, Homo sapiens
  misc_feature: GYAE6OF02G5YTN.36.23.C01.1.454.CMB.1.raw
  modified_base (242)..(242): a, c, t, g, unknown or other
  misc_feature (242)..(242): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagacctcctggacagtcgatcacatctcctgcactggaaccagcagtgacgttggncttatattatgtctcctgtcaacagcattcaggcacgccgaccccgaaacttccttaaatttatgtacggttcctttcggtccggtcccgtcgtacgggggttttcctaacggttccgtccgttttccgtcccgggtacctttaccccgtaaacggttccgttacgggtacccgaaaccgtaacccggggtccccttacccccgtacggtaacccctaactttaccccgttaccgtttaaaccgtacccctttacccggacgggttacccgttacggggaaacggggtaaccgggtacggggtaccgttacggttaaaccgtttaacgttttaacgtttccggacgttaacggtccttacctaacgtttaacgtaacccgttaggtaaacgttacctaaaggttacggttaacgtcccgtaacgtcggtcgttttaccgggttcggggtaccgggtaacgggtaacccgtaaggtttacccggtacccggttaccggttaggtacccgtaccggtacccggtaggtacccccgg

SEQ ID NO: 84099 - DNA, 578 bp, Homo sapiens
  misc_feature: GYAE6OF02I1A12.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttgtgcttataattatgtctctggttccaacagcattcaggcagcgcccgaaactcttaattatgtaggtctttcgtcggcctgtagggtttcagtcgcttcgtccggctccagtctggcaacacggcctcctgacctatcctctagactccgaggtctgacggacgaggtcctagtacttattagttcgctacggtctactatactactagtaacgtctaagttcggtaactccgtacgttacggcgttacggttcgggccgggtaacgggtaaccgtaagggtttccggaacccggttccggttaacggtaccgaccggtacccggtaggttaccccgg

SEQ ID NO: 84100 - DNA, 587 bp, Homo sapiens
  misc_feature: GYAE6OF02IWUG9.36.23.C01.1.454.CMB.1.raw
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcacatctctgcactggaaccagcagtgacgttggtgcttataattatgtctcctggtccaacagcattcagcagccgaccccgaaacttcttaatttatgtagttctttcgtcggtcctgtagggtttctagtcgtcttctccggctcagtctgcacacgcctcctcacactctcagacctacaggctggaggacgacggtctagtacttattattcgacagtcctagtaattactaacgttacgaaattcgtaaagttcgggttaactacccgtaacgtcgtacgttacgggttccgggaccgggtaaggggtaacccgtaaggtttacccggaccggttaccgttaccggtaccgtaaccggtcccgaaggttccccgg

SEQ ID NO: 84101 - DNA, 559 bp, Homo sapiens
  misc_feature: GYAE6OF02GOK8R.36.23.C01.1.454.CMB.1.raw
  modified_base (228)..(228): a, c, t, g, unknown or other
  misc_feature (228)..(228): n is a, c, g, or t
  modified_base (323)..(323): a, c, t, g, unknown or other
  misc_feature (323)..(323): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagacctcctggacagtcgatcaccatctcctgcactggaaccngcagtgacgttgtgcttataattatgtctcctggttccaacagcattcaggcagcgccccgaactcttaattatgaggtctttcgtcggccctcngggtttctagtcgcttctccggctccaagtctggcaacacgcctccctcgaccactctctacgactccacggctgacgggacgacggcgtgtattagttactcgttaccgtctactactacgtacgacggtacgttacgttgtccgttttcggccgggtcgcgaccccgaccgtcgtcccggtaccgtacggtccaccggccgacggcctccgtaccccgtcggtccgccttcccg

SEQ ID NO: 84102 - DNA, 528 bp, Homo sapiens
  misc_feature: GYAE6OF02IHQHT.36.23.C01.1.454.CMB.1.raw
  modified_base (198)..(198): a, c, t, g, unknown or other
  misc_feature (198)..(198): n is a, c, g, or t
  modified_base (227)..(227): a, c, t, g, unknown or other
  misc_feature (227)..(227): n is a, c, g, or t
  modified_base (303)..(303): a, c, t, g, unknown or other
  misc_feature (303)..(303): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacngtcgatcaccatctcctgcactggaaccngcagtgacgttggtgcttataattatgtctcctggttccaacagcattcaggcagcgccccgaaactcttaatttntgagttctttcgtcggcctcgtagggtttctagtcgcttctccggctccaagtctgcacacgcctcctcgaccatctctagactccaggtctggaggacgaggctgactattattgacagctcattactactgaagtcaatgtactccagtgactggttcggacggtagggaccctaaggttcggacccgttcgttaacggtacctacggaccccgaaggtcccg

SEQ ID NO: 84103 - DNA, 609 bp, Homo sapiens
  misc_feature: GYAE6OF02HFZXF.36.23.C01.1.454.CMB.1.raw
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagctcctggacagtcgatcaccatctcctgcacgtcggaaccagcaggtgacggttggtgtcttataattatgtcctcctggttaccaacagctattcgaggcaggccgaccccgtaaacttcttaaatttatggtaggttctttcggtccggtcccttcgtacggggtttctagtcgtctttccgtccggtctccaacgtctcggactaacgaccgtccctccgtgacctactcctctacgtactccgaggtctagggacggacggagcttagtacttattatcgctagtctactattactactgtaacgttactaagttcgtactccgtagtcggtcttacgggttcgggacgggtacgggaaccgtaacggttcggtacccgttacggtacggtacctacggtacccggaaggtcccgg

SEQ ID NO: 84104 - DNA, 679 bp, Homo sapiens
  misc_feature: GYAE6OF02IT70K.36.23.C01.1.454.CMB.1.raw
  modified_base (248)..(248): a, c, t, g, unknown or other
  misc_feature (248)..(248): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctcctgcacgtcgaaccagcaggtgtacgttggtntacttaattaattatgttcctctcggtaccaacgacgctattcgacggcacggaccgacccgtaaacttctttaaattagtggtacgttcgtttcggtccggtcccttaggtacgggtttctacgtccgtctttccgccgtctacagtcgtgaccaaccgccgccctaccacgacctactctacgtacgcctacgagtcgtacggaggacgacgtacttacgtacttagttattcgactacggtactactaattacgttacgtaacggtaacgttacgttaagttcggttaactaccgtacggttcgggttacggtttccgggttaacgggggtaccggtaacgggttaacccggttaaggtttacccggtaacccgggttaccgttaaccgggtaccggaaacccggttacccggaaccgggttaccccg

SEQ ID NO: 84105 - DNA, 514 bp, Homo sapiens
  misc_feature: GYAE6OF02F65MG.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactctaatttatgaggtctttcgtcgccctcaggggtttctagtcgcttctccggctccaagtctggcaacacggccctccctgaccatctctagacctccaggctgaggacgaggctgacttattattgcagctcattatactgaagtcaatggtatccatgctgttcgggcggtacgggacctaagttggaccgtccgtaggctacgcccgaaggtcccg

SEQ ID NO: 84106 - DNA, 179 bp, Homo sapiens
  misc_feature: GYAE6OF02IGEXL.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcacctcctcactcagggcacagggtcctgggcccagtctggcctgacacagcctgctccgt

SEQ ID NO: 84107 - DNA, 517 bp, Homo sapiens
  misc_feature: GYAE6OF02I99OO.36.23.C01.1.454.CMB.1.raw
  modified_base (216)..(216): a, c, t, g, unknown or other
  misc_feature (216)..(216): n is a, c, g, or t
  modified_base (271)..(271): a, c, t, g, unknown or other
  misc_feature (271)..(271): n is a, c, g, or t
  modified_base (362)..(362): a, c, t, g, unknown or other
  misc_feature (362)..(362): n is a, c, g, or t
  modified_base (376)..(376): a, c, t, g, unknown or other
  misc_feature (376)..(376): n is a, c, g, or t
  modified_base (379)..(379): a, c, t, g, unknown or other
  misc_feature (379)..(379): n is a, c, g, or t
  modified_base (383)..(383): a, c, t, g, unknown or other
  misc_feature (383)..(383): n is a, c, g, or t
  modified_base (387)..(387): a, c, t, g, unknown or other
  misc_feature (387)..(387): n is a, c, g, or t
  modified_base (390)..(390): a, c, t, g, unknown or other
  misc_feature (390)..(390): n is a, c, g, or t
  modified_base (397)..(397): a, c, t, g, unknown or other
  misc_feature (397)..(397): n is a, c, g, or t
  modified_base (416)..(416): a, c, t, g, unknown or other
  misc_feature (416)..(416): n is a, c, g, or t
tcagtacgctgtctcacgaccggtgctcgattagtacacgtgattagggattggggggggtctcaggaggcaccgctctcaggacatctccaccatggcctgggctctgctgctcctcaccctcctcactcagggcacgagggtcctgggcccagtctggcctgacacagcctgcctccgtgtctgagactcctggacagtcgatcaccatctccngcactggaaccagcagtgacgttggtgcttataattatgtctcctggttccaacngcattcaggcagcgccccgaaactcttaatttatgagtctttcgtcggcctcgtagggtttctagtcgcttctccgctcaagtctgcaacncgcctccctgaccntcnctanctcngcngagacgngctgactattatgcagctnatactactgaatcaatggtatcctatgctggttcggcgggtacggacgtaagttacggtaccgtaccgtacggtacgacgacccgtaggccgttaccccgg

SEQ ID NO: 84108 - DNA, 639 bp, Homo sapiens
  misc_feature: GYAE6OF02H33N5.36.23.C01.1.454.CMB.1.raw
  modified_base (249)..(249): a, c, t, g, unknown or other
  misc_feature (249)..(249): n is a, c, g, or t
  modified_base (539)..(539): a, c, t, g, unknown or other
  misc_feature (539)..(539): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgccctccgtgtctgagaccttcctggacaggtcatccaccatcctcctgcactcggaaccagcagtcgacgttggngtcttataattatgttctcctggttaccaacagcattcaggcacgccgacccgaaacttctttaatttagtggtagttctttcggtccggtcccttggtacgggttttctacgttccgtcttccgtccggtcctacgtaaggtcctggaccaaccgtaccgggtccctacccgtcgaccctagtcctacgtacgactccgaggctggaacggtcgaggtctagtacttagttacttgctagtcttacaattactaccaaggtaacgttacaaagttcggtaacttaccgngttacgggtctttacgggtccgggacggacggggtaacccttaaggttccggacccggttccgtaggttacccggaaccgttaccccggaggttaccccg

SEQ ID NO: 84109 - DNA, 525 bp, Homo sapiens
  misc_feature: GYAE6OF02HPPG4.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcagcagccgacccgaaactcttaattatgagttctttcgtcggcctcgagggtttctagtcgtcttcgtccggctcaagtctggacaacaccggccctcctgacctatctctacgactccaggctgaggacgagctagtactattatgcagctacatatactgaatacagtgtactccatcgtctggttcggacggtacggaccgtaacggttcgtaccgtccgtaggtccgacgcccgtaaggtcccg

SEQ ID NO: 84110 - DNA, 817 bp, Homo sapiens
  misc_feature: GYAE6OF02F2SC9.36.23.C01.1.454.CMB.1.raw
tcagtacgctgtctcacgaccggtgctcgattagtacacgtgattagggattgggggttctcaggaggcagcgctctcaggacatctccaccatggcctgggctctgctgctcctcaccctcctcactcaggcacaggtcctgggcccagtctggcctgacacagcctgcctccgtgtctgagactcctggaccagtcgatccacccatcctcctgccactgggaacccaggccaggtgaccgttggtgcttatacttatgtccttccctggttcccaacagctacttcgaacggtcagccgtacggtaaaacttctttaaatttacttgtacggttcctttaccggtccggtcccctcgtacgggggtttttcctaacggttccgtcctttccgttcccgggtcctacccgtaaacggttccgtacggggtacccaaacccgtaacccgggtccccttaccccgttacggtaacccctaactttccctaccgttaacgaacccttccccgaacgggtcccgttacgggtaacgggaaccggtaacgggtccttacggtaacctttaacgtttaacgtttacgacctaacggtccttaaccgtaaacgtttaacgttaaaccgttaacgggtaaaacgtttacccgtaaaaacgttacgggtttaaaccttaccccgtaacgtttcgggtaccgtttacgggtttacccggggaccgggtaaaccggggtaacccgttaaacgggtttaccggtaaccccggtttacccggttaaccgggttacccgtaacccggtaccccgtaacgggttccccgg

SEQ ID NO: 84111 - DNA, 745 bp, Homo sapiens
  misc_feature: GYAE6OF02JARUH.36.23.C01.1.454.CMB.1.raw
  modified_base (233)..(233): a, c, t, g, unknown or other
  misc_feature (233)..(233): n is a, c, g, or t
tcagtacgctgtctcacgaccggtgctcgatttagtacacgtgattagggagttggggggggtctcaggaggcagcgctctcaggacatctccaccatggcctgggctctgctgctcctcaccctcctcactcagggcacagggtcctgggcccagtctggcctgacacagcctgcctccgtgtctgacgactcctggacagtcgatcaccatcgtcctgcacgtcggaaccngcagtgacgttggtgtcttataattatgtctctcggttccaacagcattcgaggccacggccgaccccgtaaacttacctttaaatttacgtagtaacgggttccgttttcggtccggtacccgtacggttacggggtttctacggtcgtcctttccggtccggtaccttacgaacggtttcgtacgggtaccaaaccggtaccggtcccctcccgtacgtaaccctcttaccgtttcaaccggtaccttacccgaggtccgtacggaacgggtaccggacggtccgtaacggtaacttaacgtttacgttcgaccgtacggtacttaccgtaacgttacgtaaccgttaaggtaacgttaactaaacggttcgttaaccgttaccgtaacgttcggttaccggtttacggtttaccgggaacgtacggggtaaccggtaaccgttaacggtttaccgggtacccgtttaccgggttaacggtaccggtaacccgtacccggttaacccggg

SEQ ID NO: 84112 - DNA, 498 bp, Homo sapiens
  misc_feature: GYAE6OF02H62J2.36.23.C01.1.454.CMB.1.raw
tcagtacgctgtctcacgaccggtgctcgatttagtacacgtgattagggattgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaattatgagtctttcgtcggcctcagggttctagtcgcttctccggctcaagtctggcacacgcctccctgaccatctctagactccaggctgaggacgaggctgactattattgcagctcatatactgaagtcaatggtatcactggctggtcggcggagggaccaagttcgaccgtcgtacggtcgacgccaaggtccg

SEQ ID NO: 84113 - DNA, 543 bp, Homo sapiens
  misc_feature: GYAE6OF02GC0E3.36.23.C01.1.454.CMB.1.raw
  modified_base (228)..(228): a, c, t, g, unknown or other
  misc_feature (228)..(228): n is a, c, g, or t
  modified_base (304)..(304): a, c, t, g, unknown or other
  misc_feature (304)..(304): n is a, c, g, or t
  modified_base (363)..(363): a, c, t, g, unknown or other
  misc_feature (363)..(363): n is a, c, g, or t
  modified_base (373)..(373): a, c, t, g, unknown or other
  misc_feature (373)..(373): n is a, c, g, or t
  modified_base (404)..(404): a, c, t, g, unknown or other
  misc_feature (404)..(404): n is a, c, g, or t
  modified_base (426)..(426): a, c, t, g, unknown or other
  misc_feature (426)..(426): n is a, c, g, or t
  modified_base (433)..(433): a, c, t, g, unknown or other
  misc_feature (433)..(433): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctctggttccaacagcattcaggcagccgccccgaaatcttaatttangagttctttcgtcggccctcgtagggtttctagtcgcttctccggctccagtctgcacncggccctccngaccatctctacgctccgaggctgaggacgngctgacttattattgcagctanatatacngtaacgtcaagttgtactccgagtcgggtcttgggttccgggacgggtaacgggtaaccctaagggttccgaaccggttccgtagggtccacggtaccccgaggtccccg

SEQ ID NO: 84114 - DNA, 531 bp, Homo sapiens
  misc_feature: GYAE6OF02F0G2Z.36.23.C01.1.454.CMB.1.raw
  modified_base (324)..(324): a, c, t, g, unknown or other
  misc_feature (324)..(324): n is a, c, g, or t
  modified_base (363)..(363): a, c, t, g, unknown or other
  misc_feature (363)..(363): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaatttatgagtctttcgtcggccctnagggtttctagtcgcttctccggctccaagtctgcaacncggcctccctgaccatctctagactccaggctgaggacgaggctgactattatgcagctcatatactgtaagtcaatggtataccgtatggtcttggttcggcgggaacgggtaccctaaggttcgacccggttccgttaggtaccgacggtaccccgaaggtccccg

SEQ ID NO: 84115 - DNA, 683 bp, Homo sapiens
  misc_feature: GYAE6OF02JBL18.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgccccgaaactctttaatttactgaggttcctttcggtcggcccttcgtaggggtttctagtcgtctttcgtccggtctaccaacgttctcggactaacgaccggtccctccccgtagaccctactcctcgtacgacctccgaagggtcttacggacgggtacggacgggtccgttagacctttaatttacgttcggacctaggtccttacgtaattacttaaccgttaggtaaacgtttacctaaaggttcggttaacttccccgtaagttcgggtccgtttcggggttccggggtaccggggtacgggggtaaacccgttaagggtttacccggtaccccggtttacccggttaacgggttacccgaacgggtaccccccggaagggttcccccgg

SEQ ID NO: 84116 - DNA, 497 bp, Homo sapiens
  misc_feature: GYAE6OF02HAZG2.36.23.C01.1.454.CMB.1.raw
  modified_base (226)..(226): a, c, t, g, unknown or other
  misc_feature (226)..(226): n is a, c, g, or t
tcagtacgctgtctcacgaccggtgctcgatttagtacacgtgattagggattgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctctgcactggaaccngcagtgacgttggtgcttataattatgtctcctgttccaacagcattcaggcagccgaccccaaactcttaatttatgaggtctttcgtcggcctcgagggtttctagtcgcttctccggctcaagtctgcaacacggcctccctgaccatctctagctccagctgaggacgaggctgacttattatgctgctacatactactgaactcgaatggtatccattggctgtcggcggaggaccaagttcgaccgtctaggcagtccgagtccg

SEQ ID NO: 84117 - DNA, 600 bp, Homo sapiens
  misc_feature: GYAE6OF02FXONW.36.23.C01.1.454.CMB.1.raw
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgacgacctcctggacagtcgatcaccatcctcctgcactggaaccagcagtgacgttggtgcttataattatgtctcctggttccaacagtcattcaggcagccgaccccgaaatctttaaatttatggagttccttttcggccgtccctcgtacggggttttctagtcgtctttcgtccggctccgaagtctggcaacgaccggtcctccctgaccattctctagacctccaggctggaggacgaggtcttgacttattattcgacagtctcaattactactagaacgttcaaagttcggtaactacccgtacgtcggtcgttcggtttacgggacgggtaacgggtaacccgtaaggttaccgtaaccccggttaccgttaaccggtccgacggtaccccggaaggttccccgg

SEQ ID NO: 84118 - DNA, 496 bp, Homo sapiens
  misc_feature: GYAE6OF02F4G25.36.23.C01.1.454.CMB.1.raw
  modified_base (226)..(226): a, c, t, g, unknown or other
  misc_feature (226)..(226): n is a, c, g, or t
  modified_base (374)..(374): a, c, t, g, unknown or other
  misc_feature (374)..(374): n is a, c, g, or t
  modified_base (422)..(422): a, c, t, g, unknown or other
  misc_feature (422)..(422): n is a, c, g, or t
tcagtacgctgtctcacgaccggtgctcgattagtacacgtgattagggattgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttgtgcttataattatgtctcctgttccaacagcattcaggcagcgccccgaaactcttaattatgagttctttcgtcgcctcaggggtttctagtcgcttctccggctccaagtctggcaacacggcctccctgaccntctctagactcaggctgaggacgaggctgacttagttattgctagctnatatactgaagtcaatgtatcatgctgttcggcggaggaccagttcgaccgtcgtaggtcacggtaccaggtcc

SEQ ID NO: 84119 - DNA, 522 bp, Homo sapiens
  misc_feature: GYAE6OF02F22JO.36.23.C01.1.454.CMB.1.raw
  modified_base (301)..(301): a, c, t, g, unknown or other
  misc_feature (301)..(301): n is a, c, g, or t
  modified_base (317)..(317): a, c, t, g, unknown or other
  misc_feature (317)..(317): n is a, c, g, or t
tcagtacgctgtctcacgaccggtgctcgatttagtacacgtgattagggattgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtcttcctggttccaacagcattcaggcagcgcccgaaatctaattangagtcttcgtcgcctnagggtttcagtcgcttctccggctccaagtctggcacgacggcctcctgacctatcctctacgactccaggctagaggacgagctgacttattattgcagctcatactatgtaatcaatcggttaatccgattggctaggttccggcggtaacgggacctaagttaggacccgttccgtaaggtccgacggtacccgaggtcccg

SEQ ID NO: 84120 - DNA, 597 bp, Homo sapiens
  misc_feature: GYAE6OF02GB0WT.36.23.C01.1.454.CMB.1.raw
  modified_base (449)..(449): a, c, t, g, unknown or other
  misc_feature (449)..(449): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctctgcactggaaccagcagtgacggttggtgacttaataattatgtctccgtggttccaatagctattcaggcagccgacccgtaaactcttaattatgtagttcttcgcgtcctagtagggttcagtcgtcttcgtccgtctaccagtcgtgacaacgccggtcctccctcgacctacttcctactacgtaccttaccgaggtcctaggaacggacgaggtcttagactttattntacgcgatctatatacgtactgtaatccgtaagtcgttaactaccgagttgggcgtttacgggtccgggacgggtacgggtaaccttaagggttccggtaacccggttcggttaacggtaccgtaccgggtacccgtacgggtccccg

SEQ ID NO: 84121 - DNA, 617 bp, Homo sapiens
  misc_feature: GYAE6OF02HA37T.36.23.C01.1.454.CMB.1.raw
  modified_base (241)..(241): a, c, t, g, unknown or other
  misc_feature (241)..(241): n is a, c, g, or t
  modified_base (315)..(315): a, c, t, g, unknown or other
  misc_feature (315)..(315): n is a, c, g, or t
  modified_base (355)..(355): a, c, t, g, unknown or other
  misc_feature (355)..(355): n is a, c, g, or t
tcagtacgctgtctcacgaccggtgctcgatttagtacacgtgattagggattgggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatctcctgcactggaaccagcagtgactttggngtacatcatgtctctgtaccaacagtacccaggacaacgccccaaatcatcattttgacgtcgtagtcggcctnaggaatttctaatcgtcttctctgctcaagtctgccaacncggccctcctcgaccatcctcgtcgggcctccgacgcctggacggacgacggctaggtactttaagtttactggtttaccctcgtactatttaccgaaggtcccgggtaagttaccgtttgggttaccgtttttcggggacccgggccgggtaaccccacccgttcggacccgttcccgtaaggttcccaacggttccccgaacggtccgttaccggtccccccgttgggttacccgtacccgttccttaccggttcccccc

SEQ ID NO: 84122 - DNA, 611 bp, Homo sapiens
  misc_feature: GYAE6OF02I57OC.36.23.C01.1.454.CMB.1.raw
  modified_base (270)..(270): a, c, t, g, unknown or other
  misc_feature (270)..(270): n is a, c, g, or t
tcagtacgctgtctcacgaccggtgctcgatttagtacacgtgattagggattggggggggtcgtcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctgttccaanagcattcaggcagccgaccccgaaatcttaattatgtaggtctttcgtcgtccctgtagggtttctagtcgtcttctccgtcgtcctacgacgtcgtacgaccgaacgccgtccctacgtacactactcgtactacgtacctcggacgtcgtacgggaacggacgtacggtacgtacgtaactttatttcgtcgactcgtactattaacgtactacgtaacggtaactactaaggttacgtacctaccgtgtcggttcggttcggggtaccgggacggggtaaccgtaacggttagtacccggtaccgttaccggtacgtaaccgcccggtacggtaccgg

SEQ ID NO: 84123 - DNA, 651 bp, Homo sapiens
  misc_feature: GYAE6OF02JFBZ9.36.23.C01.1.454.CMB.1.raw
  modified_base (169)..(169): a, c, t, g, unknown or other
  misc_feature (169)..(169): n is a, c, g, or t
  modified_base (225)..(225): a, c, t, g, unknown or other
  misc_feature (225)..(225): n is a, c, g, or t
  modified_base (264)..(264): a, c, t, g, unknown or other
  misc_feature (264)..(264): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacngcctgcctcgtgtctgagctcctggacagtcgatcacatctcctgcactggaaccngcagtgacgttggtgcttatattatgtctcgtgttcaangcattcagcagccgacccgtaatcttaattatgtagttctttcgcgtcctgtagggttctacgtcgtcttcgtccggtctaccgtaagtcgttcggactaaccgaccggtcccttcccgtacgaaccctacttacctacgtaacggtacccttaccgaacgggtcgtacgggaacgggaccgacgggtccttacggtaacttaacgtttattcgggactaacggtccttacaaagtttacttaaccgtaggttaaacgtcttaaacgtcggttaaaccgtccgaacgttcgggtcttacgggtttccggggaccgggtaagggtaaccgtaacggtttcgaccccggtttacggtaccggtaccgtacgtacccggtaaggtcccgg

SEQ ID NO: 84124 - DNA, 594 bp, Homo sapiens
  misc_feature: GYAE6OF02G0P8R.36.23.C01.1.454.CMB.1.raw
tcagtacgctgtctcacgaccggtgctcgatttagtacacgtgattagggattggggggaagaggaagactgacggtcctgtctcaggtgcagctgcagcagtcgggcccaggagtggtgaagccttcggagaccctgtccctcaccctgcgctgtgtctggagcctccctcggcggagatgaatggtggagttgggtccgccagcccccagggaaggggctgagttggattggtgaaataaatgaggaccgggggcaccaactacaatgcgtccctcaggggtcgagtcaccatatctgcagacaagtccaagaaccacttctccctgaggctgacctctgtgaccgccgcggactcggccatatattattgtgcgagtagtttttgctaggatcgttggggcggtagtcgacgtcgtggggtcaagggatcgacggtcagtcgtctcctcacgtcctccaccaacgggcccagtcccggtccttcccccgtcgggccgtcccctgtcccgtcccgacgggacgcccaacccgttcccggaagaccgccgaaccgacggcccgggaccccgttcggggccctcggtaccccgg

SEQ ID NO: 84125 - DNA, 573 bp, Homo sapiens
  misc_feature: GYAE6OF02FYUSF.36.23.C01.1.454.CMB.1.raw
  modified_base (228)..(228): a, c, t, g, unknown or other
  misc_feature (228)..(228): n is a, c, g, or t
  modified_base (270)..(270): a, c, t, g, unknown or other
  misc_feature (270)..(270): n is a, c, g, or t
  modified_base (411)..(411): a, c, t, g, unknown or other
  misc_feature (411)..(411): n is a, c, g, or t
  modified_base (433)..(433): a, c, t, g, unknown or other
  misc_feature (433)..(433): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaanagcattcaggcacgcgaccccgtaaatccttaatttatgaggttcttttcggtccggtcccgttcgtaggggttttctaggtccgcctttcgtccggctaccaagttcctggacaacgcggtccctccctgacccatcctntacgctccaggtctggagacgngctagacttattatcgacacgtctacagttactactagaagttcaagttcggtacttaccgacttggtcctaggttcgggaccggtaggtaacccgtaggttcgaccgttccgtaacggtcacggtccgtaaggtcccgg

SEQ ID NO: 84126 - DNA, 706 bp, Homo sapiens
  misc_feature: GYAE6OF02ICMK9.36.23.C01.1.454.CMB.1.raw
  modified_base (233)..(233): a, c, t, g, unknown or other
  misc_feature (233)..(233): n is a, c, g, or t
  modified_base (247)..(247): a, c, t, g, unknown or other
  misc_feature (247)..(247): n is a, c, g, or t
  modified_base (257)..(257): a, c, t, g, unknown or other
  misc_feature (257)..(257): n is a, c, g, or t
  modified_base (270)..(270): a, c, t, g, unknown or other
  misc_feature (270)..(270): n is a, c, g, or t
  modified_base (300)..(300): a, c, t, g, unknown or other
  misc_feature (300)..(300): n is a, c, g, or t
tcagtacgctgtctcacgaccggtgctcgatttagtacacgtgattagggattggggggggtctcaggaggcagcgctctcaggacatctccaccatggcctgggctctgctgcctcctcaccctcctcactcagggcacagggtcctgggcccagtctggcctgacacagcctgccctcgtgtctgagacctcctggacagtcgatccaccatcctcctgcacgtggaaccngcagtgacgttgtncttataattntgtctctgtacangctatcagcagccgacccaattcttaattngtagttcttcgtccgccctgtacgggtttctacgttccgtctttccgtccggtctttacccgaagtttccgtcggtaacctaacgaccgggtccccttacccgtcgaaccctagttccctacgtacgtaccctaccgacgggtcctacggaacggggtaccgtaagggtccttaacgggtaaacctttaggttttacctttacggacctaacggttcccttaaccgtaacgttaacgttaacccgtaaggtaaccgttaacgttaaacgttacgggttaaccctaacccgtacggttacgggttaccgttacgggggttccggaaccggggtacgggtaacccgtaagggtttcccggtaacccggtcggttaacggtcccggaacgtcccggtaaccggtcccgg

SEQ ID NO: 84127 - DNA, 504 bp, Homo sapiens
  misc_feature: GYAE6OF02GN2V7.36.23.C01.1.454.CMB.1.raw
  modified_base (423)..(423): a, c, t, g, unknown or other
  misc_feature (423)..(423): n is a, c, g, or t
tcagtacgctgtctcacgaccggtgctcgatttagtacacgtgattagggattgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaatttatgagtctttcgtcggccctcgagggtttctagtcgcttctccggctccaagtctggcaacacggcctccctgaccatctctagactccaggctgagacgaggctgactattatgcagctnatatactgaagtcaaatggtatccatgctggtcggcggagggacctagttgacccgtcgtacggtcacgcccaaggtcccg

SEQ ID NO: 84128 - DNA, 676 bp, Homo sapiens
  misc_feature: GYAE6OF02GJLEI.36.23.C01.1.454.CMB.1.raw
tcagtacgctgtctcacgaccggtgctcgatttagtacacgtgattagggattggggggaaatactttctgagactcatggacctcctgcacaagaacatgaaacacctgtggttcttcctcctcctggtggcagctcccagatgggtcctgtctcaggtgcagctgcagcagtcgggcccaggagtggtgaagccttcggagaccctgtccctcacctgcgctgtgtctggagcctccctcggcggagatgaatggtggaggttgggtccgccacgcccccgaggggaacggggctggacgttggagttgggtagaaataaagtggaggaccgggggacaccaaactacaatcgccgtcctcgacggggtcgagtcaccagtatctgcagacaaagtaccaaagaaccctacttccgtccctagacggtctacgtacccttcgtcgtcgacccggcccgccggtaccgttccggaccctaattacttaatttacgttggtacggtacggtaagttaggttttttacggccgttagggtacttcggtttacgggggtccggttagtccggtacgggttcggttacgggggttacgaaagggggtcgttaccggtaccgggttccgtaacggtttccgttacccgttcccgtacggtaccgtcccgttaacccccgg

SEQ ID NO: 84129 - DNA, 540 bp, Homo sapiens
  misc_feature: GYAE6OF02F1GKM.36.23.C01.1.454.CMB.1.raw
  modified_base (228)..(228): a, c, t, g, unknown or other
  misc_feature (228)..(228): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctctgttccaacagcattcagcagcgcccgaaactcttaatttatgagtctttcgtcggcctcagggtttctagtcgctttctccggctccaagtctggcaacacggtcctccctgaccatctctacgactccagctgaggacgaggctgacttattatcgcagtctacatactactagattcaaagttcggtaatccgtatacggtcttcggttcggacgggtacgggtaacctaaggtttacggacccggttccgtaaggtcccacgtccccaaggtccccg

SEQ ID NO: 84130 - DNA, 858 bp, Homo sapiens
  misc_feature: GYAE6OF02JW7R2.36.23.C01.1.454.CMB.1.raw
  modified_base (172)..(172): a, c, t, g, unknown or other
  misc_feature (172)..(172): n is a, c, g, or t
  modified_base (224)..(224): a, c, t, g, unknown or other
  misc_feature (224)..(224): n is a, c, g, or t
tcagtacgctgtctcacgaccggtgctcgatttagtacacgtgattagggagttggggggggtctcgaggaggcagcgctctcaggacatctccaccatggcctgggctctgctgctcctcaccctcctcactcagggcacagggtcctgggcccagtctggcctagacacngcctgcctccgtagtctagagacctccgtggacagtcgatccacatcctccngcacgtggaaccagcaggtcgacggtttggtgtcttacgtaattatgtcttccgtgttaccaacgagctacttcgacggcgtaccgtcccgtaaccccgtaaacgtttaccttttaaagtttacgtacggttaacgggtttaccttttcccgggtcccgggtaccccgttaccgggttaaccggggggtttttaccttaacggttcccggttcccgttttacccgggttcccggtcccgtttaacccggttaaaacggttccggttaccggggtccgaacccgtaacccggggtccccttaaccccgtttcgaacccgttaacgttcccggttccgggttccgggtaccctacccgtaacgggttcccctagggtaaaccggggacggtaacccggtcgttacggtttaaactttacgtttaacccgggttcgaccggtacgttaccgttaactaactttaaaccggtaaccgtaaacggttcgaaccgtactaacccgttaccgttacgtttcccggtaccgttttaaccgggaacccggttaagggaaccccggttaaggtcccgttaaccggttcggtaaccggttcggacccttaaccggaccccggttaacccggaacccttaccccgg

SEQ ID NO: 84131 - DNA, 651 bp, Homo sapiens
  misc_feature: GYAE6OF02GX1HA.36.23.C01.1.454.CMB.1.raw
tcagtacgctgtctcacgaccggtgctcgatttagtacacgtgattagggattggggggggaaatactttctgagactcatggacctcctgcacaagaacatgaaacacctgtggttcttcctcctcctggtggcagctcccagatgggtcctgtctcaggtgcagctgcagcagtcgggcccaggagtggtgaagccttcggagaccctgtccctcacctgcgctgtgtctggacgcctccctcggcggagatgaatggtggagttgggtccgccacgcccccgagggaaggggcgtggagttggagttggtagaaataaagtggacggaccgggggacaaccgaaactaacgaatacggccgtaccctcgacgggggtcgaacgtcaacctatactactcgcagtaacaacgtaccaaacgaaccctacttccgtaccctgacggcctacgtacctcgtcggtcgtacccggcccggcggaccgtccggacctatattattattgcgtacggtagttaggtttttcgacgtaggtacgttcggttaggggcggttagttcggtacggtcggttcgggggtaacggaagggtaccgtcgtacggttacgacgttccggtccttacccgtccgtaccgtcccgtaacccgg

SEQ ID NO: 84132 - DNA, 628 bp, Homo sapiens
  misc_feature: GYAE6OF02J1LEY.36.23.C01.1.454.CMB.1.raw
tcagtacgctgtctcacgaccggtgctcgatttagtacacgtgattaggagttgggggggtcgtcgaggaggcagcgctctcaggacatctccaccatggcctgggctctgctgctcctcaccctcctcactcaggcacagggttcctgggcccagtctggcctgacacagtcctgcctccgtgtctgagctcctggacagtcgatcaccatctccgtgacactggaaccagccaagtgaccgtttggtgcttatattatgtctcctaggttccaactagcattcaggcagcgaccccgaaacttcttaaattctgtagtctttcgtcgccctacaggggttttcagtccgtctttcgtccggctaccaagtcctggccaactcggccctccgtagaccatcgtactacgactccaggcctagacggacgagggctggtacctagttactttcgctacggacttcctattactaacctaggtaattaccaaagtcgggttaatcccgttacgtcgggtccgtttagggttccgggtaccgggtacggggtaaccctaaggggttttaccggaacccgttttaccggaaccggtttaccggaaggtaccccccgaaaggggttcccccg

SEQ ID NO: 84133 - DNA, 642 bp, Homo sapiens
  misc_feature: GYAE6OF02F2HN2.36.23.C01.1.454.CMB.1.raw
  modified_base (267)..(267): a, c, t, g, unknown or other
  misc_feature (267)..(267): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttatattatgtctctgttccaanagcattcaggcagccgaccccgaaattcttaatttatgtaggttctttcggtcggtcccttcgtacggggttttctacggtcgtctttctccggtctccgaagtctggacaacgaccgggtccctcccgtcgaccatctactagacctccgaggcctaggacggtacgacgggtctcggaacttattacgttcgactacggtcttacaacgttacgttaacgttggaaacgttacaagttacggtaacttcccgtaacgttcgggccgtttacgggttcccggggacggggttaaccggggtaaccgttaacggtttccgggaacccggtttccggttaacggtaccgaacgggtacccccgtaaggggtccccc

SEQ ID NO: 84134 - DNA, 814 bp, Homo sapiens
  misc_feature: GYAE6OF02H1D1C.36.23.C01.1.454.CMB.1.raw
  modified_base (274)..(274): a, c, t, g, unknown or other
  misc_feature (274)..(274): n is a, c, g, or t
tcagtacgctgtctcacgaccggtgctcgatttagtacacgtgattagggagttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgtcttataattatgtctccgtggttccaacncgctattcgacggtacacgccgaccccgaaattctttaaactttatcggtacgttacctttcggtccggtacccttcgtaacggggttttactacggttccgttctttaccgtccggtacctttcccgtaaacggttccgttacggggaccctaaaccgtacccgggtcccttaccccgtttacggaaccctacgtttcccgttaccgttaaacggtaccccttaccgaacggggtccttaacggggaaacgggtaccgggtaacgggtccttacgggtaaacctttaagtttaacgtttcggaccgtaacggttccttaacgttaaactttaacgttaacccgttaacggtaaaaccggtttaccctaaagttaccgggttaaaccttaccccggtaacggttaccggggtaccgttttacggggttaaccgggggaaccggggtaaacgggtaacccgtttaaacgggttcccggttaaccccggttacccggttaacgggttacccggaaccggtaccccggtaacggttcccccgg

SEQ ID NO: 84135 - DNA, 500 bp, Homo sapiens
  misc_feature: GYAE6OF02GI239.36.23.C01.1.454.CMB.1.raw
  modified_base (227)..(227): a, c, t, g, unknown or other
  misc_feature (227)..(227): n is a, c, g, or t
  modified_base (398)..(398): a, c, t, g, unknown or other
  misc_feature (398)..(398): n is a, c, g, or t
  modified_base (418)..(418): a, c, t, g, unknown or other
  misc_feature (418)..(418): n is a, c, g, or t
tcagtacgctgtctcacgaccggtgctcgatttagtacacgtgattagggattgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaactagcattcaggcagcgcccgaaactctaatttatgagttctttcgtcgcctcgagggtttctagtcgtcttctccggctcaagtctgacacacggcctcctgaccatctctagactcgagctgagacgngctgacttattatgcagctnatatactgaagtcaatgtatcactgctggttcggcggacggactaggttcgaccgttcgtacggtacacgacccgagtcccg

SEQ ID NO: 84136 - DNA, 890 bp, Homo sapiens
  misc_feature: GYAE6OF02JLZF7.36.23.C01.1.454.CMB.1.raw
  modified_base (242)..(242): a, c, t, g, unknown or other
  misc_feature (242)..(242): n is a, c, g, or t
tcagtacgctgtctcacgaccggtgctcgattagtacacgtgattaggagttgggggggtcgtcgaggaggcgaccgctctcaggacatctccaccatggcctgggctctgctgctcctcaccctcctcactcagggcacagggtcctgggcccagtctggcctggacacagcctgcctccgtagtcctagagtactcctggacaggttcgatccaccatcctcctgcctactggaaacccngcaggttcgacgtttgggcgtcttaagtaattatcgttccttccgttacggttaccctaaacgaggtacctaactttaccgaacggcccgacggtacccggacccccccggtaaaaactttccgttttaaactttttaacgtcggttaacggtttccgtttttcccgggttacccgggtcccccctttaggttaaccggggggtttttcctaacggttccggtcccgttttaccgtacccccgggcctttacccgtaaaggttcccggttaggaccccgtaaaaccggtaccccggggtcccttcccccggtagtaaccccgtactttaccgttcctttaacgggaacccttccccggaaacggggtccttaaggggaaccgggaccgggaccgggttacctaacggtaaccttttaacgtttaacgttccggacgtaccggtacctttaccgaaagtttaaccgtaacggttacgttaaacggttaccgttaaaggtttaccggtaaaccttcccgtaagttccggggtaccttttgggggacccgggtaaccgggggttaacggaaaccgtttaacgttccgggtaacccgttcggttaaccgggtccaacccgggtaccccggttaagggtacccttccccgggg

SEQ ID NO: 84137 - DNA, 537 bp, Homo sapiens
  misc_feature: GYAE6OF02F209C.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatctcctgcactggaaccagcagtgactttggtgtaacaatcatgtctcctggtaccaacacgtacccaggacaaacgacccccaaactcatcatttttgacgtcggtagtcgcctcagtaatttctaatcgtcttctctgctcaagtctgccaacacggccctccctgacctatctcgtcgggcctccacgcctgacggacgaggctgtattattacttgttcctcactattcagccgtagttacgttcgtcgtttcggcggtcgaccctacgtcgaccgtccgtaggcacgcccaggcctcgccccgtcgtcacttcctcgtcccc

SEQ ID NO: 84138 - DNA, 519 bp, Homo sapiens
  misc_feature: GYAE6OF02FF252.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtcttcctggttccaacagcattcaggcagcgccccgaaactcttaatttatgaggttcttttcgtcggtcccctcgaggggttttctagtcgtctttctccggctccaagtctggcaacacggccctcctgacctatctctagactccaggctgacggacgaggctgacttattatgcagctcatatactgaatcaatggtatccatgctggttcggcggacggaccaagttcgaccgtcgtaggtcacgtcccgaaggtcccg

SEQ ID NO: 84139 - DNA, 684 bp, Homo sapiens
  misc_feature: GYAE6OF02JCIQ2.36.23.C01.1.454.CMB.1.raw
  modified_base (244)..(244): a, c, t, g, unknown or other
  misc_feature (244)..(244): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcgtcctgcactggaaccagcagtgacgttggtncttataattatgtctccgttgttccaacagctattcaggcagccgaccccgtaaacttcttaatttatgtaggttctttaccgtccggtccctgtacgggtttctagtcgtctttcgtccggtctccgaagttcgtacggacctaacgaccggtccctccgtacgacctacttcgtactacggtacctccgaggtcgtaggtaaccggacgaacgggtcttaggtaaccttatttaacgttcggactaacggtcttactaagtttacgtaaccttaggtaaacgttacctaaagttcggttaaacttacccgtaacgttcggtaccgtttacgggtttaccggggaccgggttaaacggggtaaccccgttaagggtttacccggtaacccggttaccgttaacgggtaccctaaccggtaccccgtaacgggttcccgg

SEQ ID NO: 84140 - DNA, 661 bp, Homo sapiens
  misc_feature: GYAE6OF02HZ56N.36.23.C01.1.454.CMB.1.raw
  modified_base (273)..(273): a, c, t, g, unknown or other
  misc_feature (273)..(273): n is a, c, g, or t
  modified_base (306)..(306): a, c, t, g, unknown or other
  misc_feature (306)..(306): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgccctccgtgtctgagacctcctggacagtcgatccaccatcctcctgcactggaaccagcagtgacgttggtgcttataattatgtctcctggttcaacngcattcaggcacgcgaccccgaactcttaattntgtaggttctttcgtccggtccttcgagggtttctagtcgtctttcgtaccggtctaccgtaagtcgtcggaccaaccgaccggtcccttcccgtcgtacccaattccttactacgtacctccgtaacgggtccgttaggacgggaccggtacggtcgtacggtaacctttatttacgttcgacacggtcttactaagttaacgttactaggtaaacgttactaagttacggtaacttacccgagttcgggtaccgtttcgggttccgggacggggtacgggtaacccttaaggtttcccggtaaccgttacccgttaacgggttacccgaccggtaccccgaaggttcccccgg

SEQ ID NO: 84141 - DNA, 627 bp, Homo sapiens
  misc_feature: GYAE6OF02I06J3.36.23.C01.1.454.CMB.1.raw
  modified_base (242)..(242): a, c, t, g, unknown or other
  misc_feature (242)..(242): n is a, c, g, or t
  modified_base (269)..(269): a, c, t, g, unknown or other
  misc_feature (269)..(269): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggngcttaataattatgtctcctgtccaangcattcagcacgcgccccgaactcttaattatgagtctttcgtcggtcctcgtagggttctacgtcgcttcgtccgctccagtctggcaacgaccgcctccctgacctatcctctacgacctccgaacggtctaggacgggtacgacgggtccttaggtacttactttagttcgtccgaacggtaccttacctaattacgttacgtaaacggtaacgttacgtaaagtttcgggttaaccttaccgtaccgttcgggtaccgtttcgggttaccggggtacgggtaacggggtaacccttaagggtttccgtaaccccggttcccgtaagggtaccaccggtacccgtaagggtcccc

SEQ ID NO: 84142 - DNA, 549 bp, Homo sapiens
  misc_feature: GYAE6OF02F949B.36.23.C01.1.454.CMB.1.raw
  modified_base (230)..(230): a, c, t, g, unknown or other
  misc_feature (230)..(230): n is a, c, g, or t
  modified_base (380)..(380): a, c, t, g, unknown or other
  misc_feature (380)..(380): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgccctccgtgtctgagactcctggacagtcgatcaccatctcctgcactggaaccngcagtgacgttggtgcttataattatgtctcctggttccaacagcattcagcagcgccccgaaactcttaatttatgaggttctttcgtcgtccctcgagggtttctagtcgcttcgtccggctccaagtctggcaacgacggcctcccngacctactctctagactccaggctgacggcgaggctgactagttatcgctagctcatatacgtagtaagtacaaagtggtaactacctacgttgcgttggttcgggacgggacgggtaacctaggttacgacccgttccgtacgggtcaaccggtacccgaaggtcccg

SEQ ID NO: 84143 - DNA, 558 bp, Homo sapiens
  misc_feature: GYAE6OF02GPN5Z.36.23.C01.1.454.CMB.1.raw
  modified_base (304)..(304): a, c, t, g, unknown or other
  misc_feature (304)..(304): n is a, c, g, or t
  modified_base (374)..(374): a, c, t, g, unknown or other
  misc_feature (374)..(374): n is a, c, g, or t
  modified_base (469)..(469): a, c, t, g, unknown or other
  misc_feature (469)..(469): n is a, c, g, or t
tcagtacgctgtctcacgaccggtgctcgatttagtacacgtgattagggattgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtattataactttgtctcctggtaccaacagcacccaggcagacgacccccaaatcatgatttangagtcagaaatcgcctgtagggtttctgatcgctttctctggctcaagtctggcacgaccggccctccgngaccctatcctcgtcgggcctccgagcctaggacggacggtaggctagtatttacttacgtgaccacgtctacattaactaactaagtagccaanccacttccgtacgttcttaccgggaactacgggaacctaaggtacctacgtcgtacccgtagggtacaccggtaccccacggtaacccc

SEQ ID NO: 84144 - DNA, 693 bp, Homo sapiens
  misc_feature: GYAE6OF02JO5Y8.36.23.C01.1.454.CMB.1.raw
  modified_base (634)..(634): a, c, t, g, unknown or other
  misc_feature (634)..(634): n is a, c, g, or t
tcagtacgctgtctcacgaccggtgctcgatttagtacacgtgattagggattgggggggaaatactttctgagactcatggacctcctgcacaagaacatgaaacacctgtggttcttcctcctcctggtggcagctcccagatgggtcctgtctcaggtgcagctgcagcaggtcgggcccaggagtggtgaagccttcggagaccctgtccctcacctcgcgcctgtgtctggacgccctccctcggcgggagatcgaagtggtggagttcgggtccgccacgcccccgaggggacgggctagaggttggagttggagtaataagtggacggacggggacaaccaacgtacgaactgtccgtaccgtcgtagggtacgacgtacaacgatatcgtcgacagtaacaacggttacccaaacgtaacccactttacctacccgtagaacggtcctacggtaccctcgttcggacgtacccgggcccgtaccggaccgtacccggaccgttaacttaacgtttacgtttaagtttcggtacggttaccggtaggtttacggtttttacgacggtaggtacgtttcgggttacggggacgttcgtacggtacgttcggtagggtcgtaacgggtntaccgttaacggtgttacgttaccggttccgtacccgtacgtccggtacccctacccgg

SEQ ID NO: 84145 - DNA, 667 bp, Homo sapiens
  misc_feature: GYAE6OF02JIZXO.36.23.C01.1.454.CMB.1.raw
  modified_base (181)..(181): a, c, t, g, unknown or other
  misc_feature (181)..(181): n is a, c, g, or t
  modified_base (242)..(242): a, c, t, g, unknown or other
  misc_feature (242)..(242): n is a, c, g, or t
  modified_base (290)..(290): a, c, t, g, unknown or other
  misc_feature (290)..(290): n is a, c, g, or t
  modified_base (364)..(364): a, c, t, g, unknown or other
  misc_feature (364)..(364): n is a, c, g, or t
tcagtacgctgtctcacgaccggtgctcgattagtacacgtgattagggagttggggggggtcgtcgaggaggcgaccgctctcaggacatctccaccatggcctgggctctgctgctcctcaccctcctcactcagggtcacgacgggtccgtgggcccacggtcgtcggcctagacacngtcctgcctccgtgtctgacgactcctggacagtcgatccacatcgtcagcactggaaccngcagtgacgtttggattatacttgtctcgtgtaccaagagccaaccgnggccagaccgccccaaaatcatcgtaatttacagtggtacagtaacgtccgggtcccacggtaggggtttaccnggaagtccgtactttccggtacttcgggccttaccgaacgtctcgaaccccgaacgtaccggtcccctccggttcaaccgtacctttcgcgttcccgggtacctcccggtaccgaccgttacggaacggaacgcggtcggtatacgtttacgtacgtttcctcccgtacacttactaccgtaggaccgtacggttacgtcggttactttccgggccgtccgacccgttacgccgtaccgtaccggtgtacccgaggtacccgtacggttaccgcccggttaccccgtcggtacctacctccgg

SEQ ID NO: 84146 - DNA, 587 bp, Homo sapiens
  misc_feature: GYAE6OF02FJLJ1.36.23.C01.1.454.CMB.1.raw
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
tcagtacgctgtctcacgaccggtgctcgattagtacacgtgattagggattggggggggtctcaggaggcaccgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggngcttataattatgtctcctggttccaacagcattcaggcagcgccccgaaactcttaatttatgagtctttcgtcggccctcgtagggtttctagtcgtcttctcggctcaagtctggcaacacggcctccctgaccatcctctacgacctccgaggctggacggacgaggctggtaactagtttattcgctagcctacaatacttactagtaaacgttactaaagttggttaactcccgttaacgtgggtccttggttccggggtacgggaacgggaccctaagggtttaccgaacccggttaccgtacgggttaccacggtaccctaagggtccctaccccggg

SEQ ID NO: 84147 - DNA, 576 bp, Homo sapiens
  misc_feature: GYAE6OF02IDY4J.36.23.C01.1.454.CMB.1.raw
  modified_base (276)..(276): a, c, t, g, unknown or other
  misc_feature (276)..(276): n is a, c, g, or t
  modified_base (352)..(352): a, c, t, g, unknown or other
  misc_feature (352)..(352): n is a, c, g, or t
  modified_base (367)..(367): a, c, t, g, unknown or other
  misc_feature (367)..(367): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgccctccgtgtctgacgacctccgtggacagtcgatccaccatctcctgcactggaacccagcagtgacgttggtgcttataattatcgtctctcggttccaanagctattgagcacgccacccgtaattctttaattatgtacgttcttcgtcgcctgtacgggttctagtcgtcttcncgctcagctgacacncggtccctctacgacctactctctacgctcgagtcgtaggacggacgtcggacttacgtacttattacgtgacacgtctactatactacgtacgtaatacgtaagttacgtactactacgtcggtcgttcggtcgggtacgggtaacggtacccgtaggttaccggtaccggttcgtaacggtaccaaccggtcccgaacggtccccgg

SEQ ID NO: 84148 - DNA, 754 bp, Homo sapiens
  misc_feature: GYAE6OF02IZG6J.36.23.C01.1.454.CMB.1.raw
  modified_base (284)..(284): a, c, t, g, unknown or other
  misc_feature (284)..(284): n is a, c, g, or t
tcagtacgctgtctcacgaccggtgctcgatttagtacacgtgattagggagtttggggggggtctcaggaggctagcgcgtctcaggacatctccaccatcggcctggctctgctgctcctcacctcctcactcagggctacagggtcctgggcccagtctggcctgacacagccctgccctccgtgtctgacgacctccgtggacagtcgatccaccatcctcctgctacctggaacccagcagtgacgttggtgcttatattatgtactcctgttaccaanagcattcaggctagcgccccgaaactcttaatttatgaggttctttcgtcggcccttcgagggtttctacgtcgcctttcgtccggtcctaccaacgtctcgggacaaccgacggtccctcccgtacgaccctaacttccgtcctaagtacccttcccggaacggtccttacgggaacggggtaccggtaaacggggtcccttaggtaaacccgtttagtttttaaacgtttacggacgttaaacgggtcctttacctaaacgtttaaccgtaaaccggttcggttaaaaacgttaccgtaaaaggtttacgggtttaaccttaccccgtaacgtttaccggggtccgtttacgggttttcccggggcggggttaaacccggggtaacccgttaaagggtttacccgggtacccgtttacccggttaaccggggtttacccgaacggtaccccggaaacgggttccccgg

SEQ ID NO: 84149 - DNA, 632 bp, Homo sapiens
  misc_feature: GYAE6OF02G5NRD.36.23.C01.1.454.CMB.1.raw
  modified_base (229)..(229): a, c, t, g, unknown or other
  misc_feature (229)..(229): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttgtgcttataattatgtctcctggttccaacagcattcaggcagccgacccgaaactcttaatttatgtagtctttcgtccgtcctcgtacgggttctagtcgcgttctccggtctccaagtcgtggacaacgaccggccctcccgtacgacctacttacctctaacgaccttaccgacggtctacggaagggacgacgggtcgttacgactttaacgttatttcgacctaggtccttacgtaagttaactaaccgttaaggtaaacgttacctaaaggttacggtaaccttaccgaaccgttcggtaccgtttagggttccgggacgggtacgggtaacccgtaaggtttcgaccgttccgtacggtacccaacggtccccgtaaggtcccg

SEQ ID NO: 84150 - DNA, 677 bp, Homo sapiens
  misc_feature: GYAE6OF02G05DP.36.23.C01.1.454.CMB.1.raw
  modified_base (230)..(230): a, c, t, g, unknown or other
  misc_feature (230)..(230): n is a, c, g, or t
  modified_base (269)..(269): a, c, t, g, unknown or other
  misc_feature (269)..(269): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgccctccgtgtctgagacctcctggacagtcgatcaccatctcctgcactggaaccngcagtgacgttggtgcttatattatgtctctgttccaanagcattcaggcagccgaccccgaactcttaatttatgtaggttctttcgtccgtcctcgtacgggtttctacgtcgtctttcctccggtcctaccgtaacgttccgtcggacctaaccgaccggtcccctacccgtacgaccctacttacctaccgtaacgtaccttcccgaagggtcctaggtacgggaaccggtagggtccttaggaaccttttaagttacgttacgactaacgtccttaccgtaatttaactaccgttaacggaaacgtttcaaagttaggtttaaactccccgtaagttcggtccgttacgggtttcccgggacgggtaaccgggaaccttaagggttaccggaacccggtttacggttacgggtaccaaccgggtacccgtaagggttccccg

SEQ ID NO: 84151 - DNA, 558 bp, Homo sapiens
  misc_feature: GYAE6OF02JAKOA.36.23.C01.1.454.CMB.1.raw
  modified_base (266)..(266): a, c, t, g, unknown or other
  misc_feature (266)..(266): n is a, c, g, or t
  modified_base (301)..(301): a, c, t, g, unknown or other
  misc_feature (301)..(301): n is a, c, g, or t
  modified_base (339)..(339): a, c, t, g, unknown or other
  misc_feature (339)..(339): n is a, c, g, or t
  modified_base (417)..(417): a, c, t, g, unknown or other
  misc_feature (417)..(417): n is a, c, g, or t
  modified_base (427)..(427): a, c, t, g, unknown or other
  misc_feature (427)..(427): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctcctgcactggaaccagcagtgacgttggtgcttatatatgtctctgtccaanagcattcagcagccgaccccgaaatcttaatttanggtagtctttcgtcggtcctcgtacgggtttctagtcncttctccggctccaagttcacggtcaaccacggtcctccctgacctactctactagacctcgagctaggaggcgacgnagacttattntagcagctactatactactagaacgtctaaagttcggtaactccgtacgttcggtcgttcgggttccgggacggtaacgggtaacctaggttacggaccgttcggttaagcaaccggtccgaaggtccccg

SEQ ID NO: 84152 - DNA, 526 bp, Homo sapiens
  misc_feature: GYAE6OF02FGPBK.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttatattatgtctcctggttccaacagcattcaggcagccgaccccgaaactcttaatttatgaggttctttcgtcggccctcgagggtttctagtcgcttctccggctccaagtctggcacacggcctccctgaccatctctagactccaggctggacggacgaggctagacttattactgcagctcatatactgaagttcaatcggtatccactggactggttcggcggacgggtaccaggttcgacccgttcgtacggtcacggtacccgaaggtcccg

SEQ ID NO: 84153 - DNA, 698 bp, Homo sapiens
  misc_feature: GYAE6OF02ICSXF.36.23.C01.1.454.CMB.1.raw
  modified_base (275)..(275): a, c, t, g, unknown or other
  misc_feature (275)..(275): n is a, c, g, or t
  modified_base (278)..(278): a, c, t, g, unknown or other
  misc_feature (278)..(278): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgccctccgtgtctgagacctcctggacagtcgatcaccatctcctgcactggaaccagcagtgacgtttggtgcttataattatgttcctccgtgtaccaancgntattcgagcacggcccgtaacccgtaaacttctttaatttacgaggtacgttttcctttccggtcccggtccctaggttacgggttttctacgttccgtcttccgtccggtccttacgacgttcgtcggaaccaacgtacccggtccctccgtacgacctactcctacgtacgtacctccgagtcgtaggacggtacgacggtccgttaacgtaactttaagtttagttccgacgtacgttctacctaagttaccgttacgttaagtaacgttaacttaaggttacggttaacctaccctacggttcggttaccggttcggttaccggggaacggtaaccgggtaaccgttaacggttacccggtacccggttaccggtaacggtacccggaacccggttacccggtaacggtcccccgg

SEQ ID NO: 84154 - DNA, 625 bp, Homo sapiens
  misc_feature: GYAE6OF02HQT3P.36.23.C01.1.454.CMB.1.raw
tcagtacgctgtctcacgaccggtgctcgatttagtacacgtgattagggattgggggggaaatactttctgagactcatggacctcctgcacaagaacatgaaacacctgtggttcttcctcctcctggtggcagctcccagatgggtcctgtctcaggtgcagctgcagcagtcgggcccaggagtggtgaagccttcggagaccctgtccctcacctgcgctgtgtctggacgcctcctcggcggagatgaatggtggagttgggtccgccacgcccccgagggaaggggctggagttggattggtagaaaataagtggaggaccgggggcaaccgaactaacgaatcgccgtcccgtcgaggggtcgagtcacatactctgacagacaacgtaccaacgaacctacttcctccctagacggtctacgaccctcgtcgtaccgaccggcccggacggacgtccggacctaacgttacttattatggtgtacgtagttagttttcgacgtaggtacttcggttgggtcggttagtcggtacggttcggttacggggtcgtaacgggtcgtacgtaccggtcgtacgttcggttaccgttccctacgtaccgtccctaccccgg

SEQ ID NO: 84155 - DNA, 659 bp, Homo sapiens
  misc_feature: GYAE6OF02FVG7S.36.23.C01.1.454.CMB.1.raw
  modified_base (238)..(238): a, c, t, g, unknown or other
  misc_feature (238)..(238): n is a, c, g, or t
  modified_base (331)..(331): a, c, t, g, unknown or other
  misc_feature (331)..(331): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacgagggtcctgggcccagtctggcctgacacagcctgcctccgtgtctgagacctccgtggacagtcgatccaccatcctccgtgacacgtcggaaccngcaggtcgtacggttggtgtcttaataagtttatgtcctccgtggttaccaacagctattcgaggcacgccgaccccgtaaatcttaatttgngtagttcttcgccgtcctgtagggttctagtcgtcttcgccggtctacgagtcgtaggacaacgccggtccctacccgtacgacctacttccgtacgtacgaccttccggtaggttacggaacgggtacggagtcgtaacgttacttagtttacgcgtacgtagtcctactattaacgtaccgtaaggtaacgttacgtaacgttacggtacttaccgtacggttcggttacggttcgggtaccgggacgggtaaccgggttacctaacggttccggtaaccgttccgtacggtaccgaccggtaccggtacggtccctacccccggg

SEQ ID NO: 84156 - DNA, 526 bp, Homo sapiens
  misc_feature: GYAE6OF02GEH3D.36.23.C01.1.454.CMB.1.raw
  modified_base (430)..(430): a, c, t, g, unknown or other
  misc_feature (430)..(430): n is a, c, g, or t
  modified_base (474)..(474): a, c, t, g, unknown or other
  misc_feature (474)..(474): n is a, c, g, or t
tcagtacgctgtctcacgaccggtgctcgatttagtacacgtgattagggattgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaatcttaatttatgaggttctttcgtcggtccctgtagggtttctagtcgctttctccggctccaagtctggcaacacggcctccctgacctatctctagactccaggctgaggacgaggctgacttattattgcagctnattatactggaatcaaattggtatccatggacttgggttccggnggtacggacctaaggttcgacccgttcgtacggtcacgtcccgaaggtcccg

SEQ ID NO: 84157 - DNA, 671 bp, Homo sapiens
  misc_feature: GYAE6OF02JA8W4.36.23.C01.1.454.CMB.1.raw
  modified_base (278)..(278): a, c, t, g, unknown or other
  misc_feature (278)..(278): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgggtctcctggacagtcgatcaccatctcctgcactggaaccagcagtgacgttggtggttataattgtctctggtaccaacagcacccgggnaactcgaccccaaaatcatgtatttatgaggtcactcagtccggcctcgtagggtttctaagtcgtcttctctcgctactcctaagtcgtcggacaaccgaccggtcccttcccgtacgaccctactccgtcggtcgggtccctccgacgggtcgtacgggaacgggaccggtacggtactttaactttacgtttacgtcgtacgtacgtttactaattaactaacccgaacctaacggtacctaaacctaccttacgttacgtaccgtttaacggtccgggaaccgggtaaccgggtaacccgaacggttacccgttaaccggttacccgttaacccgtaacggtaccgaccggtaccccggaacggttcccggtaccccgttaccccccgg

SEQ ID NO: 84158 - DNA, 705 bp, Homo sapiens
  misc_feature: GYAE6OF02H4PCA.36.23.C01.1.454.CMB.1.raw
  modified_base (269)..(269): a, c, t, g, unknown or other
  misc_feature (269)..(269): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctgttccaanagcattcaggcagccgacccgtaaacttcttaaattatcgagttctttcgccggcctcgtagggtttctacgtcgtctttctccggtctaccaaggtctacggtacaaacccgccggtccctcccgtacgtaaccccaattcccgttactacggaaccttccggaaggtaccgttacggaacgggaccgggtaacggtaccgttaggtaacctttaagtttaacttggcctaacgccgtttaaccgaattaacgttaaccgttaagtaacggttaattaaacggttacggtaaaccttcccgtaacgtttacggttaccggtaggtttacccggggaccggggttaaaccgggtaaccgttaaacgggtttaccggtaaccccgggtttcgtaacgggtaccgtaaacccggtacccgggtaaacggttccccggg

SEQ ID NO: 84159 - DNA, 540 bp, Homo sapiens
  misc_feature: GYAE6OF02FKA08.36.23.C01.1.454.CMB.1.raw
  modified_base (420)..(420): a, c, t, g, unknown or other
  misc_feature (420)..(420): n is a, c, g, or t
  modified_base (425)..(425): a, c, t, g, unknown or other
  misc_feature (425)..(425): n is a, c, g, or t
  modified_base (437)..(437): a, c, t, g, unknown or other
  misc_feature (437)..(437): n is a, c, g, or t
  modified_base (455)..(455): a, c, t, g, unknown or other
  misc_feature (455)..(455): n is a, c, g, or t
  modified_base (466)..(466): a, c, t, g, unknown or other
  misc_feature (466)..(466): n is a, c, g, or t
tcagtacgctgtctcacgaccggtgctcgatttagtacacgtgattagggattggggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgctataattatgtctcctggttccaacagcattcaggcagccgccccgaaactcttaatttatgagtctttcgtcggccctcgtaggggtttctagtcgtcttcgtccggtctcctaacgtctcggcaacaccggccctccctgaccactctctagacctccaggctgacggacgnggctnacttattatgcngctcatatactgaagtanaatggtatccngtggcttggtcggacggtacgggaccgtaagttcggaacccgttcccgtaggtaccgacgtacccgaaggtccg

SEQ ID NO: 84160 - DNA, 689 bp, Homo sapiens
  misc_feature: GYAE6OF02G5N6P.36.23.C01.1.454.CMB.1.raw
  modified_base (270)..(270): a, c, t, g, unknown or other
  misc_feature (270)..(270): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttgtgtcttataattatgtctccgtgttccaanagctattcaggcacgccgaccccgaaacttctttaatttatgtaggttctttccggtccggtccttcggtacgggtttctacggttccgtctttccgtccggccttaccgtaacgttcgtaggaccctaaaccgccggcccttcccgtgacccacttcctctaacgtcctaccgtaggtcgtaggacggtaccgagggtcttagtacctttaagtttacgttcgacgtacgtccttacgtaactttaacgtaccgttacggtaaacgttacctaaaggtttccggttaaacttcccgtaacggttcggttaccgtttacggggtttcccgggacggggttaacgggtaacccgttaacgggtttccggaacccggtttccggtacggttacccgaccgggtaccccgtaagggtccccg

SEQ ID NO: 84161 - DNA, 573 bp, Homo sapiens
  misc_feature: GYAE6OF02G4QLG.36.23.C01.1.454.CMB.1.raw
  modified_base (239)..(239): a, c, t, g, unknown or other
  misc_feature (239)..(239): n is a, c, g, or t
  modified_base (265)..(265): a, c, t, g, unknown or other
  misc_feature (265)..(265): n is a, c, g, or t
  modified_base (392)..(392): a, c, t, g, unknown or other
  misc_feature (392)..(392): n is a, c, g, or t
  modified_base (397)..(397): a, c, t, g, unknown or other
  misc_feature (397)..(397): n is a, c, g, or t
  modified_base (441)..(441): a, c, t, g, unknown or other
  misc_feature (441)..(441): n is a, c, g, or t
tcagtacgctgtctcacgaccggtgctcgattagtacacgtgattagggattgggggggggtctcaggaggcaccgctctcaggacatctccaccatggcctgggctctgctgctcctcaccctcctcactcaggcacagggtcctgggcccagtctggcctgacacagcctgcctccgtgtctgagactcctggacagtcgatcaccatctctgcactggaaccagcagtgacgttgngcttatattatgtctctggttccaanagcattcagcagccaccccgtaaacttcttaaatttatagtaggttactttcgtcggccctcgtaggggtttctagtcgtcttctccggtctccgtaagtctaggcaacgacggccctcctgaaccnctctntacgtactccgagctgagacgagctgaacttattattgcagctnattactactagaagtacaagttcggttactaccgacgttggactttcggttaccgggacgggttaacgggaacctaaggttaccgtacccgtacgtacggtaccaaccgggtccaacggtaccgtaccccgg

SEQ ID NO: 84162 - DNA, 568 bp, Homo sapiens
  misc_feature: GYAE6OF02GCT7Z.36.23.C01.1.454.CMB.1.raw
  modified_base (229)..(229): a, c, t, g, unknown or other
  misc_feature (229)..(229): n is a, c, g, or t
  modified_base (404)..(404): a, c, t, g, unknown or other
  misc_feature (404)..(404): n is a, c, g, or t
  modified_base (446)..(446): a, c, t, g, unknown or other
  misc_feature (446)..(446): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtcttcctggttccaacagcattcaggcagccgaccccgaaacttccttaaatttatgtaggttccttttcgtccggtccctcgtaggggtttctagtcgtcttctccgctcaagtctggacaacgacgccctccctgaccatctctanacctcaggctaggaggacgaggctgacttattatgcagtctnattatacgtagtaatcaaattggtaactccgaagtcggtcgttacgggttcgggacgggtacgggtacctaaggttccgaacccggttccgtagggtaccaacggtacccgaagggtccccg

SEQ ID NO: 84163 - DNA, 623 bp, Homo sapiens
  misc_feature: GYAE6OF02HK6DM.36.23.C01.1.454.CMB.1.raw
tcagtacgctgtctcacgaccggtgctcgatttagtacacgtgattagggattgggggggaaatactttctgagactcatggacctcctgcacaagaacatgaaacacctgtggttcttcctcctcctggtggcagctcccagatgggtcctgtctcaggtgcagctgcagcagtcgggcccaggagtggtgaagccttcggagaccctgtccctcacctgcgctgtgtctggacgccctccctcggcggagactgaatggtggaggttcgggtccgccacggcccccgaggggaacggggctggaggttggagttgggtagaaaataaagtggaggaccgggggacaaccgaactacaatgccgtccctcgagggtcgacgtcaccatatctgcgagaacaacgtaccaaacgaaccctacttcctacccgtagacggcctacgacccttctcgtacggacccgcccggacggaccgtccggcctagttactatttacgttgtgcgtagttagtttttgacgtaggtattcggttgggcgttagtccggtacgttcggtggggtcgaagggtactaccgtacggtacgtacgttccgtccttcccgtcaccgtccctacccg

SEQ ID NO: 84164 - DNA, 488 bp, Homo sapiens
  misc_feature: GYAE6OF02G5I5O.36.23.C01.1.454.CMB.1.raw
  modified_base (455)..(455): a, c, t, g, unknown or other
  misc_feature (455)..(455): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaatttatgagtctttcgtcggcctcagggtttctagtcgcttctccggctccaagtctgcaacacggcctcctgaccatctctagactccaggctgaggacgagctgactattatgcagctcatatactgaagtcaatgtatccactgctggtcggnggaggaccaagtgaccgtctaggtcacgccagc

SEQ ID NO: 84165 - DNA, 521 bp, Homo sapiens
  misc_feature: GYAE6OF02F5OA4.36.23.C01.1.454.CMB.1.raw
  modified_base (199)..(199): a, c, t, g, unknown or other
  misc_feature (199)..(199): n is a, c, g, or t
  modified_base (426)..(426): a, c, t, g, unknown or other
  misc_feature (426)..(426): n is a, c, g, or t
  modified_base (429)..(429): a, c, t, g, unknown or other
  misc_feature (429)..(429): n is a, c, g, or t
tcagtacgctgtctcacgaccggtgctcgattagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgggtctcctggacngtcgatcaccatctcctgcactggaaccagcagtgactttggaggtaacaatcatgtctcctggtaccaacagtacccaggcaaacgcccccaaactcatcattttgacgtcggtagtcggccctcaggtaatttctaatcgcttctctggctcaagtctgccaacacggccctccctcacctatctctagcctccaggctgaggacgaggctgactattattgctnctnatatactgaagtcaatggtactccagtgctggttcgggcgggaggacctaaggttcgaccgtccgttaggccagcccgaaggtcctacccgg

SEQ ID NO: 84166 - DNA, 542 bp, Homo sapiens
  misc_feature: GYAE6OF02JIP2N.36.23.C01.1.454.CMB.1.raw
  modified_base (229)..(229): a, c, t, g, unknown or other
  misc_feature (229)..(229): n is a, c, g, or t
  modified_base (272)..(272): a, c, t, g, unknown or other
  misc_feature (272)..(272): n is a, c, g, or t
  modified_base (354)..(354): a, c, t, g, unknown or other
  misc_feature (354)..(354): n is a, c, g, or t
  modified_base (375)..(375): a, c, t, g, unknown or other
  misc_feature (375)..(375): n is a, c, g, or t
  modified_base (460)..(460): a, c, t, g, unknown or other
  misc_feature (460)..(460): n is a, c, g, or t
  modified_base (484)..(484): a, c, t, g, unknown or other
  misc_feature (484)..(484): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacaggtcctgggcccagtctggcctgacacagcctgcctccgtgtctgagactcctggaccagtcgatcaccatctcctgcacgtggaaccngccagtgacgttggtgcttataattatgtctcctggttccaanagcattcaggcagccgacccgaaatcttaatttactgtagttctttcgtccggtccctcgtaggggtttctagtcgctttcnccggctacaagtctggcaacncggcctccgtgaccactctctagacctcaggtctacggacggacgtacggcttacgacttattatagctagctcattactacgtnaagtcaagtcgtatccgagtcgtntcggtcggacgggacggtacctaaggtttcgaccgtctacggtccacgccgaggtccg

SEQ ID NO: 84167 - DNA, 571 bp, Homo sapiens
  misc_feature: GYAE6OF02G4C37.36.23.C01.1.454.CMB.1.raw
  modified_base (229)..(229): a, c, t, g, unknown or other
  misc_feature (229)..(229): n is a, c, g, or t
  modified_base (309)..(309): a, c, t, g, unknown or other
  misc_feature (309)..(309): n is a, c, g, or t
  modified_base (352)..(352): a, c, t, g, unknown or other
  misc_feature (352)..(352): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctcctgcactggaaccngcagtgacgttggtggttataaatttgtctcctggtaccaacagcacccgggcaatcgaccccccaaaatcatgatttangaggtcactcagtcgccctcaggggtttctaatcgtcttctcngcatccaagtctggacacacggcctcctgaccatctcgtggtctccgaggctggaggaccggaaggtcttaatttctttacgtgtctgtttaccataactaccaaaccacgacaaaccacttctgtacttagttccgggacggaacgggaccaaacggtccttaccggtaccccgttacgttaacggtaccaccggacccgtacggtcccttccccggg

SEQ ID NO: 84168 - DNA, 610 bp, Homo sapiens
  misc_feature: GYAE6OF02GWSRK.36.23.C01.1.454.CMB.1.raw
  modified_base (485)..(485): a, c, t, g, unknown or other
  misc_feature (485)..(485): n is a, c, g, or t
tcagtacgctgtctcacgaccggtgctcgatttagtacacgtgattagggattgggggggaaatactttctgagactcatggacctcctgcacaagaacatgaaacacctgtggttcttcctcctcctggtggcagctcccagatgggtcctgtctcaggtgcagctgcagcagtcgggccccaggagtgggtgaagccttcggagacccctgtcccctcacctgccgctgtgtctggacgccctcccgtcggcggagatgaatggtgggagttggggtccgccgacgccccccgaggggaacggggctggagttggagttggtagaaaataaagtggaaggaccgggggcaaccaactaacaaatcggccgtccctcgacggggtcgagtccacatatctgcagacaacgtaccaaacgaccctacttcctaccctgacgctcgacctcgtgcgaccgccgcggctcggcctatatattattgngacgtagttagttttgcgtaggtagttcggttggggacgtacgtccggtacgtcggtacggggtcgtaagggtactcggtaccggtctacggttccgttcgttccgtcgaccgtccctaaccccg

SEQ ID NO: 84169 - DNA, 709 bp, Homo sapiens
  misc_feature: GYAE6OF02GJJH5.36.23.C01.1.454.CMB.1.raw
tcagtacgctgtctcacgaccggtgctcgattagtacacgtgattagggattggggggggtctcaggaggcagcgctctcaggacatctccaccatggcctgggctctgctgctcctcaccctcctcactcagggcactagggtcctggggcccaggtctagggcctgacacgagcctgcctccgtgtctgagctcctggaccagtcgatcaccatctcctgcctacgtgggaaccagccaggtcgtaacgttggtgcttataattatgtctcctggttccaacagctatttcaggtcaggccgaccccgaaactcttaatttagtgtaggttcttcgtcgtccctctagggttctagtcgtcttacgtccggctaccgaacgtcgtacggacacgacccggtccgtaccctagacctactcctctacgtaactcccaaggccttaggacggacggacggtaccgtaggtaacccttagtttaacgtttcgaccgaacgggtccttaacctaacgtttaaccgttaaccggttacggtaaacggttacctaaaacggtttacgggttaacctacccgttaacgttcggttaaccggtttcggggtttaccgggaccggggttaacgggtaaacccggtaacggttttacgggaccccggtttaccgttaaccgggttaccgaccggttaccccggacgggttaccccgg

SEQ ID NO: 84170 - DNA, 664 bp, Homo sapiens
  misc_feature: GYAE6OF02HZ5P1.36.23.C01.1.454.CMB.1.raw
  modified_base (246)..(246): a, c, t, g, unknown or other
  misc_feature (246)..(246): n is a, c, g, or t
  modified_base (270)..(270): a, c, t, g, unknown or other
  misc_feature (270)..(270): n is a, c, g, or t
  modified_base (308)..(308): a, c, t, g, unknown or other
  misc_feature (308)..(308): n is a, c, g, or t
tcagtacgctgtctcacgaccggtgctcgattagtacacgtgattagggattggggggggtctcaggaggcaccgctctcaggacatctccaccatggcctgggctctgctgctcctcaccctctcactcagggcacaggtcctgggcccagtctggcctgacacagcctgcctccgtgtctgagactccgtggacagtcgatcaccatctcctgcacgtacggaaccaggctagtgacgtttggngtcttatattatgtctctgtacanagctattcgagcagccgacccgtaactacttaatttanaggtacgttcgtttccgtccggtacctcggttagggtttcttaggtccgtcttccgtccggtctaccgtaagttcctggaccaaccgtaccggcccttacccgtacgaccctactttccgtacgtacgtaccgtaccgagggtctacgggaacggaccggtaggtacccgttagtaacctttaagtttacgtcgacgtacgtcctaaccgttattaacgttacgtacggtaacgtacttaagttacggtactaccgtagttacggtcgttaggtcccgggaagggtaccggtacgtaaggtttcccgtaccggtacgttaccgggacctacgggtacctacgggtcctaccccggg

SEQ ID NO: 84171 - DNA, 545 bp, Homo sapiens
  misc_feature: GYAE6OF02G4PB6.36.23.C01.1.454.CMB.1.raw
  modified_base (228)..(228): a, c, t, g, unknown or other
  misc_feature (228)..(228): n is a, c, g, or t
  modified_base (367)..(367): a, c, t, g, unknown or other
  misc_feature (367)..(367): n is a, c, g, or t
  modified_base (406)..(406): a, c, t, g, unknown or other
  misc_feature (406)..(406): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctcctgcactggaaccngcagtgacgttggtgcttataattatgtctcctggttccaacagcattcaggcagcgccccgaaactcttaatttatgaggtctttcgtccggccctcgtagggtttctagtcgctttctccggctcagtctggcaacncggcctcctgaccatcctctagctccaggctgaggacgnggctgactattattgcagctcattatactagaacgtactaagttgtacttccacgtggtcgttcggttcgggacggtaacgggaaccgtaaggttcggacccgttccggtacggtaccgacggtacccgaaggtccccg

SEQ ID NO: 84172 - DNA, 639 bp, Homo sapiens
  misc_feature: GYAE6OF02IQUZ0.36.23.C01.1.454.CMB.1.raw
  modified_base (200)..(200): a, c, t, g, unknown or other
  misc_feature (200)..(200): n is a, c, g, or t
  modified_base (463)..(463): a, c, t, g, unknown or other
  misc_feature (463)..(463): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgtctccgtgtctgagactcctggacngtcgatcacatctcctgcacgtggaaccagcagtgacgttggtgcttataattatgtctcctggttacaacagcattcgaggcagccgaccccgaaacttctttaatttagtgtacggttctttccggtccggtcccttcggtacggggtttctaggtccgtctttccgtccggtctcctaagtcgtacggaccaacgtaccggccctccctcgacctactctactagcctcgaggtctgaggacgaggcttagtacttattnttcgctagtctacgtattacgtacttaagtaacgttactaaggttacggtaacttcccgacgttcggtaccgtttcgggttacggggaccgggtaacgggtaacccgttaacgggtttccggtaccccggttaccgttaacgggttcccgtaaccggtacccgtaacggtccccgg

SEQ ID NO: 84173 - DNA, 770 bp, Homo sapiens
  misc_feature: GYAE6OF02IEKCI.36.23.C01.1.454.CMB.1.raw
tcagtacgctgtctcacgaccggtgctcgatttagtacacgtgattagggattgggggggaaatactttctgagactcatggacctcctgcacaagaacatgaaacacctgtggttcttcctcctcctggtggcagctcccagatgggtcctgtctcaggtgcagctgcagcagtcgggcccaggagtggtgaagccttcggagaccctgtccctcacctgcgctgtgtctggacgccctcccgtcggcggagatgaagtgggtggaggttcgggtccgccgaccggcccccggaaggggaacggggcgtggtaggttggagttggtagtaaaagtaaagtggacggaccggggacaaccgtaacgtaacgaagtcgccgtcccgtacggacggggtcgacgtaccacctagtactcgtacgacgacgtaacaacgtacccaaacgaaccctaccttaccctacccgtaggacggtccgttacgtacccttcgtacgtcggacccggccggaccggtaccgtccgggaccttagttaactttaagtttacgttcgttacgtacggttacggtttacgttttttacggacgttacgggttaacgtttccggggtttacggggtacgggtttaccgttcgggtaccgggttccgggtttacggggggttaacggtaaaccggggttacggttacccggttaaccgggttacgttaccggttaccggttccccgttcccggttacccgtacccggtaccccttaacccccggg

SEQ ID NO: 84174 - DNA, 780 bp, Homo sapiens
  misc_feature: GYAE6OF02HXVKR.36.23.C01.1.454.CMB.1.raw
  modified_base (128)..(128): a, c, t, g, unknown or other
  misc_feature (128)..(128): n is a, c, g, or t
  modified_base (169)..(169): a, c, t, g, unknown or other
  misc_feature (169)..(169): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctnactcagggcacagggtcctgggcccagtctggcctgacacngcctgcctccgtgtctgagacctcctggacagtcgatccacatctcctgcactggaaccagcagtgacgttggtgacttataattatgttcttcctggttccaacagctacttcaggcacgccgaccccgtaaacttccgtttaaattttagtcggtacggtttccgttttccggtccgggtaccccttcgggttaggggttttcctacggttccgtcctttaccgtcccggtccttacccaaaggttcgtacgggacctaaccgtacccgggccccttacccgtacggtaacccctacgttccctaccgttacggtaccctttcccgaacgggtccgttacgggaaccggggtaacggacgggtaccgttacgtaaacgttttaacgtttacgtttcggacctacggttaccttaacctaatttaaccgtaacccgtttagaaaccgtttacgaaggtttacggttaaaccttcccgtaacggttcggttcgtttaccggggttcccgggtaacggggtaccgggtaaacccgttaacgggtttccggtaaccccgggttccggttaaaccgggttcccaaacgggtacccccggtaaggttcccccggg

SEQ ID NO: 84175 - DNA, 623 bp, Homo sapiens
  misc_feature: GYAE6OF02H6P3J.36.23.C01.1.454.CMB.1.raw
  modified_base (199)..(199): a, c, t, g, unknown or other
  misc_feature (199)..(199): n is a, c, g, or t
  modified_base (229)..(229): a, c, t, g, unknown or other
  misc_feature (229)..(229): n is a, c, g, or t
  modified_base (272)..(272): a, c, t, g, unknown or other
  misc_feature (272)..(272): n is a, c, g, or t
  modified_base (346)..(346): a, c, t, g, unknown or other
  misc_feature (346)..(346): n is a, c, g, or t
  modified_base (465)..(465): a, c, t, g, unknown or other
  misc_feature (465)..(465): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgccctccgtgtctgagactcctggacngtcgatcaccatctcctgccactggaaccngcagtgacgttggtgcttatattatgttctcctggttccaacngcattcaggcagccgaccccgaaacttctttaatttgtgtacggttctttcgtcggccctgtgggtttcagtcncttcgtccgctcagtctggcacgcgcctctcgactatctctacgtacctcacggtcgtacggacggtaccggacggtactcgtaacttagtttacgttgactacggtctactaactttntaaccgtaagtaacggttacttaaaggtcggtacttaccgacgttggtaccgttcgggtttacccggggcgggtaaacggggtaccgttaaacggtttaccgggtaccccggttcgttaacgggtacccgacgggttacccccgaagggttacccccg

SEQ ID NO: 84176 - DNA, 738 bp, Homo sapiens
  misc_feature: GYAE6OF02FHG48.36.23.C01.1.454.CMB.1.raw
  modified_base (228)..(228): a, c, t, g, unknown or other
  misc_feature (228)..(228): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggtgcttataattatgtctcctggttccaacagctattcaggtcagccgaccccgaaacttacttaatttatgtacggtctttacgtccggtcccctcgtaggggtttctacgtcgtcttcgtccggtctaccgaacgtctaggaccaacgtaccggcccttcccgtacgaccctactccttactacgaccttaccgaggtccgtaggtaacgggaaccggtaagggtccttacgtaaccgtttaacgttttaacgttacgaccgtaacggtaccgttacctaaacgttaacttaacttaagggtaaacgttaccgtaaaggtttacggttaacgttaccccgttacgttacggggtaccgttagggtttcccggggaacggggtaaccgggggttaaacccgttaaaccgggttttaccgggtaaacccccggtttccggttaaaccggggttaccccgtaaacccgggttacccccggtaagggttaccccccgggg

SEQ ID NO: 84177 - DNA, 737 bp, Homo sapiens
  misc_feature: GYAE6OF02ILQQY.36.23.C01.1.454.CMB.1.raw
  modified_base (724)..(724): a, c, t, g, unknown or other
  misc_feature (724)..(724): n is a, c, g, or t
tcagtacgctgtctcacgaccggtgctcgatttagtacacgtgattagggattggggggaaatactttctgagactcatggacctcctgcacaagaacatgaaacacctgtggttcttcctcctcctggtggcagctcccagatgggtcctgtctcaggtgcagctgcagcagtcgggcccaggtagtggtcgaagcccttcggagaccctgtccctcacctgcgctgtgtctggagccctccgtcgggcgagattgaatgggtggacggttcgggtccgccgacggaccccccgaggggaacggggctggtaggttggagttggtagaaaataaagtggacggacccgggggcaaacccgtaaacgacgtaaactggtccgtacccgtacggtacggggttcgaacgttacaccgtaataacgtcgttagccaagacctaaaacggtacccgaaaacgtaaacctaacccgtttaccgtaccccgttaggacggtaccgttacgggaccctttacgttcggttaaccgtaccccggacccgtaccggtaccgttaccggaccttaaacgtacgttaagtttacgttggtacggtcgaacggttagttttttcgaacgttagtacgtttcggtcgggtacggttacgttcggaccgttggttcggggtactaagggtacgtaccggtacggttacgtacgttacgttccgttcctacggtaccncccgttaacccgg

SEQ ID NO: 84178 - DNA, 620 bp, Homo sapiens
  misc_feature: GYAE6OF02IQSBZ.36.23.C01.1.454.CMB.1.raw
  modified_base (313)..(313): a, c, t, g, unknown or other
  misc_feature (313)..(313): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcacatctctgcactgaaccagcagtgacgttggtgcttaataattatgttcctccgtcggttaccaacagctattcaggcagccgacccgtaaacttcttaatttangtagttctttcggtccggccctcgtacgggtttctacgtcgtctttccgtccggctccaagtctggaccaacgccggtccctccgtcgacctatctactacgacctccgaggtctaggaacggacgaggtcgtacgtacttagtttacgtcgacgagtcctactaattataacgttgaaacgttctaaagttacggttaactcctaacgtcggtcgttcgggttccgggacgggtagggtaacccttaagggttccggtacccggttaccgttagggtaccgaaccggtacccgaacggtaccccgg

SEQ ID NO: 84179 - DNA, 816 bp, Homo sapiens
  misc_feature: GYAE6OF02H9EFY.36.23.C01.1.454.CMB.1.raw
  modified_base (230)..(230): a, c, t, g, unknown or other
  misc_feature (230)..(230): n is a, c, g, or t
  modified_base (279)..(279): a, c, t, g, unknown or other
  misc_feature (279)..(279): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatccaccatcctcctgcactggaaccngcagtgacgttggtgacttataatttatgtccttccgtggttaccaacngctacttcacggtacacggcccgaccccgtaaacttctttaatttagtcggttacggttcctttccgggtaccggtccccttacggtacggggttttcctaggttcccgtcgttttccgcccggtacttacccgtaagttccgtacggtacaaacccgtccgggtcccctacccgttcgaacctacttccgttaccgtaaccgtaccttcccgaacgggtcttacgggaacgggtacggacgggtaccttacggtaaccttttaagtttacgtttacggactaacgggtccttaacgttaaacgtttacgttaacgtttaacgggtaaactttaaccgttaaaggttaccgggttaaacctttaaccccgtaaggtttcccggggttaacgtttttaccgggggttccgggggtaaccggggtaaccggggtaaaccccgtttaaagggtttccccgggttaacccccgggttttaacgggtaacccgggtttaccctacccggggttaaccccccggtaagggttccccccccggg

SEQ ID NO: 84180 - DNA, 661 bp, Homo sapiens
  misc_feature: GYAE6OF02ILWJS.36.23.C01.1.454.CMB.1.raw
  modified_base (239)..(239): a, c, t, g, unknown or other
  misc_feature (239)..(239): n is a, c, g, or t
  modified_base (256)..(256): a, c, t, g, unknown or other
  misc_feature (256)..(256): n is a, c, g, or t
tcagtacgctgtctcacgaccggtgctcgatttagtacacgtgattagggattggggggggaaatactttctgagactcatggacctcctgcacaagaacatgaaacacctgtggttcttcctcctcctggtggcagctcccagatgggtcctgtctcaggtgcagctgcagcagtcgggcccaggagtggtgaagcctttcggagaccctgtccctcacctgcgctgtcgtctggacncctccctcgggcggagntgaatggtggagttgggtccgccacgcccccgaggggacgggctggaggttggtagttggtagaaaagtaagtggaggaccgggggcaaccgaactacgaagtgccgtcctcgacgggtcgagtacaactatactctcgacagacaaacgtaccaaacgtaacctaccttcctaccctgacgctcgaccttcgttcgtaccggacccgcccggccggtaccgtccggacctattacttatttacgtcgtaggtcgtaggttacgtttttgacgttaggtacgttcggttcggggtacggttacgtacggttaccgttacgggttacggggtacggtaaagggtacgtaccggtacgggttccgtagttcccggttccttacccgtcgtaccggccctaaccccgg

SEQ ID NO: 84181 - DNA, 604 bp, Homo sapiens
  misc_feature: GYAE6OF02HGXD0.36.23.C01.1.454.CMB.1.raw
  modified_base (231)..(231): a, c, t, g, unknown or other
  misc_feature (231)..(231): n is a, c, g, or t
  modified_base (425)..(425): a, c, t, g, unknown or other
  misc_feature (425)..(425): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacgagggtcctgggcccagtctggcctgacacagcctgcctccgtgtctgagactccgtggacagtcgatcaccatctcctgcagtcggaaccngcagtgacgttggtgcttataattatgtctctgttacaacagctacttgagacacgaccgaccccgtaaacttctttaattagtgtacgttctttcggtccggtcctcgtagggtttctacggtcgtcttcgtccgtcctacaagtcgtcgactaaccgccggccttccgacgacctacgtctactacgtaccnccgtaggcgtaggaacggacggagtctacgtacttattaagttgacaggtctactaatactacgtagtaactagaacgttggtaacctccgtagtcgcgttcggtacgggcgggtaacggaccgttaaggttccgtaacccgtaccggtacggtaccgtacggacccgtaggtccccgg

SEQ ID NO: 84182 - DNA, 538 bp, Homo sapiens
  misc_feature: GYAE6OF02JD9AF.36.23.C01.1.454.CMB.1.raw
  modified_base (306)..(306): a, c, t, g, unknown or other
  misc_feature (306)..(306): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttcccaactagcattcaggcagcgccccgaaactcttaatttangagttctttcgtcggccctgtagggtttctagtcgctttctccggctcagtctggcacacggcctccctgaccatctctagacctcgaggtctgaggacgagctgactattatgcagctactattatacgtagtaacgtctaaagtcggttactacctacgtggtctgggttcggcggtaacggacctaaggttccgtaccgtcgtacggtccgacggtcccgaaggtcccg

SEQ ID NO: 84183 - DNA, 786 bp, Homo sapiens
  misc_feature: GYAE6OF02HP2QM.36.23.C01.1.454.CMB.1.raw
  modified_base (252)..(252): a, c, t, g, unknown or other
  misc_feature (252)..(252): n is a, c, g, or t
tcagtacgctgtctcacgaccggtgctcgatttagtacacgtgattagggattggggggggtctcaggaggcagcgctctcaggacatcctccaccatggcctgggctctgctgctcctccaccctcctcactcgagggcacgacgggtcctcgggcccagtcgtcggcctgacacagcctcgcctccgtgtcctgacgtacctccgtggactagtccgatccaccattcctcctgaccacgtacggaaccngctagtcggtacggttggtcgtactttaagtaaattgtaggttccttaccgttacggttaccaaacgtacggtactaacgttccgaacggtccgaacggtaccccgtaacccccggtaaaactttaccttttaaaagttttacgtacgggttaaccggtttccgttttacccgggttaccccggttacccgttacggggttaaccggggttttccttaacgggtttcccgttcccgtttaccccgttcccggttaccttacccgtaacgggttccgttacgggtaaccctaaccggtacccggtccccttacccgtaccgtaccctacgttacccgtacgtaaccggtacccgtacccgaggtcgtaacgggacggacggtacggcctaagttacgttattaagtcgacgtacgtcctacgtaagttactacgtagtacgttactaagtcgtactaccgtagtcggtcgttacggcgggacggaacgtacgtacggttaccgcctacggtacgccgaacgtacccgtaggcccg

SEQ ID NO: 84184 - DNA, 712 bp, Homo sapiens
  misc_feature: GYAE6OF02JWJ86.36.23.C01.1.454.CMB.1.raw
  modified_base (173)..(173): a, c, t, g, unknown or other
  misc_feature (173)..(173): n is a, c, g, or t
  modified_base (220)..(220): a, c, t, g, unknown or other
  misc_feature (220)..(220): n is a, c, g, or t
tcagtacgctgtctcacgaccggtgctcgatttagtacacgtgattagggattggggggggtcgtcaggaggcagcgctctcaggacatctccaccatggcctgggctctgctgctcctcaccctcctcactcgagggcacagggtcctgggccccagtctcggcctgacacngcctgcctccgtgtctgagctcctggacagtcgatcaccatcctccngcactggaaccagctaggtgaccggtttggtgtacttaattaagttatgttcctccgttcggttaccaacgagctattcgaggcacgaccgacccccgtaaatcctttaatttacgtgtacggttccgtttccgtccggtaccccgttcggtaacggggttttcctaggtccgtcctttcccgttcccggtaccttcccgtaaacggttccgttacgggacccaaacccggtacccgggtccccgttacccccgtacgtaaccccgtacttccgttaccctaacggtaacccttcccgaacggtcgtacggtaacgggaccggtaacggcgttacgaaccttagtttacgttacgctacggtcttactacgttaacttagtacgtaacgttaagtaacgttacggtaacttccgacgtgtacgttcgggttacgggccggtaagggacccgtagttcgaccgttcgacggtcgacggtacccgaggtccccg

SEQ ID NO: 84185 - DNA, 610 bp, Homo sapiens
  misc_feature: GYAE6OF02IMJ7P.36.23.C01.1.454.CMB.1.raw
  modified_base (379)..(379): a, c, t, g, unknown or other
  misc_feature (379)..(379): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgccctccgtgtctgagactccgtggacaggtcgatcaccatcctcctgccactcggaaccagcagtgacggttggtgcttatattatgttctcctggttccaacagctattcaggcagccgacccgaaacttcttaattatgtagttctttcgtccggtccctgtagggtttctacgtcgtcttctccgtctcaagttctggcaacncggccctcctcgacctatctctacgacctccgaggtcgtacggacggacgaggtcttacgtaacttactttagttcgctaacggtcttacgtaattaactacgttaagtaacgttacgtaaagttggtaaccttccacgttcggcgttcggttcgggaccggtacgggtaaccgtaacggtttcggtacccggttaccgttagggtacctacggacccgtaagggtccccg

SEQ ID NO: 84186 - DNA, 502 bp, Homo sapiens
  misc_feature: GYAE6OF02GXBQ0.36.23.C01.1.454.CMB.1.raw
  modified_base (424)..(424): a, c, t, g, unknown or other
  misc_feature (424)..(424): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgccccgaaactcttaatttatgtaggttctttcgtcggccctgtaggggtttctagtcgcttctccggctccaagtctgcaacacggcctcctgaccatctctagactccagctgaggacgaggctgactattattgcngctcatatactagaagtcaatggtatccgatgctggtcggcggaggacagttgaccgtcgtaggtcacgccgagtccg

SEQ ID NO: 84187 - DNA, 748 bp, Homo sapiens
  misc_feature: GYAE6OF02ILKRR.36.23.C01.1.454.CMB.1.raw
  modified_base (171)..(171): a, c, t, g, unknown or other
  misc_feature (171)..(171): n is a, c, g, or t
tcagtacgctgtctcacgaccggtgctcgatttagtacacgtgattagggagttggggggggtctcaggaggcagcgctctcaggacatctccaccatggcctgggctctgctgctcctcaccctcctcactcagggcacagggtcctcgggcccagtctggcctgacacngcctgccctccgtgtctgagactcctggactagtcgatcaccatcctcctgcacgtacggaaccagcaggtgacggttggtgtcttaataattatgttctcctcggttaccaacgtagctattcgaggcacgccgaccccgtaaaacttctttaactttagtacggtacgttctttccggtccggtcccttacggttacggggttttcgtacgttccgtcttcccgttccggtccctttaccgtaacggttcgtacgggtacctaaacccggtacccggtcccgtaccctacggtaaccctaacgttcctacgtaacgtacccgtaccgtacgggtccgtaggaacgggtacggaacgggtccttaggtaaacctttaagttacgttcgacaccggttcgtacctaattaactaacgtagtaaacgtactaacggttagtaccttaacctacgtccgggttacggtttcggggtaaccgggtacccgggtaacggggtaaaccgttaacgggttacccggtaccggttaacccggttacggggttacctaacccgggaccccgtaaggttcccccgg

SEQ ID NO: 84188 - DNA, 589 bp, Homo sapiens
  misc_feature: GYAE6OF02F4FVW.36.23.C01.1.454.CMB.1.raw
  modified_base (228)..(228): a, c, t, g, unknown or other
  misc_feature (228)..(228): n is a, c, g, or t
  modified_base (370)..(370): a, c, t, g, unknown or other
  misc_feature (370)..(370): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctcctgcactggaaccngcagtgacgttggtgcttataattatgtctcctggttccaacagcattcaggcagccgccccgaaactcttaatttatgagttctttcgtcggtccctcgtaggggtttctagtcgtcttcgtccgctccaagtctgcaacncggccctccctgaccatctctacgactccaggtctaggacggacgaggcttgacttatttacttgctacgtctcattactacgtagtaacgttacgaacttggtaactcccgtaagttcggtacgttcgggttaccgggacgggtacgggaaccgttaacggttcggacccggtttaccgtaacgggtaccgaaccggtaccccggaacggttccccgg

SEQ ID NO: 84189 - DNA, 774 bp, Homo sapiens
  misc_feature: GYAE6OF02IRBJJ.36.23.C01.1.454.CMB.1.raw
  modified_base (227)..(227): a, c, t, g, unknown or other
  misc_feature (227)..(227): n is a, c, g, or t
tcagtacgctgtctcacgaccggtgctcgattagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagactctggacagtcgatcacatctcctgcacgtggaaccngcagtgacggttgtgcttaataattatgtctcctggtttaccaacgagcatttcgacggtcacggaccgtacccccggaaaacttaccttttaaagttttacgtacggtaggttttcccgttttcggtccggttaccccgttcggttacggggttttcctacggttccgtccgttttaccgtccccggtcttacctaaacggttccgttacgggtaccaaacggtacccggtcccttccccgtacgaccctacttaccgttctaacggtacccttccgacgggttaccgtaggaacgggaaccggtacgggtccgttaacggtaaccgtttaacgttttagttaccggtctaaccggtcctttaactaacgttaactttaaccgttaagtaaacgtttaacgtaaacgtttcgggttaaaccttccctaacgggttgttaccggttgggtttaaccgggacggggtaccgggtaaaccgttaacgggtttaccgtaccggttaccggttaccggtaccggtacccggacccggtaacggtcccccgg

SEQ ID NO: 84190 - DNA, 497 bp, Homo sapiens
  misc_feature: GYAE6OF02G3PEO.36.23.C01.1.454.CMB.1.raw
  modified_base (242)..(242): a, c, t, g, unknown or other
  misc_feature (242)..(242): n is a, c, g, or t
  modified_base (285)..(285): a, c, t, g, unknown or other
  misc_feature (285)..(285): n is a, c, g, or t
  modified_base (300)..(300): a, c, t, g, unknown or other
  misc_feature (300)..(300): n is a, c, g, or t
  modified_base (375)..(375): a, c, t, g, unknown or other
  misc_feature (375)..(375): n is a, c, g, or t
  modified_base (397)..(397): a, c, t, g, unknown or other
  misc_feature (397)..(397): n is a, c, g, or t
  modified_base (408)..(408): a, c, t, g, unknown or other
  misc_feature (408)..(408): n is a, c, g, or t
  modified_base (430)..(430): a, c, t, g, unknown or other
  misc_feature (430)..(430): n is a, c, g, or t
  modified_base (439)..(439): a, c, t, g, unknown or other
  misc_feature (439)..(439): n is a, c, g, or t
  modified_base (486)..(486): a, c, t, g, unknown or other
  misc_feature (486)..(486): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggngcttataattatgtctcctggttccaacagcattcaggcagcncccgaactctattangagtcttgcgcctcagggttctagtcgctttactccggctcctaagtctggctaacacggcctcctagaccatcnctagactccgagctgaggacgnggctgactatnttgccagctcatatctgacgtnaatggtacncactgtctaggtcggaggacggactacggttgaccgtcgtacgtacncgtaccagtcc

SEQ ID NO: 84191 - DNA, 515 bp, Homo sapiens
  misc_feature: GYAE6OF02F7IJC.36.23.C01.1.454.CMB.1.raw
  modified_base (229)..(229): a, c, t, g, unknown or other
  misc_feature (229)..(229): n is a, c, g, or t
  modified_base (364)..(364): a, c, t, g, unknown or other
  misc_feature (364)..(364): n is a, c, g, or t
  modified_base (446)..(446): a, c, t, g, unknown or other
  misc_feature (446)..(446): n is a, c, g, or t
  modified_base (454)..(454): a, c, t, g, unknown or other
  misc_feature (454)..(454): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggccctgacacagcctgcctccgtgtctgagactcctggacagtcgatcaccatctcctgcactggaaccngcagtgacgttggtgcttataattatgtctcctggttccaacagcattcaggcagcgccccgaactcttaattatgtagttctttcgtcggtccctgtagggtttctagtctcttcgtccgctcagtctgcaacncggcctccctgaccatctctagactccgagctggacggacgaggctagacttagttatgcagctcattatactagacgttanaatggtanccatgctggtcggacggtaggacctaagttcgaccgttcgtacgtcacgtcccgagtcccg

SEQ ID NO: 84192 - DNA, 744 bp, Homo sapiens
  misc_feature: GYAE6OF02IRIT3.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcaggtgacggttggtgtcttaattaattattgttccttaccgtaggtttacccaacacgctattcacgggtcacggccgaccccgtaaacttactttaaatttagtcggtacggttccgttttaccggtccggtcccttacggttacggggtttcctacggttccgtactttccgtcccggtcctactaacggttcgtcggacctaaccgacccggtcccttccctacgaccctattcccgttacgtacgtaccgtccgacggtcgtacgggaacggacggacggtcttacggtacctttaagtttattaccgaccgtacgtcttaactaacgtttacgttaaccgttacggtaaacgttaccgttaaagttcggttaaacctcccgttaacgtttcggtacgtttccggggttaccgggtaaccggggtaaccgggtaaccgtaacgggtttccggtaacccggttaccggttaccgggtacccgaaccgggtaccccgtaacggttcccccgg

SEQ ID NO: 84193 - DNA, 640 bp, Homo sapiens
  misc_feature: GYAE6OF02HJNJB.36.23.C01.1.454.CMB.1.raw
  modified_base (249)..(249): a, c, t, g, unknown or other
  misc_feature (249)..(249): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcaacgagggtcctgggcccagtctggcctgaccacagcctgcctccgtgtctgacgtactccgtggacagtcatcaccatctcctgcacgtggaacagtcagtcgacgttggngtcttaatattatcgtctccgtcggttaccaacgtagctattcagcacggccgtacccgaacttacttaatttactgtacgtttcgtttcgtccgtcctggttacgggttctacgttcgtccttcgtccggtctacgtagtcgtcgacaacgacggtccctcgtacgactactctactagtccgtacacggtctaggacggtacggtagtcttaaggtacttaagtttacgttgaccgtcgcgttactaagttacgttacgagtaaactgttaaacgtcggtaacttaccgtaggtcgtaccgtttcgggtcgggacgggtacggtaaccggttaaacggttcgtaacccggttaccggtaaggtccgtaacggcccgtaagggtccccgg

SEQ ID NO: 84194 - DNA, 637 bp, Homo sapiens
  misc_feature: GYAE6OF02IUU8Y.36.23.C01.1.454.CMB.1.raw
tcagtacgctgtctcacgaccggtgctcgatttagtacacgtgattagggattgggggggaaatactttctgagactcatggacctcctgcacaagaacatgaaacacctgtggttcttcctcctcctggtggcagctcccagatgggtcctgtctcaggtgcagctgcagcagtcgggcccaggagtggtgaagccttcggagaccctgtccctcacctgcgctgtgtctgggacgcctcccctgggaccggagactgaatggtggagttgggtccgccacgcccccgaggggaacggggctgagttcggattggtgaaataagtggaggaccgggggcaaccgaactacaatgccgtccctcgagggtacgagtacaaccatatctgcagacaacgtacaacgaacctacttcctaccctgacgctcgacctctgtcgaccgccgacggacctcggacctactatatttacgttgtgcgtagttagtttttcgcgtagggtacttcgggttcggggtaccggttacgttaccggtacggttaccggtcgggggttaacgaacggggttactaccggtacgggttacttaacgttccggtccgttacccgtccgtacggtccccgttaaccccggg

SEQ ID NO: 84195 - DNA, 815 bp, Homo sapiens
  misc_feature: GYAE6OF02HV6IH.36.23.C01.1.454.CMB.1.raw
  modified_base (237)..(237): a, c, t, g, unknown or other
  misc_feature (237)..(237): n is a, c, g, or t
  modified_base (295)..(295): a, c, t, g, unknown or other
  misc_feature (295)..(295): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacgaggggtcctgggccccagtctggcctgacacagcctgccctccgtgtctgagacctcctggacagtcgatccaccattcctcctgcacgtggaaccngcaggtggtacggtttggtcgtctttaataatttatgttactccgttggttccaacgngtactatcgaggcgacgccggaccccaacttactttaatttagtacggttaggttcgttttccggtccgtccctcggttacggggtttcttacggtcccgttctttccgttcccggccttacccgtaacggttccgtagggtacccgtaaacccgacccgggtccctaccccgttacggaaccctagttacccttaaccgttaagtacccgttaccgacgggtaccgttaaggacggggtaaccggtacggtaccgttaacggttaccttttaagtttaacgttaggtaccgtacggttaccttaccgtaaactttaacgtttaaccgtacggtaaacgttaccgtaaacgtttaggtaacccgttaccgtaacggtttccgggcggttttaacgggttcccggggtaacgggggttaaccggggtaaacccgttaacccgggtttttacggaaccccggttttacggttaaccgggtaacccgtaacccgggttacccccggtaagggttccccccggg

SEQ ID NO: 84196 - DNA, 908 bp, Homo sapiens
  misc_feature: GYAE6OF02JLW51.36.23.C01.1.454.CMB.1.raw
  modified_base (241)..(241): a, c, t, g, unknown or other
  misc_feature (241)..(241): n is a, c, g, or t
  modified_base (269)..(269): a, c, t, g, unknown or other
  misc_feature (269)..(269): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttgngtcttatattatgtctcctgttaccaanagctattcgaggcacgccgaccccgtaaattctttaaattacgtacgtaggttcctttacggtccggtccctacgtaggggttttctagtccgtcctttccgtcccggtctacccgtaacggtccgttagggaccctaaaccggtaccgggtcccctttaccccgtacggtaacccctagtttacccgtaccgttaaaccggtaccccgttacccggtaacgggtcccgttaacggggaaccgggttaaaccgggaaacggggtccgttaaccgggtttaaaccttttaacggttttaaacgttccggtaaccgttaacgggtacccgtttaacctaaaccggttttaaaccgtttaaacccggtttaacgggtaaaaccggttttaaccgttaaacgggttttaaccggtttaaacccgtttaccccggttaaaccggtttccgggggtttacccggtttttaccgggggttaccccggggggttaaacccgggggtaacgggggtttaaaacccccggttaaccgggggtttttaaccccggtaacccccgggttttaaccccggggttaaacggggtttaccccccgggtaaaaccgggttacccccccggggtaaaacggggtttcccccccggg

SEQ ID NO: 84197 - DNA, 992 bp, Homo sapiens
  misc_feature: GYAE6OF02IGET6.36.23.C01.1.454.CMB.1.raw
tcagtacgctgtctcacgaccggtgctcgatttagtacacgtgataggattgggggggtctcaggaggcagtcgcgtctcgaggacatctccaccgatcggcctgggctactgctgcctccgtcaccctcctcactcagggcaacagggtcctacgggacccaggtcctggccttagacacacgcctggcccgttaccgtgtcgtaggacgtacctccgtcggacgacgtacgactaccgaccacttcccttccgtcgacctaccgtaccggaaacccgaggtccgtaggttccggttaccgtttcgggtacgttaccttttaacttaactttacgtccgttaccgtacccgttacggttaacccaaaccggtaacggtcctaacgtttaccgaaccggggtcccgtaaccggtaccccgggtacccccgttaaaactttccgttttaaaagttttacggtaccggttttaccggtttaccgttttaccccgggtacccggtaccccgtttacgggtttacccggggggtttttacctaaccgggtttcccggttacccgtttccccggggttaccccgggtacccgtttaaaccccgggttaaacgggttccccggttaaggggtaaaacccctaaaccccggggttaccccggtccccccgtttaacggtccgtaaacccccttagttcccttaaccgttaccgtaacccgttaacccggaggttaccggacgggtaaacggggtcccggtacgtaccgttaaggttaacctttaagtttaacccgttcgactaccgtacgttaacccgttaattaaaccgtcgtaacggtttaactacgttaaaacgttcggttaaccgtttacaccgggttacgggttacccggtttaggtaacccgggggaccgttacgggttaaaccccgttaggttacccggtccggttaacccgttagggacccctaaccggttaccccgaaccggttccccgg

SEQ ID NO: 84198 - DNA, 537 bp, Homo sapiens
  misc_feature: GYAE6OF02GSD0B.36.23.C01.1.454.CMB.1.raw
  modified_base (228)..(228): a, c, t, g, unknown or other
  misc_feature (228)..(228): n is a, c, g, or t
  modified_base (390)..(390): a, c, t, g, unknown or other
  misc_feature (390)..(390): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgccctccgtgtctgagactcctggacagtcgatcaccatctcctgcactggaaccngcagtgacgttgtgcttataattatgtctcctggttccaacagcattcaggcagccgaccccgaactcttaatttatgagttctttcgtcgtccgtctagggttctagtcgtcttctccgctcatctgcacacgcctcctgaccatctctcactcacgtcgngacggacgagcgtagtacttattagtgctagtctactatactacgtagtaacgtactaagtcgtactacctagtcgtcgtggttcgggacggtacgggtaacgtagttccggtacctacggtacgtacgacgtaccgacggtacccg

SEQ ID NO: 84199 - DNA, 615 bp, Homo sapiens
  misc_feature: GYAE6OF02FU05W.36.23.C01.1.454.CMB.1.raw
  modified_base (227)..(227): a, c, t, g, unknown or other
  misc_feature (227)..(227): n is a, c, g, or t
tcagtacgctgtctcacgaccggtgctcgattagtacacgtgattagggattggggggggtctcaggaggcaccgctctcaggacatctccaccatggcctgggctctgctgctcctcaccctcctcactcagggcacagggtcctgggcccagtctggcctgacacagcctgcctcgtgtctgagactcctggacagtcgatcaccatctcctgcacgtggaaccngcagtgacgttggtgcttataattatgtctccttggttccaacagctattcaggcaggccgccccgaaacttcctttaaatttatggtacgttctttcggtccgccctgtagggtttctagtcgcttcgtccggtctcctaagtcgtggactaacgacggtccctcccgtcgaccactctactacgacctccgagcgtgaacggacggagcgtagactattatgctagctcatacgtactagtaagtctaagtacgtactaccgtacgtcggtcgttacgggtccgggtacgggtaaccgggtaaccttaagggtttaccggtaaccccggttaccgttaacgggtacccgaaccggtaccccggaacggtcccgttaaccccccggg

SEQ ID NO: 84200 - DNA, 625 bp, Homo sapiens
  misc_feature: GYAE6OF02G8IK0.36.23.C01.1.454.CMB.1.raw
  modified_base (228)..(228): a, c, t, g, unknown or other
  misc_feature (228)..(228): n is a, c, g, or t
  modified_base (312)..(312): a, c, t, g, unknown or other
  misc_feature (312)..(312): n is a, c, g, or t
tcagtacgctgtctcacgaccggtgctcgattagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacggttggtgtcttataattatgttcctccttggttaccaacagctattcaggcagccgaccccgaaatcttaattangtagttctttcgtccgtcctcgtagggttctagtcgtcttcgtccggtctcctaagtctgacctaacgaccggcccttcccgtacgacctcttcctaccgtacgtacctccgaggtcctaggaacggaccggagccgtagtacttattacgtgaccagtcctagtaattagtaccgttagaagttactaaagttggtaaaccttcccaaggttcggtccgtttcgggtaccgggaccgggttaacgggaccgttaacggttccgaccccggttacgttaccggtaccgaaccggtacccggaacggttccccg

SEQ ID NO: 84201 - DNA, 579 bp, Homo sapiens
  misc_feature: GYAE6OF02FQ292.36.23.C01.1.454.CMB.1.raw
tcagtacgctgtctcacgaccggtgctcgatttagtacacgtgattagggattgggggggaagaggaagactgacggtcctgtctcaggtgcagctgcagcagtcgggcccaggagtggtgaagccttcggagaccctgtccctcacctgcgctgtgtctggagcctccctcggcggagatgaatggtggagttgggtccgccagcccccgagggaaggggctggagttggattggtgaaataaatgagaccgggggcaccaactacaatgcgtccctcaggggtcgagtcaccatatctgcagacaagtccaagaaccacttctccctgaggctgacctctgtgaccgccgcggactcggccatatattattgtgcgagtagtttttgcaggtatcgtttggggcggtatcgacgtcgtggggtcaagggatcgacggtcacgtcgtctcctcagtccctccgaccgacgggccctagtccggttccttcccccgtcggacccgccctcgcctcccgagggacgccgtacctcccggacgacgaccgacgcggccggccccgtgggcctcggtcccgg

SEQ ID NO: 84202 - DNA, 513 bp, Homo sapiens
  misc_feature: GYAE6OF02FJPWN.36.23.C01.1.454.CMB.1.raw
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgccccgaaacttcttaatttatgaggttctttcgtcgccctcgaggggtttcagtcgcttctccggctccaagtctgcaacacggcctcccgtgaccatctctagactccgagctgaggacgagcttagacttattatgcacgctcatactactgaagtcaatggtactccactgctggttcggcggaggacctagtcgaccgtctaaggtcacgtccgaaggtccg

SEQ ID NO: 84203 - DNA, 670 bp, Homo sapiens
  misc_feature: GYAE6OF02F37VC.36.23.C01.1.454.CMB.1.raw
  modified_base (275)..(275): a, c, t, g, unknown or other
  misc_feature (275)..(275): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagctccgtggacagtcgatcacctatcctcctgcactggaaccagcagtgacgttggtgcttatattatgtcttccgtgttaccaacngcattcaggcagccgaccccgtaaactctttaattacgtgtacggttcttttccggtccgtcccgttacggtacgggttttacctacggttccgtcgtttaccgtccgggtaccttacccgtaagttccgtacgggacctaaccgtacccgggtcccttcccgtacgaccctacttccgtactacgtaccctacgacggtccgtagggacggaccggaggtaccttgtaacctttagtttaagtcgtctacgtcttacaattactacgttagtacgtctaagttacgtacttaccgacgttcggtccgttaggggtcgggaccgggtaacggtaccgttaaggttaccggtccgttaccggttacggacctacccggacccggtaaggtccccgg

SEQ ID NO: 84204 - DNA, 625 bp, Homo sapiens
  misc_feature: GYAE6OF02IGMOZ.36.23.C01.1.454.CMB.1.raw
  modified_base (285)..(285): a, c, t, g, unknown or other
  misc_feature (285)..(285): n is a, c, g, or t
  modified_base (452)..(452): a, c, t, g, unknown or other
  misc_feature (452)..(452): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacgagggtcctgggcccagtctggcctgacacagcctgcctccgtgtctgagactcctggacaggtcgatccaacatcctcctgcacgtggaaccagcagtgacgttggtgtcttaataattatgtctcctggttacaacagtcattnaggtcagccgaccccgaaacttcttaacgttatgtacggttctttcggtccgtcccgtgttacgggttctacggtcgtactttccgtccggtcctaccgtaaagtccgttcgggacctaaaccgaccgtcccgtaccctacggactactctctacgactcgacggtntacggaaggtcgagtcgtacgtacttattacttgacagtctactaatatactagaacgtacaaagtcgtactacctccgtaggtccgtttggtaccgggacgggtaacgggaaccgtacggttacggtacccggtacgttaaccggtacgaacggtacccggaaggtccccgg

SEQ ID NO: 84205 - DNA, 769 bp, Homo sapiens
  misc_feature: GYAE6OF02FI5P1.36.23.C01.1.454.CMB.1.raw
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctcctgcactaggaaccagcagtgacgttgtgcttataattatgtctcctggttccaacagctattcaggtcacgccgaccccgtaactacttaatttatgtaggttctttcgtccggtccctacgtagggtttctacggtcgtcctttcgtcccggtctacccgtaagttccgtaggtaccaaaccgtacccggtcccctttacccgtacgaaccctacttccgttaccgttaacgtaaccccgttacccgacgggtaccgttacgggaacggggtaacccgtagggggtcccttaaggtaaccttttaagttttaacgttcggaaccgtaacgggtcctttaaccgtaaacttaaacgttaaccgttacgggttaaacgttaaccgttaaacgttgggttaaacccttacccgttaaccgggttcgggttacccgtttacgggttacccggggaacgggggtaaccggggttaaaccccgtaagggttttacccggacccgggtttacccgttaagggtacccgtaaccgggtaccccgtaagggttcccccgg

SEQ ID NO: 84206 - DNA, 771 bp, Homo sapiens
  misc_feature: GYAE6OF02HC4XC.36.23.C01.1.454.CMB.1.raw
  modified_base (268)..(268): a, c, t, g, unknown or other
  misc_feature (268)..(268): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcacatctcctgcactggaaccagcagtgacgttggtgcttataattatgtctctgttccaacngcattcaggcagccgaccccgtaaacttctttaattttactgtaacggttcttttcggtcggtccccttcggtaggggttttcctacggttcgtctttccgtccgggtaccttccgaaacgttccgtacggaccgtaaacccgtacccgggtccccttaccccgttacggaaccccctaactttcccgtttaccgtaaccgtaccccgttacccggaacgggtccggttacgggaacggggtaaccgggaaacggggtccttaacggtaacctttaagttttaacgtttagtacccgacggttaccttacgtaaatttacgtaaccgttaggttaaacgttactaaagttacgggttaacttacccgtacgttacgggtccgtttcggggtttacccggggtaaccgggtaacggggtaacccgttaagggttttcccggtaaccccggtttccgggttaaccggttaccgaacccggtaccccggtaaacgggttcccccgg

SEQ ID NO: 84207 - DNA, 662 bp, Homo sapiens
  misc_feature: GYAE6OF02H05HS.36.23.C01.1.454.CMB.1.raw
tcagtacgctgtctcacgaccggtgctcgatttagtacacgtgattagggattgggggggaagaggaagactgacggtcctgtctcaggtgcagctgcagcagtcgggcccaggagtggtgaagccttcggagaccctgtccctcacctgcgctgtgtctggagcctccctcggcggagatgaatggtggagttgggtccgccagcccccgagggaaggggctggagttggattggtagaaataaatgaggaccgggggcaccaactacaatgcgtcccctcgacggggtcgagtcaccatatctgcagacaagtaccaagaaccacttctccctgaggctgacctctgtcgaccgcgcggactccggcatatattattgtgtacgtagtagtttttgcgtagggtattcggttggggcggttagtcggaactagttcggtggggtacaaggggtctacgtacggttactacgtccgttaccttcccgtacgacgcctacccgaaccgaaccgggtccctaacggttacccggttcctttaccccccgtcgggccccgtacccttcggtaccctccggacgggtaccgcccgtaacccggtcccggaacgtacggaccctacggaccggacccgggtaccccgttcggggtccctacccggg

SEQ ID NO: 84208 - DNA, 799 bp, Homo sapiens
  misc_feature: GYAE6OF02G4WIR.36.23.C01.1.454.CMB.1.raw
  modified_base (300)..(300): a, c, t, g, unknown or other
  misc_feature (300)..(300): n is a, c, g, or t
tcagtacgctgtctcacgaccggtgctcgattagtacacgtgattagagattggggggggtctcaggaggcaccgctctcaggacatctccaccatggcctgggctctgctgctcctcaccctcctcactcagggcacagggtcctgggcccagtctggcctgacacagcctgcctccgtgtctgagactcctggacagtcgatcaccatctctgcactggaaccagctagtgacgttggtgcttaataattatgttctctgttccaactagcattcagcagccgacccaatcttaattntgtagttctttgccgtcctagtagggtttctagtccgtctttcgtccggtcttaccgaaggttcgtcggacctaaaccgaccggtcccttacccgttacggaaccctacttccttaccgtaacggtaccctacccgtaacgggccttacgggaacgggaaccgtacggggtaccgttaacggtaaacttttaacgttttaacgtttaccggtaccgtaacggttaccttaacctaacgtttaaaccgtttaaccgttaaacgggttaaacgtttaaccgtaaaacggtttaaccgggtttaaccttaaccccggtaacgtttccggggttaaccgtttaccgggggtttaacccgggggtaaccggggtaaacccggggttaaaacccccggttaaacggggttttaacccgggttaacccccgggttttaccggttaaacccgggggtaacccgttaaacccggggtacccccccgttaaaaggggttcccccccggg

SEQ ID NO: 84209 - DNA, 784 bp, Homo sapiens
  misc_feature: GYAE6OF02I37RN.36.23.C01.1.454.CMB.1.raw
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgacgactccgtggacaggtcgatccaccatcctcctgccacgtcggaaaccagcaggtcgtacggtttggtgtactttaattaatttagttcgttccttccgttacggtttacccaaacgtaggtacctaagtttaccggaacggccgacggaccccggtaaccccccgttaaaacgttttacttttaaacgttttaacgtacgggttaacgggttttcccgttttccgggtacccgggtcccctttacggggttaacgggggtttttcctaacggttccggttcctttcccggtccccggtaccgttaacccgtaacggttccggtcggaaccctaaacccgtcccgggtaccccttacccgtcgaaccctcttaccctaccgtaacgtcccctaccgacgggtcctacgggaacgggacggtaacggtacgttagtacgtttaagttacttcgactagtaccttacgtaatttacgtacgtaagtaacgttactaagttcgtaactccgagttcgtcgttacgggtccggacgggaacggtaccgtaaggttccggtaccgttccggtacggtaccacgggtacccgtaggtcccg

SEQ ID NO: 84210 - DNA, 598 bp, Homo sapiens
  misc_feature: GYAE6OF02J2JFG.36.23.C01.1.454.CMB.1.raw
  modified_base (191)..(191): a, c, t, g, unknown or other
  misc_feature (191)..(191): n is a, c, g, or t
  modified_base (497)..(498): a, c, t, g, unknown or other
  misc_feature (497)..(498): n is a, c, g, or t
  modified_base (510)..(510): a, c, t, g, unknown or other
  misc_feature (510)..(510): n is a, c, g, or t
  modified_base (545)..(545): a, c, t, g, unknown or other
  misc_feature (545)..(545): n is a, c, g, or t
  modified_base (557)..(557): a, c, t, g, unknown or other
  misc_feature (557)..(557): n is a, c, g, or t
tcagtacgctgtctcacgaccggtgctcgatttagtacacgtgattagggagttgggggggggtctcaggaggcagcgctctcaggacatctccaccatggcctgggctctgctgctcctcaccctcctcactcagggcacgagggtcctgggcccagtcctggcctgacacagtcctgccctcgtgttcngacgacctcctggacagttcgaactccacctatcctcctgacaccgtggaaccagcaggtgtacgttgtgtcttatattatgtctccttcggttccaaactcgctattccgaggccacgaccgaccccgtaaactacctttaagttttatcgttaggttctttccgtccgccctcggtacggggtttctacggtccgtcttccgtccggacctcgtaagttccgtgaaccacgaccggttccctccgttacgacctactctctacgcctccgtaggctaggagcgacgctctacgtactttatcgnngtctagacttanacgttgaacttacgagttcgtctaccgtactcggngttcggtcgggngacggacgtagtcgacgtccgacgtcaccgaccgtagtccg

SEQ ID NO: 84211 - DNA, 533 bp, Homo sapiens
  misc_feature: GYAE6OF02HIMNV.36.23.C01.1.454.CMB.1.raw
  modified_base (270)..(270): a, c, t, g, unknown or other
  misc_feature (270)..(270): n is a, c, g, or t
  modified_base (373)..(373): a, c, t, g, unknown or other
  misc_feature (373)..(373): n is a, c, g, or t
  modified_base (484)..(484): a, c, t, g, unknown or other
  misc_feature (484)..(484): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaaccatctcctgcactggaaccagcagtgacgttggtgcttataattatgtctctggtccaanagcattcaggcagccgaccccgaaactcttaatttatgtagttctttcgtccggccctcgtagggtttctagtcgtctttctccggctccaagtctggcaacncggccctcctcgaccatctctagacctccaggcctgacggacgaggctagacttattacgtgcagctacattatactagaatcaataggtactaccatggcttggtcgggnggaagggtacctaagttcggaccgttccgtaggtcacgcccgagtcccg

SEQ ID NO: 84212 - DNA, 832 bp, Homo sapiens
  misc_feature: GYAE6OF02JYQ6V.36.23.C01.1.454.CMB.1.raw
  modified_base (234)..(234): a, c, t, g, unknown or other
  misc_feature (234)..(234): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgacgactccgtggacagtcgatccaccattcctcctgcactggaaaccngcagtgacgtttggtgcttataattatgttctccgttggttacccaaagtgctattccaggctacggccgaccccgtaaacttctttaaactttagtacggtaggttccttttcggtccggtccctacggttacggggtttctacgttccgtaccgtttcgtcccggtctaccgtaagttcggtcgggtacctaaaccggtcccgggcccctttacccgtacgtaacccgtaacgttttccgttaacccgttaaacggtccccgtttacccggaacgggttccgttaacggggtaaaccggggaacccggggtaaccggggttaccttaccggggttaactttaaccggttttaaacgttaccggggcctaaacggttaccttaacgttaacctaaacggtttaaccgttaacggggtaaactttaccgttaaaaggttccggttaaaccttacccggtaacgtttcgggccggtttttaaccggggtacggggtaacccgggtaacggggtaaccccgtttaagggtttacccggtacccggtttaacccgggttacgggttaacccgaacccggggaccccgtaacggggttcccc

SEQ ID NO: 84213 - DNA, 642 bp, Homo sapiens
  misc_feature: GYAE6OF02G4254.36.23.C01.1.454.CMB.1.raw
  modified_base (230)..(230): a, c, t, g, unknown or other
  misc_feature (230)..(230): n is a, c, g, or t
tcagtacgctgtctcacgaccggtgctcgatttagtacacgtgattagggagttggggggggtctcaggagtcagcgctctcaggacatctccaccatggcctgggctctgctgctcctcaccctcctcactcaggcacgagggtcctgggcccagtctggcctgacacagcctgcctccgtgtctgagacctcctggacagtcgatcaccatctcctgcactggaaccngcagtgacgttggtgacgttaataattatgtctcctggttccaacagctagttcaggtcacgccgaccccgaaactacctttaattatacgtagttctttacgtccgtccctcgtcgggtttactacgtcgtcttaccgtccggccttacgaacgttcgtggaccaacgtccggtacctccctacgtaccacttcctactacgtacctccgaggtccgtacggaggacggtacggtccgttacgtacttaacttagttacgactacgtaccttacgtaacttacgttaacgtaggtaaaccgttataaacgtgttaaacctccgtaacgtcgtacggtttacgggtcggtaacgggacggtaaccgtaggtaccgtaccgtcggtagtacctacgggacctaacggtccccg

SEQ ID NO: 84214 - DNA, 612 bp, Homo sapiens
  misc_feature: GYAE6OF02GQ0CI.36.23.C01.1.454.CMB.1.raw
  modified_base (357)..(357): a, c, t, g, unknown or other
  misc_feature (357)..(357): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcacgtggaaccagcagtgacgttggtgtcttataattatgtctcctcggttccaacagctattcaggcagccgaccccgaaactcttaatttatgtaggttctttcgtccggtccctcgtagggtttctagtcgtcttcnccggtctaccaagtctggacaacgaccggcctcctgacctatcctctacgacctcgacggtctagacggacgtaggctacgtacttaattacttgactacgtctacaattacgtaacttacgtaagttacgtaagttacggtaactccctacgtcggtcgttacgggttccgggacgggtaacggggtaaccgttaacgttccggtaaccggttccggttaaccggtaccgaccggtacccgtaacggtccccgg

SEQ ID NO: 84215 - DNA, 815 bp, Homo sapiens
  misc_feature: GYAE6OF02HY9IN.36.23.C01.1.454.CMB.1.raw
  modified_base (221)..(221): a, c, t, g, unknown or other
  misc_feature (221)..(221): n is a, c, g, or t
tcagtacgctgtctcacgaccggtgctcgatttagtacacgtgattagggattgggggggaaatactttctgagactcatggacctcctgcacaagaacatgaaacacctgtggttcttcctcctcctggtggcagctcccagatgggtcctgtctcaggtgcagctgcagcagtcgggcccaggagtggtagaagcctttcgggacgaccctgtcccctnacctgccgcttggtgtctggacgtccctccgtcgggcggagatagagtcggtggaggttcgggtccgtaccgacgcccccggaaggggaacggggtccgtaggacggttggagtttgggtagtaaaagttaaagtggacgggtaacccgggggaccaaacccgtaaaaccgtaacgaaacgtcggtccgttaccccgtacggacgggggttaccgacggtaccaaccgaacttacgttcgtacgcgaacgaacaacgtaccaaacggtaaaccctaccttaccgtcccgtaggtacggccgttacgacccgttacgtcggtaccggtacccggccggtaccggtaccgtcgggaacctaacgttaacttacgtttacgttaggtacgtacggttaggtttacgtttttacggaccggtaaggttacgtttaccggggtacgggggttaaccggttacgtaccgggttaccgggttcgggttaacgggggtaccggtaaacggggttaccgttaacccgggtaaccggtttaccgtaaccggtttcccggtaccctttcccggtaacggttaccccgtaccccgttaaccccggg

SEQ ID NO: 84216 - DNA, 639 bp, Homo sapiens
  misc_feature: GYAE6OF02HP80X.36.23.C01.1.454.CMB.1.raw
tcagtacgctgtctcacgaccggtgctcgatttagtacacgtgattagggattgggggggaaatactttctgagactcatggacctcctgcacaagaacatgaaacacctgtggttcttcctcctcctggtggcagctcccagatgggtcctgtctcaggtgcagctgcagcagtcgggcccaggagtggtgaagccttcggagaccctgtcccctcacctgcgctgtgtctggacgcctcccgtcggcggagatgaatggtggtagttgggtccgccgtacgccccccgtaaggggaacggggcgtggacggtttggtacgtttagggtaggtaaaaagtaaaagtggaacgggtaccccgggggacaacccgaaacgtaacgaaatcggaccgtaccctcgagggggtaccgtagtcaacctatactctgctagacaagtaccaagaaccacttcctacccgtgacggactcgtacctcgtgtacgaccgccgcggtacctccggccaatatattattggtgtacgtagttagttttcgctaggtgttcggttgggtcgttacgtcgtacgtcgttaggggtcaagggtctacggacggtcgtacgtccgttccgtccctacgcgtccctaaccccg

SEQ ID NO: 84217 - DNA, 564 bp, Homo sapiens
  misc_feature: GYAE6OF02FIRY4.36.23.C01.1.454.CMB.1.raw
  modified_base (255)..(255): a, c, t, g, unknown or other
  misc_feature (255)..(255): n is a, c, g, or t
  modified_base (301)..(301): a, c, t, g, unknown or other
  misc_feature (301)..(301): n is a, c, g, or t
tcagtacgctgtctcacgaccggtgctcgatttagtacacgtgattagggattggggggaagaggaagactgacggtcctgtctcaggtgcagctgcagcagtcgggcccaggagtgtgaagccttcggagaccctgtccctcacctgcgctgtgtctggagcctccctcggcggagatgaatggtggagttgggtccgccagcccccagggaaggggctgagttgggattggtgaaataaatgagaccgggggnaccgaactacaatgcgtccctcaggggtcgagtcaccatatctgcngacaagtccaagaaccacttctccctgaggctgacctctgcgaccgccgcggactcgccatatatattgtgcgagagttttttgcaggatctttggggcggtatcgacgtctgggggtcaaggggatcgaggtcatcgtctcctcagcctccaccgaacgggcccagtccggttcctttccccctggtccgtccctgcccttccacggacgcctaccctccggacgacgcaacgacggccgggcccgtcggggcctggtcccg

SEQ ID NO: 84218 - DNA, 613 bp, Homo sapiens
  misc_feature: GYAE6OF02GCUAZ.36.23.C01.1.454.CMB.1.raw
tcagtacgctgtctcacgaccggtgctcgatttagtacacgtgattagggattgggggggaagaggaagactgacggtcctgtctcaggtgcagctgcagcagtcgggcccaggagtggtgaagccttcggagaccctgtccctcacctgcgctgtgtctggagcctccctcggcggagatgaatggtggagttgggtccgccagcccccagggaaggggctgagttggattggtagaaataaatggaggaccgggggcaaccaaactacaaatcgcgtccctcgaggggtcgagtcaccatactctgcagacaagtaccaagaaccacttcctcctgaggctgacctctgtacgaccgccgcggacgtccggccatatattattgtgcgtagtagtttttgactggtattcgttggggcgtagtcggacgttcggtggggtacgaagggtatcgtacggtcgtatccgttctcctcacgccctaccaccgacggccacgttccgtccgttccccgtcgtcccgtccctcgtccgtccgacggaccgtcccacccgtaccggacgaccgacgtaccgaccggcccggtcccggtcgggtccgtcgtacccggg

SEQ ID NO: 84219 - DNA, 529 bp, Homo sapiens
  misc_feature: GYAE6OF02F8GMG.36.23.C01.1.454.CMB.1.raw
tcagtacgctgtctcacgaccggtgctcgattagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgccactggaaccagcagtgacggttggtgcttataattatgtctcctggttccaacagcattcaggcagcgccccgaaactcgttaatttatgtagtcttttcgtcggccctcgtagggtttctagtcgtcttcgtcccggtctccaagttcgtagcaacgaccggtccctcccgtcgacctactctcctaagactccaggtcgtgaaggccgaggctagacttattattgcagtctacatatactgaagtcaatgtactcagtcgcgtgtcggcggacggactagtcgaccgttctagcacgaccagtcccg

SEQ ID NO: 84220 - DNA, 789 bp, Homo sapiens
  misc_feature: GYAE6OF02G1IST.36.23.C01.1.454.CMB.1.raw
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagacctccgtggacagtcgatcaccatctcctgcacgtcggaaccagccagtgacgttggtgcttaataattatgttcctccgtggttcccaacagctattcgacggctacggacccgaccccgtaaacttctttaatttagtggtacgttcgtttccggtccggtccccgttcggtacggggtttcttacggttccgtccttttccgtcccgggtacctttacccgtaacggttccgtacgggtaccctaaaccgtacccgggtacccctttaccccgtacggtaacccctactttcccgtacgttaaccggtacccgtacccggtaagggtccgttaacgggaacgggtacccggtagggtaccttacggtaaacctttagtttaacgttcgaccgtacgtaccttactaagtttacgttaacgtaacggttaaagtaccgtttaaaggtcggttaacccttcctaacggttcgggttaccgttcgggttacccgggggaccgggtaaccggggtaacccgttaacgggtttcccggtaacccggtttacccggttaacgggtacccgtaaccggttaccccggaacggttaccccccgg

SEQ ID NO: 84221 - DNA, 644 bp, Homo sapiens
  misc_feature: GYAE6OF02G167F.36.23.C01.1.454.CMB.1.raw
  modified_base (420)..(420): a, c, t, g, unknown or other
  misc_feature (420)..(420): n is a, c, g, or t
tcagtacgctgtctcacgaccggtgctcgatttagtacacgtgattagggattgggggggaaatactttctgagactcatggacctcctgcacaagaacatgaaacacctgtggttcttcctcctcctggtggcagctcccagatgggtcctgtctcaggtgcagctgcagcagtcgggcccaggagtggtgaagccttcggagaccctgtccctcacctgcgctgtgtcgtggacgccctcccgtcggcggagatgaagtggtggaggttcgggtccgaccacggccccccgaaggggaacggggctaggaggttgggagttgggtagtaaaataaaagtggaacgggaccgggggacaaccgaaacgtaacaagtcggccgtcccgtcggaacggggtcgacgtccacctagtactcncgacacgaacaagtaccaaacgaaccctacttccgtcccgtagacgctcgacctctgtcgaccgccgcgacgtccgcctaatacttattattgtacgtacgtagttagttttcgacgtaggtacgttcggttgggtacgtagtcggtacgttcggttagggtacggaagggtactcggtacggtctacggttccgtaccttccgaccgtacgtaccctacccgg

SEQ ID NO: 84222 - DNA, 592 bp, Homo sapiens
  misc_feature: GYAE6OF02I2ZSL.36.23.C01.1.454.CMB.1.raw
  modified_base (230)..(230): a, c, t, g, unknown or other
  misc_feature (230)..(230): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagacctcctggacagtcgatcacatctcctgcactcggaaccngcagtgacgttggtgcttaataattatgttctcctggttaccaacagctattcaggcagaccgccccgaaacttcttaattatgtagttctttcgtcgtccctgtagggttctagtcgctttcgtccgctcagtctggcacgacgcctcctcgacactctctagctccgaggtctaggacggacggacgctaggtacttacgttattcgactagtctaccattactacgttagtaagtacgtaagttcggtaactaccgtcgttacggttcttacgggttccgggcgggtaaacgggaccttaaaggttccggtacccggttaccggtagggttccaccgggtacccgtaaccggtccccgg

SEQ ID NO: 84223 - DNA, 736 bp, Homo sapiens
  misc_feature: GYAE6OF02JX4YQ.36.23.C01.1.454.CMB.1.raw
  modified_base (217)..(217): a, c, t, g, unknown or other
  misc_feature (217)..(217): n is a, c, g, or t
  modified_base (251)..(251): a, c, t, g, unknown or other
  misc_feature (251)..(251): n is a, c, g, or t
  modified_base (280)..(280): a, c, t, g, unknown or other
  misc_feature (280)..(280): n is a, c, g, or t
tcagtacgctgtctcacgaccggtgctcgatttagtacacgtgattagggagttgggggggggtctcaggaggcagcgctctcaggacatctccaccatggcctgggctctgctgcctcctcaccctcctcactcgagggcacgagggtcctgggcccagtctggcctgacacagcctgcctccgtgtctgacgacctcgtggacagtcgatccacntctcctgcactggaaccagcagtcgacgttggtncttatattatcgtctcgtacgtaccaagngctatcgaggctacgaccgacccgtaattactttaattacgtaggtacgttctttccggaccggtcccgtacggtacgggtttctacggtccgtaccgtttccgtccggtaccttaccgacgttcgtcggaaccctacccgaccgggtcccttacccgtacgtaccctacgttcctaccgtactacccgtccgtacggtctacgggaacggaacggtcggtacgtcgtaacgttagttacgtacgacctacggttacttactaacgttacgttaaccgtaggtaacgtacgttaacggttacggttaacccttacgttacgttcgggttaccctttacgggggttaaccggggtaaccgggtaaacgggttaaccgttaccggggtttaccgggttaaccccgttccgggttaaccgggtaccgtaaccccgggttacccgaacggggttcccccc

SEQ ID NO: 84224 - DNA, 502 bp, Homo sapiens
  misc_feature: GYAE6OF02FGFTZ.36.23.C01.1.454.CMB.1.raw
  modified_base (403)..(403): a, c, t, g, unknown or other
  misc_feature (403)..(403): n is a, c, g, or t
  modified_base (411)..(411): a, c, t, g, unknown or other
  misc_feature (411)..(411): n is a, c, g, or t
  modified_base (418)..(418): a, c, t, g, unknown or other
  misc_feature (418)..(418): n is a, c, g, or t
  modified_base (422)..(422): a, c, t, g, unknown or other
  misc_feature (422)..(422): n is a, c, g, or t
  modified_base (460)..(460): a, c, t, g, unknown or other
  misc_feature (460)..(460): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtcttcctggttccaacagcattcaggcagcgccccgaaactcttaatttatgagttctttcgtcgccctcaggggtttctagtcgcttctccggctcaagtctggcacacggcctcctgaccatctctagactccagctgacggacgngctgactnttatgcngctnatatactgaacgtcaatgtactccactggctggtcggnggacggaccagttcgaccgtctacggtcacgcccgaggtccg

SEQ ID NO: 84225 - DNA, 573 bp, Homo sapiens
  misc_feature: GYAE6OF02GXACY.36.23.C01.1.454.CMB.1.raw
  modified_base (199)..(199): a, c, t, g, unknown or other
  misc_feature (199)..(199): n is a, c, g, or t
  modified_base (255)..(255): a, c, t, g, unknown or other
  misc_feature (255)..(255): n is a, c, g, or t
  modified_base (275)..(275): a, c, t, g, unknown or other
  misc_feature (275)..(275): n is a, c, g, or t
  modified_base (435)..(435): a, c, t, g, unknown or other
  misc_feature (435)..(435): n is a, c, g, or t
  modified_base (451)..(451): a, c, t, g, unknown or other
  misc_feature (451)..(451): n is a, c, g, or t
  modified_base (479)..(479): a, c, t, g, unknown or other
  misc_feature (479)..(479): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgccctccgtgtctgagctcctggacngtcatcaccatcctcctagcactggaaccagcagtgacgttggtgcttataattangttcttccgtggttccaacngctattcgaggcagccgaccccgaaacttcgttaatttatggtagttcctttgtccggtcccctgtagggtttctacgtcgtcttctccggcttacgagtctgaccaacgaccggtccctcctgacctactctacctacgacctcgagtctggaggacgngctgtacttattagtncagtctacgattacgtactagtaacttnaaacgttggtaacctccagttcggatttcggtcgggagggtacggaacctaggttccgtacccgtcgtacggtccaacggtcccgaaggtcccg

SEQ ID NO: 84226 - DNA, 583 bp, Homo sapiens
  misc_feature: GYAE6OF02FF8V8.36.23.C01.1.454.CMB.1.raw
  modified_base (399)..(399): a, c, t, g, unknown or other
  misc_feature (399)..(399): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtcttcctggttccaacagcattccaggcagccgtaccccgaaacttccttaaatttactggaggtttctttcgtccggtcccttcgtaggggtttctagtcgtccttctccggtctccgaagtctggccaacaccggccctccngaccatctactgacctcaggctgaggacgaggtctgacttattagttcgctagtacctctattactaaccgtagtaacgttccaaagttcggtactaccgacgttgggtactcggttacgggacggacgggaacctaggtttccgaacccggttccgtaaggtccacggtacccgaggtccccg

SEQ ID NO: 84227 - DNA, 598 bp, Homo sapiens
  misc_feature: GYAE6OF02F7DLT.36.23.C01.1.454.CMB.1.raw
tcagtacgctgtctcacgaccggtgctcgatttagtacacgtgattagggattgggggggaaatactttctgagactcatggacctcctgcacaagaacatgaaacacctgtggttcttcctcctcctggtggcagctccccagatgggtcctgtctcaggtgcagctgcagcagtcgggcccaggagtggtgaagccttcggagaccctgtccctcacctgcgctgtgtctggacgcctcccgtcggccggagatgaatgggtggagttgggtccgccagcccccgagggaagggctgagttggattggtgaaaataagtggaggaccgggggacaccgaactacaatcgcgtccctcgaggggtcagtcaccatatctgcagacaagtccaaagaaccacttctcccgtgacggtctcgtacctcgtcgtcgaccgccggccggacctccggacctatattacttattggtgcgtagtagtttttcgcgtaggtcgttcgttcggggtcgttacgtcggtacgttcggtcggggtacgtaagggtactacggtacggtcgtagttccgtccgtacctccgtacgtcccgtaccccg

SEQ ID NO: 84228 - DNA, 725 bp, Homo sapiens
  misc_feature: GYAE6OF02FUIXH.36.23.C01.1.454.CMB.1.raw
tcagtacgctgtctcacgaccggtgctcgatttagtacacgtgattagggagttggggggggtactcgaggaggcagcgctctcaggacatctccaccatggcctgggctctgctgctcctcaccctcctcactcagggcacgagggtcctgggcccagtctggcctgacacagcctgcctccgtgtctgagctcctggacagtcgatcaccatctcctgcactggaaccagcagtgacgttggtgcttataattatgtctcctggtccaacagcattcaggcacgccgaccccgaaacttcttaactttatgtaggttctttcggtcgtccctcgtacggggtttctaggtccgtctttcctccggtctacccgaagttctacgggtacaaaccgtaccgggtcccttcccgtacgaccctacgttcctaccgttaacgaccgtttcccgaagggtcgtacgggaacggggaaccgtacgggtccttaaggtaaccctttaagttttaacgtttacgggacctacggtaccttaccgtaactttaacgttacccgttaggtaaacgttacctaaacggttcggttaacctacccgtaacgttcgggttaccgttcggggttttacccggggacggggtaaccggggtaacccgttaaggtttacccggtacccggtttcccggttaacgggttcccgaacgggttaccccgaagggttaccccg

SEQ ID NO: 84229 - DNA, 627 bp, Homo sapiens
  misc_feature: GYAE6OF02GSY28.36.23.C01.1.454.CMB.1.raw
  modified_base (269)..(269): a, c, t, g, unknown or other
  misc_feature (269)..(269): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctcgggcccagtctggcctgacacagcctgcctccgtgtctgagacctcctggacagtcgatcacatcctcctgcatcggaaccagcagtgacgttgtgctataattatgtctctgtaccaangctattcaggcacggccgaccccgtaaactctttaattagtgtacgttcgtttcgccggtcctcggtaggttctagtcgcttcgtcgtcctaccgtaagtccgtagaccgtaacgacccggtccctcccgtacaccctataccctactacgtaccgtacgaccggtacgacggtacggacggtaggtaccttaggtaacctttagttacttcgacgtatcgttactattaacttacgtaagtaacgttacgtaagttacgtacctaccgtactgggtcttacgggtcgggacgggtaacggtacgtaacggttaccggaccgttcggtaaccggtccgtaccgaccggtagtccccgg

SEQ ID NO: 84230 - DNA, 814 bp, Homo sapiens
  misc_feature: GYAE6OF02FWGZB.36.23.C01.1.454.CMB.1.raw
  modified_base (474)..(474): a, c, t, g, unknown or other
  misc_feature (474)..(474): n is a, c, g, or t
tcagtacgctgtctcacgaccggtgctcgatttagtacacgtgattagggattggggggggtcgtcgaggaggcagcgctctcaggacatctccaccatggcctgggctctgctgctcctcaccctcctcactcagggcacaggtcctgggcccaggtcctgccctgacctcagcctgcgtccgtgtctgggtctcctggacagtcgatcacatctcctgcacgtggaaccagctacgtgactttgggttcggtaaaccgtaagtacaagtcgttctacccttcgggtaccaacgtacgttaaccccgacggaccgaaaacgacccccctaaaactacctacttacctaacgttttttcgaacgttccgggttaacgtccggtcccgtaccgtaacgtaacgtttcttaaactcgtaccttcgttacgtcggtacctcgtaacgtctacgacccaaccgaccgtcccgttaccncgtaacctgtaccctcgtcgtccgacctacggtcctaggaccgggacgacgggccttagaacgtttaatttacccgttacggtttacccttaccgtaacgttacgtttaccgaaccgggtacccggtaacgttttccgtttaacggggttcccgtttttacgggggtaccgggtccccgggtaaacccgttaccccgttaccgggtaacccgtttacccgggttaccgggtaccttaacccgggaccccgttaaacgggtccccgttacccggtacccccccggtttaccgggggtaacctaccccggttttccccggtaccggttttcccccccccggg

SEQ ID NO: 84231 - DNA, 904 bp, Homo sapiens
  misc_feature: GYAE6OF02GSLCW.36.23.C01.1.454.CMB.1.raw
tcagtacgctgtctcacgaccggtgctcgatttagtacacgtgattagggagttgggggggggtctcaggaggcaccgctctcaggacatctccaccatggcctgggctctgctgctcctcaccctcctcactcagggcacgagggtcctgggtcccagtctggcctgacacagcctgcctccgtgtcctggagactcctggacagtcgatcacctatcctcctggcctacgtacggaaccaggacctaaggttcggtacggtttgggtacgtactttaaagttaaatttacgttcggttacccttacccggtttaccgggtttaaccccaaaaccgtacggtaccttaacgtttaccgaacgggtaccgtaaccgggacccccggtaaccccccgttaaaaccgttttccgtttttaaaacgttttacggttacgggttaacgggttttcccgtttttaccccgggtcccgggttacccccgttacggggtttaacgggggtttttcctaaccggggttccggttaccgttttcccggtaccccggggtaccttaacccggttaaggtttccgtacgggtaaccctaaaccggtaccccgggttccccttcccgtaacggtaaccctacttcccgttaccgtaacgtacccgttaccggagggtaccgttacgggaacgggtaaccggtaacggttccgttaacgggttaacctttaacttttacgttaccggaccttacggtaccttaacgtaacgtttaacgttacgttaaggtaacgttacgtaaacgttacggttactaccgacggttaggttccgttagggtaccgggacggtaacggtaaccgtacggtttacgacccgttacgtacggtccacggacccgtagcccgttaccccgg

SEQ ID NO: 84232 - DNA, 633 bp, Homo sapiens
  misc_feature: GYAE6OF02J0RVQ.36.23.C01.1.454.CMB.1.raw
  modified_base (131)..(131): a, c, t, g, unknown or other
  misc_feature (131)..(131): n is a, c, g, or t
  modified_base (183)..(183): a, c, t, g, unknown or other
  misc_feature (183)..(183): n is a, c, g, or t
  modified_base (222)..(222): a, c, t, g, unknown or other
  misc_feature (222)..(222): n is a, c, g, or t
  modified_base (236)..(236): a, c, t, g, unknown or other
  misc_feature (236)..(236): n is a, c, g, or t
tcagtacgctgtctcacgaccggtgctcgatttagtacacgtgattagggagttggggggggtcgtcgaggaggcgagcgctctcaggacatctccaccatggcctgggctctgctgctctcaccctcctnactcaggcacaggtcctgggcccagtctggcctgacacagcctgcctccgtntcgtagacgactccgtggacagtcgatcacatctccgtncacgtcggaaccancagtgaacgttgtagtcttaataattagttcgtcgtcctacggttacccaaatacggacctaatttcgacgggactaacgccgaacccccggtaaaacttacttaaactttagtagtacggttctttacggtccgtaccctcggtagggtttctacgtcgtccttcgtaccggctaccgtacgttactcggactaacgaccggtctcccgtagaccacttctactacgcacctacgggctaggtacgaacggtacggcttacggaacttgttacttagcacggtactctaatactaagttacgaacgagttaactacgtaattaccgatacggtctacggtcggacgaacgggtaccgaagttcggacgttcgtacgtacgacgtccgtaaccggac

SEQ ID NO: 84233 - DNA, 1016 bp, Homo sapiens
  misc_feature: GYAE6OF02IOMUU.36.23.C01.1.454.CMB.1.raw
tcagtacgctgtctcacgaccggtgctcgatttagtacacgtgatttagggtagttgggggggaaatactttctgagactccagtggaccttcctgctacaagtaacatgaaacacctgtggttcttcctcctcctggtggcagcttcccgagatgggtcctgtcttcaggtgcagtctgcagcagtcgggcccaggagttgggtgaagtccttcgggagaccctggtccccgtcgacctgccgctgtcgtctgggacgccctccccgtcgggccggagtattcggaagttgggtacgggtaggttcggggtcccgccccgtaacggcccccccggtaggggaacggggccgttgggaacggtttggggtacggttagggtacgtaaaaagttaaacgttcgggaaccgggtacccgggggggtacctaacccggtaaaaccgttaaacgaaacggttcgggtacccgtttacccccggttacggtacggggggttacccgtaaggttacccgtaacccgtaacgttaacctttccgtaccggtaccgaaacgggtaaccgtaaacccggttaacccgaaaaccggttaaaccccgtaaccgtttacccgttaacccccgtttaagggtaacccggaccggtttaccccggtacccgttacccgtttacggttacccggtaccccggaccccgggtacccgggtaaccgttcccggggaacccttaacgttaactttaacgttttaacgtttaccgggttacggtaaccgggttaacggttttacccgggtttttttacggaaccgttaacgggtttcggtttaaccgggttttacgggggttaccgggtttaacgttacccgggttacgggtttaccggggtacggggggtttaacccgggtaaacggggttaccgtttaacccggaacccgggtttaccggttaaccgtttacccgggttttcccgtacccccggtttaccgtaccccggttaccccgtttaacccccccgggg

SEQ ID NO: 84234 - DNA, 783 bp, Homo sapiens
  misc_feature: GYAE6OF02G57S6.36.23.C01.1.454.CMB.1.raw
tcagtacgctgtctcacgaccggtgctcgatttagtacacgtgattagggattgggggggaaatactttctgagactcatggacctcctgcacaagaacatgaaacacctgtggttcttccctcctcctggtggcagctcccagatcgggtcctgtctcaggtgcagctgcagcagtccgggcccaggagtggtagaagtccgttcggacgtaccctgtcccctcacctgcgctggtgttcagggacgcctcccgtcgggacggagtatacgaagttgggtgggtaggttcggggtcccgaccgaccggaccccccgagggggaacggggcctggtagggttggagtttagggtacgtaaaaagtaagtaggacgggaaccgggggtaccaacccggaaactaaccgtaaagtcggacccgttcccgtaggacgggggtaccgaaggttaccaccgtaagtactacctagaccgaagaaccgtaacgtacccgaaaacgtaacctaccgttcccgtaccctacgggtacggccgttaccgtaacccgttcgtacgtacccgggccgaacccggcgggtaacccgttccgggaaccctattaacgttacgttagttttcgagtcggtaacggttcgttttcgacgtaggtaacgtttcgggttacgggacggttagtacccgggttacggttcgggtacggggttacgggaaaggtcgttaaccggacgggttccaagttcccggttccgttacccttacggacccgtcccgttaacccccggg

SEQ ID NO: 84235 - DNA, 692 bp, Homo sapiens
  misc_feature: GYAE6OF02FPJZ4.36.23.C01.1.454.CMB.1.raw
  modified_base (188)..(188): a, c, t, g, unknown or other
  misc_feature (188)..(188): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctganactcctggacagtcgatcaccatctcctgccactggaccagcagtcgacgttggtcgtcttaataattatcgtctcctggttaccaacgtgctattcgaggcacgccgaccccgtaaatctttaattagtacggtagttctttacggtccggtacccttcgtacgggtttcctacggttcgtcctttccggcccggtactaccgtaacgttcgtacggtacctaaccgtaccggcccttacccgtacgtacccgtacttacgtacctacgtacctaccgacgggtactacgggacgggtaaccgtcggtaccgttacgaacgtttattaaccgttggacctacggtcttaccgaattacgtaacgtacgtaacgttcaaacggttgttaacctaccgtcggttacggtaccgttcggtacgggtaccggggtaaccggtaccgttaacggttccggaccggtttacggttaaccgggtacctacggtaacccgtaggttccccg

SEQ ID NO: 84236 - DNA, 223 bp, Homo sapiens
  misc_feature: GYAE6OF02JD2C7.36.23.C01.1.454.CMB.1.raw
  modified_base (217)..(223): a, c, t, g, unknown or other
  misc_feature (217)..(223): n is a, c, g, or t
tcagtacgctgtctcacgaccggtgctcgatttagtacacgtgattagggattggggaggaactgctcagttaggacccagacggaaccatggaagccccagcgcagcttctcttccacctgctactctggctcccaggaactgtggctgcaccatctgtcttcatcttcccgccatctgaagacagcgtactgagcgggctggcaaggcgcatagnnnnnnn

SEQ ID NO: 84237 - DNA, 723 bp, Homo sapiens
  misc_feature: GYAE6OF02JZ8MJ.36.23.C01.1.454.CMB.1.raw
  modified_base (230)..(230): a, c, t, g, unknown or other
  misc_feature (230)..(230): n is a, c, g, or t
tcagtacgctgtctcacgaccggtgctcgatttagtacacgtgattagggagttggggggggtctcaggaggcagcgctctcaggacatctccaccatggcctgggctctgctgctcctcaccctcctcactcagggcacagggtcctgggcccagtctggcctgacacagcctgcctcgtgtctgagactcctggacagtcgatcacatcctcctgcacgtacgaaccngcaggtgtacggttggtgtacttaataacttagtgttcctccgttacggttaccaacgtacgactattcgaggacgtacggacccgtaccccgtaaacgttacttaacgtttacgtacggtacgttcctttacggtcccggtacccgttacggtacgggttttacctacggttccggtcctttccggtacccgtaccgttacccgtaaaggttccgtacgggtaccaaccggtacccgggtcccttcccgtacgtaccgtaactccgttactaacgtacccgttcgaacggtcgtacgaacgggtacgacggtccgttaacgtaacgtttacgttagtccgtactacggtacctactacgttataaccgtaagtaacgttaactaacgtttacgtacctaccgtacggtacgtcgttcggttacgggacggtaacggtaccttaaggttcccgtaccgtaccgtaacggtacccacggtaccgtacggtcccg

SEQ ID NO: 84238 - DNA, 805 bp, Homo sapiens
  misc_feature: GYAE6OF02IFWQJ.36.23.C01.1.454.CMB.1.raw
tcagtacgctgtctcacgaccggtgctcgattagtacacgtgattagggattggggggggtctcaggaggcagcgctctcaggacatctccaccatggcctgggctctgctgctcctcaccctcctcactcagggcacgagggtcctgggcccagtctggcctgacacagcctgcctcgtgtctgagactcctggacagtcgatcacatcctcctgacacgtaggaaccagcaggtcgtacggtttggtgtactttaattaatttattcgttctcccgttcggtttaccaacgacgtactacgtttacgacgggtcaccggacccggtaaccccccgtaaaacgtttacctttttaaacgttttagtacggttaacggttttcccgttttccgggttacccgggttccccgtttacgggtttaccggggggtttttaccttacggttcccgttaccgttttcccggtcccgggttcttaacccggttaacggttccgttacgggaacctaaaccggtacccgggtcccttacccgttacggaaccctacgttccttaccgtaacgtacctaccggacggtcgtacgggacgggtaccggtacgtacttaacgtactttaagtttacgtcgaccgtacgtccttacgtaacttactacgttaagtaacgttacgtaacgttcggttaacctaccgtagttacgggtccgtttagggttaccggggacgggtaacggtaccgttaacggttaccgggttacccgtacggttaacgggtacccgaaccggtcccggtaacgtccccgg

SEQ ID NO: 84239 - DNA, 719 bp, Homo sapiens
  misc_feature: GYAE6OF02J04O5.36.23.C01.1.454.CMB.1.raw
  modified_base (230)..(230): a, c, t, g, unknown or other
  misc_feature (230)..(230): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacgagggtcctgggcccagtctggcctgacacagtcctgcctccgtgtctgagcctcctggacagtcgatcaccatctcctgcactggaaccngcagtgacgttgtgtcttataattatgtccttctcggttacccaacagctattcgaggcagcccgacccgaaacttctttaaatttgtacggttagttccgtttaccgtccggaccctttcggtacgggttttccacggtttccgtccgttttccgttccgggtaccttacccgtaaacgttcgtacggtaccaaaccgtcccgggtacccttccccgttacggacctacgtacctcgtttaacgacccgtccgaggtccgttcggggaacggtaccggcgggaccttacgtaacgtttacttaagttccgacgtacgggtcttaaccgtattaaacccgtcttaaggtaaccgttgtaacgtttcggtaccctaccgtacgtacggtaccgtttcggggtccggacgggttaacggtaccgaacgggtttccggtaacccgttacggtaccgggttaaccgaccggtaccccggtagggtacccccgg

SEQ ID NO: 84240 - DNA, 818 bp, Homo sapiens
  misc_feature: GYAE6OF02JB7KB.36.23.C01.1.454.CMB.1.raw
  modified_base (635)..(635): a, c, t, g, unknown or other
  misc_feature (635)..(635): n is a, c, g, or t
tcagtacgctgtctcacgaccggtgctcgatttagtacacgtgattagggagttggggggggtctcgaggagggcaccgctctcaggacatctccgaccatggcctgggtctctgctgctcctcaccctctcactcgaggccacgagggtcctgggcccaggtctggcctgacacagcctgcctccgtgtctgagtacctccgtggacagtcgatccgaccgtatcctctgaccacgtaggaaaccctgactaaggtgaccgtttgggtactacttaataattagtcggttccttcgttacgtaccaagtacgtactaacgttacgacggccgtaaccgtcccgtaaaccccgttaaactttacgtttaaagttacgtaggttaccggtttaccgtttaccggtacccggggtacccttcggggtttaacgggtttactaccggttcgttccgttccggacccgggttcctaaccggtttaagtcggtaaccggtaacctaacccggtacccggtcccttaccccgtaacgtacccgtaccgtttaccttaacccgtaaacgccccgtttacccgggacggtacgtaaccgggaacggtacggaccggtactaacggttaacctttaggtttacncctacgtacgtactacgtaaattccgtaacggtaacgtaacgttacgtaaacgtacggttaccctaacgttacggtcgttacggttacggtccggggaacggttaaccgggaaaccgtttaaggtcccgtaaacccggttcgtaaaccgccgtaaaccgacccggttaacgcccgttacccgg

SEQ ID NO: 84241 - DNA, 575 bp, Homo sapiens
  misc_feature: GYAE6OF02HM3KD.36.23.C01.1.454.CMB.1.raw
  modified_base (277)..(277): a, c, t, g, unknown or other
  misc_feature (277)..(277): n is a, c, g, or t
  modified_base (340)..(340): a, c, t, g, unknown or other
  misc_feature (340)..(340): n is a, c, g, or t
tcagtacgctgtctcacgaccggtgctcgatttagtacacgtgattagggattggggggaagaggaagactgacggtcctgtctcaggtgcagctgcagcagtcgggcccaggagtggtgaagccttcggagaccctgtccctcacctgcgctgtgtctggagcctccctcggcggagatgaatggtggagttgggtccgccagcccccagggaaggggctgagttggattggtgaaataaatgagaccgggggcaaccaactacaatgcgtccctnaggggtcgagtcaccatatctgcagacaagtccaagaaccacttctccctgacggctgacctntgtcgaccgccgcgactcgccatatattattgtgacgtagtagtttttgactaggattcgttggggcggtatcgacgtcgtgggtcgaagggtatcgacggtcatcgtcttccgtcacgccctccaccgaacggcccagtccggtcccttccccgtcggcccgtccctcgccttccgacggacgccacccgtaccgacgacgaccacgacggccgcccgtcgggcctcgtcccgg

SEQ ID NO: 84242 - DNA, 595 bp, Homo sapiens
  misc_feature: GYAE6OF02GWMIE.36.23.C01.1.454.CMB.1.raw
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataatatgtctctgtccaacagcattcagcagccgaccccgaatcttaattatgtagttcttcgtcggtcctgtgggtttctagtcgtcttccgtccggtctacgaagtctggacaacgccggcctcctcgacctactcctactacgtactaccgaggtctaggacggacgacggctaggaccttaagttactcgctacgcctactatactacgtagtaagtactaaagtcgtaacgtccgtacgtggtccgttgggttacggggaccgggtaacgggtaaccgttaacggtttaccggtacccgttccggttaaggtaccggtaaccgacccggtaacggtaccccg

SEQ ID NO: 84243 - DNA, 597 bp, Homo sapiens
  misc_feature: GYAE6OF02IYKD9.36.23.C01.1.454.CMB.1.raw
  modified_base (142)..(142): a, c, t, g, unknown or other
  misc_feature (142)..(142): n is a, c, g, or t
  modified_base (190)..(190): a, c, t, g, unknown or other
  misc_feature (190)..(190): n is a, c, g, or t
  modified_base (220)..(220): a, c, t, g, unknown or other
  misc_feature (220)..(220): n is a, c, g, or t
  modified_base (223)..(223): a, c, t, g, unknown or other
  misc_feature (223)..(223): n is a, c, g, or t
  modified_base (257)..(257): a, c, t, g, unknown or other
  misc_feature (257)..(257): n is a, c, g, or t
  modified_base (275)..(275): a, c, t, g, unknown or other
  misc_feature (275)..(275): n is a, c, g, or t
  modified_base (481)..(481): a, c, t, g, unknown or other
  misc_feature (481)..(481): n is a, c, g, or t
  modified_base (517)..(517): a, c, t, g, unknown or other
  misc_feature (517)..(517): n is a, c, g, or t
tcagtacgctgtctcacgaccggtgctcgatttagtacacgtgattagggattggggggggtctcaggaggcagcgctctcaggacatctccaccatggcctgggctctgctgctcctccaccctcctcactcagggcacgngggtcctcgggcccagtctggcctgacacagcctgcctccgtgtctgngactctggacaggtcatcactatcctaccngcnctaggaccagcagtgcgttgtgtcttaataattntgttctactggttcaacngctattcgagcacgccgacccgtaatctttaacttagtcgtacgttctttcgtccgtaccctaggtacgggtttacacggttcgtccgttcgtccggttactaccaagttccgtacgactaaccgccggtccctacgtcgaactcgttactcgttaacgcctcgagtactcggaggacgtcggtactcggtaacttacgttacgtnacgtaacgctactaacttataccgtagaaccgttanaacgttggtaacctctacgtcgcgttacgtcgggacggacgtaactacggtcgaccgtcttagccgactaccgaggtccg

SEQ ID NO: 84244 - DNA, 599 bp, Homo sapiens
  misc_feature: GYAE6OF02GUFX7.36.23.C01.1.454.CMB.1.raw
  modified_base (257)..(257): a, c, t, g, unknown or other
  misc_feature (257)..(257): n is a, c, g, or t
  modified_base (286)..(287): a, c, t, g, unknown or other
  misc_feature (286)..(287): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgacgtacctccgtggactaggtcgatccaacctatcctcctgccacgtcggaaccagcaggtgacggttggnacttaataattatgtctcctggtaccaannctatcaggcagccgacccgtaaactctttaatttatgtaggttctttcgtccgtccctcgtaggggtttctagtcgtcttcgtccggctaccagtctgacaacgcgccctcccgtgaccactctctacgacctcgacgtcgtaggacggacggacggctagacttattatcgactagcctatagtactacgtagaagtactaagtacggtactaccgtacgtgtcgttgggttccgggacgggtaacggtaacccgtaaggttaccggtaccggttaccgtaacggtccaacggtacccgaacgggtccccg

SEQ ID NO: 84245 - DNA, 828 bp, Homo sapiens
  misc_feature: GYAE6OF02I8KYG.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgccctcgtgtctgagctccgtggactagtcgatccaccagttcctcctgaccacgtacgggaacccaggcctaaggtcggtaacggtttgggtgtacctttaattaagtttattcggttaccttaccgttcggttacccaacgtagacctaagtttcgacgggacacggcccgtaacccccgtaaattactttaatttacgtaggtacgtttccgttttccgtccgtcccttacgtacggggtttctaaggtccgtctttccgtaccggtcctaacccgtaggttccgtacggacccgtaaaaccgtcccggtaccccgttacccgttacgacccttacttacccgtttacctaaccggtacctttacccggaacggtccgttaagggaaccggggtaccggagggttaccttacgggtaaacttagttttactaccggttcggaaacttccgttaaacctaaagtttaccgttaacgttacgggtaaaactttccgtaaaacggtttcgtaacgttttacccgcggtttagggtttaccggttaccgggttcccgggggtaaagggtaaccggtaacccgtttaagggttacccgttaccccgggttaaccgttacggtaacccgtaaccggcccgggtaacccggttccccgg

SEQ ID NO: 84246 - DNA, 757 bp, Homo sapiens
  misc_feature: GYAE6OF02JZCK5.36.23.C01.1.454.CMB.1.raw
  modified_base (125)..(125): a, c, t, g, unknown or other
  misc_feature (125)..(125): n is a, c, g, or t
  modified_base (194)..(194): a, c, t, g, unknown or other
  misc_feature (194)..(194): n is a, c, g, or t
  modified_base (342)..(342): a, c, t, g, unknown or other
  misc_feature (342)..(342): n is a, c, g, or t
tcagtacgctgtctcacgaccggtgctcgatttagtacacgtgattagggattgggggggtctcaggaggcagcgctctcaggacatctccacatggcctggctctgctgctcctcaccctcctnactcagggcacaggtcctgggcccagtctggcctgacacagcctgcctcgtgtctgagactcctggacngtcgatcaccgtatcctcctgcctacgtggaaacctgcgtagttgtacgttggtcgtacgttataaagtttctcgttctaccgttggttaccaacgtacgtctagttccgaggtcaaggcccgacccgtaaattcgtttaaacgtttntcggtacgtttctttaccgtccggtaccccttaggttcggggtttacctaacggtcgtacccgtttcgtacccggctttacccgaagtccggtacggtaccgtaaccgtacccgggtcccttaacccgtagtacccgtacgttacccttacgttaaacggacccgttacccgtaaggtccgttacggaacgggtaaccgtaccgggttactaccggttaaacttacggtttaccttcggaaccgttaacgtcccgtttagaacgtttaccgtttaactagggtaaactttcccgtaaaagttggtaaacccttaccgtacgttaccggcgttttacgggccggtaaaccggggtgtaacccgttagttacccggtacgttacccggtagcccgttaaccggcgttccgtacccgg

SEQ ID NO: 84247 - DNA, 763 bp, Homo sapiens
  misc_feature: GYAE6OF02FRCQM.36.23.C01.1.454.CMB.1.raw
  modified_base (228)..(228): a, c, t, g, unknown or other
  misc_feature (228)..(228): n is a, c, g, or t
tcagtacgctgtctcacgaccggtgctcgattagtacacgtgattagggattggggggggtctcaggaggcaccgctctcaggacatctccaccatggcctgggctctgctgctcctcaccctcctcactcagggcacagggtcctgggcccagtctggcctgacacagcctgccctccgtgtctgagactcctggacagtcgatcaccatctcctgcactggaaccngcagtgacgttggtgtcttataattatgtctcctggttccaacagctattcaggcacgccgaccccgtaaacttctttaactttagtaggtacggttcgtttccggtccggtcccttcggtagggttttctacgtcgtcttcgtccggctaccgtagttcgtcggacaaccgcccggtcccttcccgtacgaacccttacttaccgttaccgtacgtacccttaccgacgggtccgttacgggaacgggtaccggacgggtccttacggtaaactttacgtttaagtttccgaccgtaacgtcccgttaacttaacgttaacgttaacgtaggttaaaccgttacgttaaaggttttacggtaaaccgttcccgttaaacggttccgggttacggttttaccggggtttaccgggggtaaccgggggtaaccggggttaacccgttaaacgggtttacccggtaccccgggtttacccggttaccgggtacccgtaaaccggggaccccgttaacgggccccgttacccccgggg

SEQ ID NO: 84248 - DNA, 752 bp, Homo sapiens
  misc_feature: GYAE6OF02JJ5D1.36.23.C01.1.454.CMB.1.raw
  modified_base (216)..(216): a, c, t, g, unknown or other
  misc_feature (216)..(216): n is a, c, g, or t
  modified_base (225)..(225): a, c, t, g, unknown or other
  misc_feature (225)..(225): n is a, c, g, or t
  modified_base (249)..(249): a, c, t, g, unknown or other
  misc_feature (249)..(249): n is a, c, g, or t
  modified_base (523)..(523): a, c, t, g, unknown or other
  misc_feature (523)..(523): n is a, c, g, or t
tcagtacgctgtctcacgaccggtgctcgatttagtacacgtgattagggagttggggggggtcgtcaggaggcagcgctctcaggacatctccaccatggcctgggctctgctgctcctcaccctcctcactcagggcacgagggtcctgggcccagtctcggcctgacacagcctgcctccgtgtctgagtaccttcctacgggctaggctacnccaaccgtntccttctgcacgtacggaaccacncgagtcgtacggttggtgtacttataattagtctcttccgtcgttaccaacgagactactcggtgcgaccgacccgtacccggtaaactttccgttaaagttttacgtagggttacgttacctttttcgggtcccggttcccctacggttacgggtttcctacgttcccggtcttttaccgaccggttcctaccgtaacgttccggtcggtaccctaaaccggtcccgtcccctaccgtacgaaccctactccgtaccgtacgtaccgtaccgnggtccgtaaggtacggaccggtacgacggtttcgtactttaacgttacgtacctgtaccggtacgttacctacgttaagttaaccgtaggttaaccgtagtttacggtaccggtaccgttctaacggggttccttagggttccggtaacggggtccggtaacgggtaccggttaccgttacggtcccggttacctacggggtaccaccggttacccgacggttccccgg

SEQ ID NO: 84249 - DNA, 604 bp, Homo sapiens
  misc_feature: GYAE6OF02HL1C0.36.23.C01.1.454.CMB.1.raw
  modified_base (364)..(364): a, c, t, g, unknown or other
  misc_feature (364)..(364): n is a, c, g, or t
  modified_base (442)..(442): a, c, t, g, unknown or other
  misc_feature (442)..(442): n is a, c, g, or t
tcagtacgctgtctcacgaccggtgctcgattagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgtcttataattatgtctcctggttccaacagcattcaggcacgccgaccccgaaactcttaatttatagtaggttctttcgtcggcctcgtagggtttctagtcgcttctcggctccagtcngacacgacggcctcctgacctatctctaacgacctacgaggtctacggagggacgaggcgttagtacttaattagttnacagtctctatatacgtagtaagtactaagtacggttaatccgtaagtcgggtacgttacgggttccgggaccgggtaacggggtaacccgttaacgggtttaccggtaacccggttacccgttaagggttaaccgaccggtacccggtaaacgggtccccg

SEQ ID NO: 84250 - DNA, 806 bp, Homo sapiens
  misc_feature: GYAE6OF02JH3A0.36.23.C01.1.454.CMB.1.raw
  modified_base (240)..(240): a, c, t, g, unknown or other
  misc_feature (240)..(240): n is a, c, g, or t
tcagtacgctgtctcacgaccggtgctcgatttagtacacgtgattagggattgggggggaaatactttctgagactcatggacctcctgcacaagaacatgaaacacctgtggttcttcctcctcctggtggcagctcccagatgggtcctgtctcaggtgcagctgcagcagtcgggccaggagtggtgagccttacggacgaccctcgtccctcacctgccgctggtgtcgtggacnccctcccgtcgggacggacgagttgaacgttgggtgggtaaggtttcggggtcccgcccacggcccccccggaggggaaacgggggtcctgggacggtttgggtagttacggggtagtaaaagtaaaagtggaacgggtaccggggggaccaacccgaaaccgttaacaacgttcggtacccgttaccccgtacggacgggggttaccgaggtacccaacctaattactacgtgtaccgaagaaccgaaaccgtacccgaaaacgaaacccttaccttacctccctaggtacggcttacgacccttcgagttcggaccgcccggaccggtccgtccggacctaattacttaaacgtttacgttcggtacgaccggttaggtttgttttttacgacgtacgggttaacgttccgggtttacggggtacgggtttacgttaccgggttacggtttcggggtacggggttaaccggtaaacggggttaccgttccggtaaccgggtttaccgtaccgtttccggttcccttaccccggttaccgttacccgtccccgttaaccccccgg

SEQ ID NO: 84251 - DNA, 613 bp, Homo sapiens
  misc_feature: GYAE6OF02G97GP.36.23.C01.1.454.CMB.1.raw
  modified_base (228)..(228): a, c, t, g, unknown or other
  misc_feature (228)..(228): n is a, c, g, or t
  modified_base (268)..(268): a, c, t, g, unknown or other
  misc_feature (268)..(268): n is a, c, g, or t
  modified_base (279)..(279): a, c, t, g, unknown or other
  misc_feature (279)..(279): n is a, c, g, or t
  modified_base (302)..(302): a, c, t, g, unknown or other
  misc_feature (302)..(302): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagactctggacagtcgatcaccatctcctgcactggaaccngcagtgacgttggtgcttataattatgtctctgttccaangcattcaggcngccgccccgaaactcttaattangtagttctttcgtcggccctcgtagggtttctagtcgtcctttcgtcccggtctaccaacgtcgttcggacctaaccgaccggtccctcccgtcgaccctatcctaccgtaacgaccttaccgacggtctaggacggaacggacggtctcggaacttaattagttcgacagtcttacattactacgtaggtaacgtactaaagttcggttaacttcccagttcggcgtttagggttccggacggggtaacgggtaaccgttaaggttacgtacccggttcgttacggtccacggtacccgacggtacccgg

SEQ ID NO: 84252 - DNA, 658 bp, Homo sapiens
  misc_feature: GYAE6OF02F5S2I.36.23.C01.1.454.CMB.1.raw
  modified_base (247)..(247): a, c, t, g, unknown or other
  misc_feature (247)..(247): n is a, c, g, or t
  modified_base (321)..(321): a, c, t, g, unknown or other
  misc_feature (321)..(321): n is a, c, g, or t
  modified_base (384)..(384): a, c, t, g, unknown or other
  misc_feature (384)..(384): n is a, c, g, or t
tcagtacgctgtctcacgaccggtgctcgatttagtacacgtgattagggattggggggggtctcaggaggcaccgctctcaggacatctccaccatggcctgggctctgctgctcctcaccctcctcactcagggcacagggtcctgggcccagtctggcctgacacagcctgccctccgtgtctgacgactcctggacagtcgatcaccatctcctgcactggaaccagcaggttgacgtttggngtcttataattatgttctcctggtttccaacagcctattcgaggtcacgccgaccccgtaaacttcttaatttntgtagttcctttcgtccggtccctcggtagggtttctagtcgtcttcgtccgtctccaagtcnggcaacgaccggcctccctcgacctatcctactacgacctccgacggtctagggacgtacgggacggtctacgtacttattttagtcgactagtacctacttaagtaacttaccgttagtaaacggtttccaaagttccgggttaaacttcccgaacgttcgggttaccgttgggttaccggggtaccgggaacgggtaaccgttaacggttacgtacccggttaccggttacggtaccggaccgtacccggtaacggtcccgttacccccggg

SEQ ID NO: 84253 - DNA, 718 bp, Homo sapiens
  misc_feature: GYAE6OF02HT9PB.36.23.C01.1.454.CMB.1.raw
  modified_base (169)..(169): a, c, t, g, unknown or other
  misc_feature (169)..(169): n is a, c, g, or t
  modified_base (200)..(200): a, c, t, g, unknown or other
  misc_feature (200)..(200): n is a, c, g, or t
  modified_base (206)..(206): a, c, t, g, unknown or other
  misc_feature (206)..(206): n is a, c, g, or t
  modified_base (222)..(222): a, c, t, g, unknown or other
  misc_feature (222)..(222): n is a, c, g, or t
  modified_base (228)..(228): a, c, t, g, unknown or other
  misc_feature (228)..(228): n is a, c, g, or t
  modified_base (243)..(243): a, c, t, g, unknown or other
  misc_feature (243)..(243): n is a, c, g, or t
  modified_base (271)..(271): a, c, t, g, unknown or other
  misc_feature (271)..(271): n is a, c, g, or t
tcagtacgctgtctcacgaccggtgctcgattagtacacgtgattagggattgggggggggtctcaggaggcagcgctctcaggacatctccaccatggcctgggctctgctgctcctcacctctcactcgaggcacacgggtcctcgggcccagtctggcctagaccncagtcctgcccgtcgtgtctgacgacttccnggaacncgttcgatcctaacgntctccngacagtacggaaccngctgtcggtaggttgtatacttaatatntcgttctacgttcgtaccaagactactacgtacgacgactaccggaccccgtaacccttaaattttactttaacgttacgtagggtttaccggtttacctttccgggtacccgttacggttaccgggttacggtttcctacggttcccgttcttacccggtccggacctttaaccggtacggttccggtacgaaccctacccggttcccgtcccttaccgataccttactaccgtacgtacgtacctaccggtaggtacggtacgacggtaccggtacggacgttacgttacttacgttacgtacgacgtacgtacactaacgttacgtacgtacgtaacgttacgtacgtacgttaatcgtacgtacgtcggttaccggcgggtaacgggacgttaacggtacggtaccgtaccgttacgtacgtacggaccgtacggacctccgg

SEQ ID NO: 84254 - DNA, 658 bp, Homo sapiens
  misc_feature: GYAE6OF02F57M2.36.23.C01.1.454.CMB.1.raw
  modified_base (199)..(199): a, c, t, g, unknown or other
  misc_feature (199)..(199): n is a, c, g, or t
  modified_base (212)..(212): a, c, t, g, unknown or other
  misc_feature (212)..(212): n is a, c, g, or t
  modified_base (218)..(218): a, c, t, g, unknown or other
  misc_feature (218)..(218): n is a, c, g, or t
  modified_base (474)..(474): a, c, t, g, unknown or other
  misc_feature (474)..(474): n is a, c, g, or t
  modified_base (521)..(521): a, c, t, g, unknown or other
  misc_feature (521)..(521): n is a, c, g, or t
  modified_base (527)..(527): a, c, t, g, unknown or other
  misc_feature (527)..(527): n is a, c, g, or t
  modified_base (581)..(581): a, c, t, g, unknown or other
  misc_feature (581)..(581): n is a, c, g, or t
tcagtacgctgtctcacgaccggtgctcgattagtacacgtgattagggattggggggggttctcaggaggcagcgctctcaggacatctccaccatggcctggctctgctgctcctccaccctcctcactcagggcacaggtcctgggcccagtctggcctgaccacagcctgcctccgtgtctgacgtctctggacngtcgactccaccncgtccncctgacctacgtccgaacctgacacggtcgacggttggtctactaatacgttctcgtcctccgtacgttcccaaacgcactcttacgcggccacgccgtaacgtaacttctttaaattcgacgtacgtcgttcccgccggtcccctaggttacgggtttcctcgtccgtccttaccgtccggacctaccgtaaacggtccgtaccgaccaccggacccgtccctaccgtctacaccgttcacgtacaccctccggnggtcctagggacgccgtaggtctacgtacctttaagtccgtcgaccncgtacncttaaccgtataccgtagtaaacgtccgtaattcggaccctaccgagttccggnttacccgggtacgggcggtaaccgtaacctagggaccctaccggttcgaaccgttccgacccgacgtccggtccccg

SEQ ID NO: 84255 - DNA, 815 bp, Homo sapiens
  misc_feature: GYAE6OF02I3KDY.36.23.C01.1.454.CMB.1.raw
  modified_base (182)..(182): a, c, t, g, unknown or other
  misc_feature (182)..(182): n is a, c, g, or t
  modified_base (219)..(219): a, c, t, g, unknown or other
  misc_feature (219)..(219): n is a, c, g, or t
  modified_base (233)..(233): a, c, t, g, unknown or other
  misc_feature (233)..(233): n is a, c, g, or t
  modified_base (276)..(276): a, c, t, g, unknown or other
  misc_feature (276)..(276): n is a, c, g, or t
  modified_base (321)..(321): a, c, t, g, unknown or other
  misc_feature (321)..(321): n is a, c, g, or t
tcagtacgctgtctcacgaccggtgctcgattagtacacgtgattagggagttgggggggggtctcaggaggcagcgctctcaggacatctccaccatggcctgggctctgctgctcctcaccctcctcactcgacgggcacgacgggtccgtcgggaccctagtccgtcggcctgaccacncgcctcgcctccggtgtctggacgacctccgtggacnggtcgactccactntcctctcgcacgtacggaactagcgtagtcggtacggttggtntactttaattaattagtcggttcttccggttaggttaacccaacncgtactacgttcgacgtcgacgtaccccggtaccctaaaactttctttaagtttagacggtttccggttcctttaccggtcccggtccgttaggttacggggtttcttacggttccgtccgttccggtccgtccttacgtaacggttcctacgtaacctaaccgcccggtcccttacccgtaagtaccttaccttcgtacgtacccgtaccgtacggtacggtcgtacgggaacgggtacggacggttaaccgttacggtttaaactttaacgtttacgggttaccgtacgttaaccgggttcttaacggttaaacttaccgttaaacggtaacggtaaacgggtttaactaacgggtttacttaaccgttacccgtggtttacgtccgggttttacggggtccgggtaaacggggacgtttaacccggttaacggttaccggtacccggttacgtttccgggaacgtaacccggtaccggaaccggttcccgg

SEQ ID NO: 84256 - DNA, 749 bp, Homo sapiens
  misc_feature: GYAE6OF02GQ1DT.36.23.C01.1.454.CMB.1.raw
  modified_base (231)..(231): a, c, t, g, unknown or other
  misc_feature (231)..(231): n is a, c, g, or t
  modified_base (247)..(247): a, c, t, g, unknown or other
  misc_feature (247)..(247): n is a, c, g, or t
  modified_base (260)..(260): a, c, t, g, unknown or other
  misc_feature (260)..(260): n is a, c, g, or t
  modified_base (280)..(280): a, c, t, g, unknown or other
  misc_feature (280)..(280): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgacgactccgtggacagtcgatcaccatctcctgcacgtgaaccngcagtgtacgttggtntacttaataattntgtcttcgtagttaccaagngtctattcgaggcacggccccgaaccccgtaaactttctttaaagtttagtacggttaacggtttcctttaccggtcccggtaccccgttaggttacggggttttaccacggttccgtccgtttcccgtccggtaccttaccgtaacggttccgtacggtaccaaaccggcccggttcccctacccgtacgtaaccctattaccgtacctacggtacctaccggacgggtaccgtagggaacgggaccggaggtccgttagaaccttttaagttacgtacgactacgtactagtaacttaacgtacgtagtaacgtactaaggttacgtacgtaccgtacggttcgtaccggttacggggttccggggaaacgggttaaccgggtaacccgttaacgggtttacccggaacccgtttaccgggtaaacgggtaccccgaaccgggtaccccggtaaaggttccccccgg

SEQ ID NO: 84257 - DNA, 695 bp, Homo sapiens
  misc_feature: GYAE6OF02GCZC3.36.23.C01.1.454.CMB.1.raw
  modified_base (561)..(561): a, c, t, g, unknown or other
  misc_feature (561)..(561): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctctgcactggaaccagcaggtgtacggttggtcgtacttaataattatcgttccttccgttacggttaccaacgagtacctagttccgaaggtccacggcccgaacccccgtaaaacttctttaaatttacgtggtaacggtttcgttttaccggtccggtccccgttacggtacggggttttctacggttccgtccgtttccgtacccggtccttaccgtaacggttccgtacggacctaaaccgtacccggtcccttcccgacgtaccctacttcctacgtacgtacctaccgtaggtcgtagggacgggacgtaggtcttagtacttattagtcgacacgtactnaacttacgtacgtaagtacgttactaagttcggttaacctaccgacgttggtcgttacggttcggggacggtaacggttaccgtaaggttccgaacccgttcgtacgggtacacccggtaccgtacggtccccg

SEQ ID NO: 84258 - DNA, 795 bp, Homo sapiens
  misc_feature: GYAE6OF02IUTRK.36.23.C01.1.454.CMB.1.raw
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgccctccgtgtctgagacctccgtggacagtcgatccaccatcctcctgccacgtacggaaccagccaggtcgtacgttggtgtcttaagtaattatcgttccttccgtggttacccaacagctacttcgaggcacggccgaccccgtaaacttactttaaatttagtaggtaggttccgttttccggtccggtcccgttacggttacgggttttcttacggtccgtcgtttccgtcccggtaccttaccgtaacggttcgtacgggacctaaaccgaccggtcccttacccgtacgtacctacgttctaccgtaacgtacccttaccggacggtacgtacgggtaacgggaaccggtacggtcgttaacggtaactttaacggtttactttaccggacctaacggtccttacgttaaacttaacgttaaacgttaggtaaaccgttaactaaacggttcggttaaaccttcccgtaacgggttacgggttaccgtttcggggttaacccgggaaccgggggtaaacgggtaaccccggttaaagggtttacccggtaacccgggttaaccggttaccgggtacccgtaaacccgggtaccccgggtaacggttcccccgg

SEQ ID NO: 84259 - DNA, 641 bp, Homo sapiens
  misc_feature: GYAE6OF02FLQB3.36.23.C01.1.454.CMB.1.raw
  modified_base (388)..(388): a, c, t, g, unknown or other
  misc_feature (388)..(388): n is a, c, g, or t
tcagtacgctgtctcacgaccggtgctcgatttagtacacgtgattagggattgggggggaaatactttctgagactcatggacctcctgcacaagaacatgaaacacctgtggttcttcctcctcctggtggcagctcccagatgggtcctgtctcaggtgcagctgcagcagtcgggcccaggagtggtgaagccttcggagaccctgtccctcacctgcgctgtgtctgggacgccttcccgtcgggcggagactggaatggtggagttgggtccgccacgcccccgagggacgggctggagttggagttggtagaaataaagtgaacggaccgggggacaaccgaactacaatcgccgtcctcgacggggtcgagtcacatacnctcgacagacaagtaccaaacgaccacttctcctacgacgtctcgaccttctgtcgaccgccgccggacgtccggacctacgggggttacttaagttattgttcgtacgtagttagttttcgtacgtacgtacgttcggttacgggtcggttacgttacggtacggttcggtacggggtcggtaagggtacgtaccggtacggttacgtacgttccgttaccgttcccgtaccgtaccgtcccgtaaccccgg

SEQ ID NO: 84260 - DNA, 711 bp, Homo sapiens
  misc_feature: GYAE6OF02GYQHY.36.23.C01.1.454.CMB.1.raw
  modified_base (232)..(232): a, c, t, g, unknown or other
  misc_feature (232)..(232): n is a, c, g, or t
  modified_base (275)..(275): a, c, t, g, unknown or other
  misc_feature (275)..(275): n is a, c, g, or t
  modified_base (319)..(319): a, c, t, g, unknown or other
  misc_feature (319)..(319): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatccaccatcctcctgcacgtggaaccngcagtgacgttgtgcttaataattatgtctcgtggttccaacngctattcgaggcacggccgaccccgtaaacttctttaatttagngtacggttctttcggtccgtcccttcggttagggtttctacggttccgtcctttaccgtccggtacctaccgtaaggttcgtacggaacctaaccggacccggtcccttaccccgtactaaccctacgttccttacgtaccgtaccctcccggaaggtccgtagggaccgggtaaccgacggtcttacggtaacctttagttacgttcgacctacggtaccttacgtaattacgttacgttaggtaacgttaccaaggtttacgtaacttaccgtacggttcggtacggttacggttccggggaaccgggtaacgggtaaccgttacgggtttacccgtaacccggtttccggttaaggtacccgacccggtacccggtacggtacccccgg

SEQ ID NO: 84261 - DNA, 685 bp, Homo sapiens
  misc_feature: GYAE6OF02GNAVP.36.23.C01.1.454.CMB.1.raw
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggccccagtctggcctgacacagcctgcctccgtgtctgagacctcctggacagtcgatcaccatcctcctgcacgtcggaaccagcagtgacggttggtcgtcttataattatgttcctccgttggttacccaacagctattcgaaggtccacggccgaccccgtaaacttactttaattatggtacgttcgtttcggtccgtccctcggttagggttctacggtcctcttccgtccggtcctactacgtcgtcggacaacgccggtccctcctacgaccctatcctcgtacgcctccgaggtccgtagggaacggacggacggtcgttacggtacttagttagttcgacgtacgtacttacaattactacgtaaggtaacgttaacgtaaacgttacggtaacctacccgttacgttcggttaccggtttcgggtaccggggaccgggttaacgggtaaaccgttaacgggttttacggaccccggttaccggttaccggtaccggtaaccgtaccccggtaacggtcccccgg

SEQ ID NO: 84262 - DNA, 948 bp, Homo sapiens
  misc_feature: GYAE6OF02GY038.36.23.C01.1.454.CMB.1.raw
tcagtacgctgtctcacgaccggtgctcgatttagtacacgtgattagggattggggggggaaatactttctgagactcatggacctcctgcacaagaacatgaaacacctgtggttcttcctcctcctggtggcagctcccagatgggtcctgtctcaggtgcagctgcagcaggtccgggccaggagtgggtagaagcccgttcgggacgacccctcgtcccctacacctggccgtcgttgtcgtcgtgggaccgtccctccccgtcgggcggagacgtagtaagtgggtggtaggttcgggtccgaccgaccggaccccggaaggggacgggctaggtaggttggagttaggaagtaaagtaaggtcggaacgggaccggggacaaccgtaactaacgtaacgtccggtacccgtacccggtacgggtaccgggggtccgtaacggtacccgaaccgtaagttacgttccgtacgaaccgtaaacggtaaaaccgtaaccggtaaaccctaaacccggtaaacccttaaccccgtttaccccgttaacccgggttacgggaaccggttacccggttaccggttaaccccgttccggttaccgggtaacccggtccccgggtaccccgggtacccgggtacccggttacccggtaacccgttaacgttaaacgttttaacgtttaacggtttacggttaccggtaacggtttaacggttttacggtttttacgggaaccggttaacgggttacggttttccgggggtaacggggttaaccggggtttacccgttaccggggttacccgggggttacggggttaccggggggttaaccgggtaaacgggttaacccgggttacccgggtaaacgggtttacccgttacggtttacccgggtacccttaccccggtacccggtaccccggttacccctaacccccggg

SEQ ID NO: 84263 - DNA, 698 bp, Homo sapiens
  misc_feature: GYAE6OF02G2DVF.36.23.C01.1.454.CMB.1.raw
  modified_base (230)..(230): a, c, t, g, unknown or other
  misc_feature (230)..(230): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgacgacctcctggacaggtcatcacatctcctgcactggaaccngcagtcgacgttggtgtacttataattatgttctcgttcgtaccacagtcattcgaggcacggccgacccctaaacttacttaatttgtacggttacggtttccgtttccggtaccggtccgttacggttacgggtttctacggtccgttctttcccgtcccggtacttacccgtaacgttccgtacggacctaaccgtaccggtcccctcccgtaccgaccgtacttccgttactaaccggtaccgtaccggtacggtccgttaggggaacgggtaccggtcggaaccttggttaacgtttagttttacgtcgtactacgtcttactaagttataaccgttagtaacgttatacggttgtaccgtccgtcgttcgtcgttcgggtaccgggacgggtaaccggtacgtaaacggttccggtacccgttccggttacggtacccgtaccggtacccgaacgtccccgg

SEQ ID NO: 84264 - DNA, 763 bp, Homo sapiens
  misc_feature: GYAE6OF02GKBQ4.36.23.C01.1.454.CMB.1.raw
tcagtacgctgtctcacgaccggtgctcgatttagtacacgtgattagggattgggggggaaatactttctgagactcatggacctcctgcacaagaacatgaaacacctgtggttcttcctcctcctggtggcagctcccagatgggtcctgtctcaggtgcagctgcagcagtcgggcccaggagtggtgaagtccttcggagaccctgtccctcacctgcgctgtgtcgtggacgccctcccgtcggcggagctagaagtggtggaggttcgggtcccgccgacggaccccccggaggggaacggggtccgtaggtaggttgggtagttacgggtagtaaaattaagtacggaacgggtaccgggggaccaaccgtaaacctaacgaagtccggtacccgttacccgtacggtacgggggtaccgtaacggtaccaaccgtattacgtccgtagacctaagaaccgtaaccgtacccgaaaacgtaaccctaaccttcccgtacccgtaggtaccgtacgtacggtacccttcgtcgttaccggacccggcccggaccgggtacctcccggacctagttacttattagttcggtgtgtacgttaggttttcgacgtagggttacgttcgggttacggggtacgttacgtacggtaccggttcgggtacggggttaccggtaagggttcgtaccggttaccgggttacttacggttcccggttacccgttacccgtaccgtacccggtcccctaaccccgg

SEQ ID NO: 84265 - DNA, 810 bp, Homo sapiens
  misc_feature: GYAE6OF02GVE89.36.23.C01.1.454.CMB.1.raw
  modified_base (241)..(241): a, c, t, g, unknown or other
  misc_feature (241)..(241): n is a, c, g, or t
  modified_base (800)..(800): a, c, t, g, unknown or other
  misc_feature (800)..(800): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacgagggtcctgggcccagtctggcctgacacacgcctgccctccgtgtcctgagactccgtggacagtcgatccaccattcctacctgctacgtacggaaccngccgaggttcggaccgttggtcgtactttaataatttattgttcctttccgttacgggtttacccaaacgagtaccctacgtttacgagggtcaccggacccgtaacccccgtaaaacctttacgttttaaactttaagttcgggttaaacggttttccgttttacccgggtcccgggttcccccgttacggttacggggtttttaccgtaacggtttccgtccgtttcccgttcccgggttaccttacccgtaaggttcccgttaccggggaacctaacccgtacccgggtaccccgttacccgtaccgtaacccgtaccttacccgtttacgtaacgtacccgtaccgtacgggtccgttacgggaacgggtacggacggttaccgtacgtaaccgtttactttacgttagacctacgtacctactaacttagtaccgttacgaacgttacgtaacgtacggttaccgtccgtacgttacggcgttccggtcggggtaccggtagggaacccgttaggtaccgttacccggtcggtaccgtacggaccgtacccggnggtaccccgg

SEQ ID NO: 84266 - DNA, 620 bp, Homo sapiens
  misc_feature: GYAE6OF02FT164.36.23.C01.1.454.CMB.1.raw
  modified_base (265)..(265): a, c, t, g, unknown or other
  misc_feature (265)..(265): n is a, c, g, or t
  modified_base (376)..(376): a, c, t, g, unknown or other
  misc_feature (376)..(376): n is a, c, g, or t
  modified_base (397)..(397): a, c, t, g, unknown or other
  misc_feature (397)..(397): n is a, c, g, or t
  modified_base (405)..(405): a, c, t, g, unknown or other
  misc_feature (405)..(405): n is a, c, g, or t
  modified_base (410)..(410): a, c, t, g, unknown or other
  misc_feature (410)..(410): n is a, c, g, or t
tcagtacgctgtctcacgaccggtgctcgatttagtacacgtgattagggagttgggggggggtctcaggaggctagcgctctcaggacagtcctccaccatggcctgggctctcgctgcctcctcaccctcctcgactcgagggccacgtaggggtccctggggccccagtctcggcctagacgtaccaggcctgccttccggtgtcgtgacggacttccgtaggactaggtcgatccaaccatctcctggacactggaaaccngtcaggtgacgttggtgtctataattatgtctcctggttccacagtcacttcgacggcagcgacccgaaactctaattatgtaggtctttcgtcgcctgtgggttctgtcncttctccgctcagtctgcacncgcctccngaccnctctcagcctcgagtcgtgaggacgaggctgacttattagtcgctagctactagttactacgtaggtaacgtctaaagttcggtaacttccgtaaccgttcgggtcttacgggtttaccgggccgggtaaggggtaacccgtaagggtttccggtaacccggttccggttacgggtacccgtaccggtaccccggtaagggttcccccgg

SEQ ID NO: 84267 - DNA, 644 bp, Homo sapiens
  misc_feature: GYAE6OF02ILBB3.36.23.C01.1.454.CMB.1.raw
  modified_base (173)..(173): a, c, t, g, unknown or other
  misc_feature (173)..(173): n is a, c, g, or t
  modified_base (186)..(186): a, c, t, g, unknown or other
  misc_feature (186)..(186): n is a, c, g, or t
  modified_base (189)..(189): a, c, t, g, unknown or other
  misc_feature (189)..(189): n is a, c, g, or t
  modified_base (200)..(200): a, c, t, g, unknown or other
  misc_feature (200)..(200): n is a, c, g, or t
  modified_base (219)..(219): a, c, t, g, unknown or other
  misc_feature (219)..(219): n is a, c, g, or t
  modified_base (516)..(516): a, c, t, g, unknown or other
  misc_feature (516)..(516): n is a, c, g, or t
  modified_base (550)..(550): a, c, t, g, unknown or other
  misc_feature (550)..(550): n is a, c, g, or t
  modified_base (557)..(557): a, c, t, g, unknown or other
  misc_feature (557)..(557): n is a, c, g, or t
  modified_base (582)..(582): a, c, t, g, unknown or other
  misc_feature (582)..(582): n is a, c, g, or t
tcagtacgctgtctcacgaccggtgctcgatttagtacacgtgattagggagttggggggggtctcaggaggcagcgctctcaggacatctccaccatggcctgggctctgctgctcctcaccctcctcactcgagggcacagggtcctcgggcccagtctggcctagacacngcctgcctccgtntcngagacctccgnggacacggtcgatccaccntccgtcctgcaactgggaaacccaggtccaagttgacgttggtcgtcttaataattgtgttcctccttaggttccaacacgtctacttacgacggcacggccgtacccgtaaacttctttaaacttgtacggtagttccgttttccgccggtcccttaacgggttcggggtttactcggtcgtacctttccgtccggtacctaccgtaacgtccgtcggtacaaaccgtaccggtcccttcccgtacgacctagttcctaccgtacgtaccctcgtacggtctacgggacggtacgnggtccgtacgtacgttagttactggcacgtctanactagtntaacggattcgaatgtactctacgngtcgttcggacggtggacggttaacgagtacgtccgacgttaccgtcgacgtccgacgtccg

SEQ ID NO: 84268 - DNA, 830 bp, Homo sapiens
  misc_feature: GYAE6OF02HOC6Q.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcaggcacagggtcctggcccagtctggcctgacacagcctgcctccgtgtctgacgacctccgtaggacagtcgatcaccatccttcctgacacgtacggaaccagacaggtacggtacggttggtgtacttttaattaaatttatggttccttaccgttacggtttaacccaaactacgtcctaacgttccgaaggaccaacggtaccccgtaacccccgtaaaactttccttttaaaatttacgtaggttaacggtttcccgttttacggtcccggtccccgttacggtaaggggttttcctaacggttccgtccgttttaccctcccgggtacttaacccgtaagtccgtaggaccctaaaccggcccggtcccttacccggtactaaccctaacgttccctaccgttaaacgtaaccgtacccggtaggtaccgtacgggtaacgggaaccgggtaacggtaccgttaaagttaaccgttaacgttttaaacgtcgtacgtaacttccgttaaactaacgtttaaccgtaccgttaaaggtaacgttaaccgttaagggttaccggttaaaccttacccgtaggttcggttaaccggtttcggtaacggggacccggttaaaggggaaccccttaaggttcccgtaacccggttaccggtaacggttaccgaaccggtacccgacggttaccccg

SEQ ID NO: 84269 - DNA, 867 bp, Homo sapiens
  misc_feature: GYAE6OF02IF0XI.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacgagggtcctgggcccagtctggcctgacacagcctgcctccgtgtctgacgctccgtggacagtcatcacatctcctgcacgtcggaaccagcagtcgtacggttggtgctttaataatttatgttctccgttaggttaccaacgtagtctacgttcagggtccacggtccgaccccgtaaacttactttaatttagtggtacggtttccgttttccggtccggtcccgttacggttaggggtttcctacggttcgtccgttttacccggttccggtaccttacccgttaaaggtccgtttacgggacccgaaaccgacccggttcccccgttacccgttaccgaacccgtaacgtttcccgttaaccgtaaccggacccgtttacccggaacggttccgttagggaaaccggggtaccggttaacggggtaccctttacggttaaaccgtttaacgtttaacggtttcgtaacccgtagggttacccttaacgtaaacgttttacgtaaaccgttaacggggtaaacgttccgtttaaaacggttccgggtttaaccgtaaccccggttaaggttccgggttacggtttaaccgggggtttaccgggtaacccgggggtaaacggggttaacccgttaacgggttttaccccggttaacccgggtttacccggttaaccgggttttacccggaaccgggttaaccccgggtacggttaccccccggg

SEQ ID NO: 84270 - DNA, 664 bp, Homo sapiens
  misc_feature: GYAE6OF02GHID1.36.23.C01.1.454.CMB.1.raw
  modified_base (222)..(222): a, c, t, g, unknown or other
  misc_feature (222)..(222): n is a, c, g, or t
  modified_base (243)..(243): a, c, t, g, unknown or other
  misc_feature (243)..(243): n is a, c, g, or t
  modified_base (288)..(288): a, c, t, g, unknown or other
  misc_feature (288)..(288): n is a, c, g, or t
tcagtacgctgtctcacgaccggtgctcgatttagtacacgtgattagggtagttgggggggtctcaggaggcagcgctctcaggacatctccaccatggcctgggctctgctgctcctcacctctcactcgagggcacagggtcctgggcccagtctggcctgaccacagccctgcccttcggtgtctgacgactccgtggaccaggtcgaatccaccgtntctcctgcctactcggaaccngacaggtgacgttgtgtcttatattatgttctctggttccaacgntctattcgaggcacgccgacccgtaattcttaagtttagacggtacggttcttccggtaccggtcccgttcggtacggggttttctaggtccgtccgtttccgtccggtctaccgtagttccggtacgaccacgtacccgtccctacctacgaccctacttacctctaacgccctaccgaggtcctacggacggaccggagtcgttacgacgtttaagttcgttacgactcgacttacgtaattaccgtacgtacgttactaacttaagtacgttacctaccgacgtttcggcgttcgggttccgggaccggttaacgggaccgtaacggttcgacccggttcgtaccgggttacaccgggtacccagggtccccg

SEQ ID NO: 84271 - DNA, 655 bp, Homo sapiens
  misc_feature: GYAE6OF02GDW2S.36.23.C01.1.454.CMB.1.raw
  modified_base (226)..(226): a, c, t, g, unknown or other
  misc_feature (226)..(226): n is a, c, g, or t
  modified_base (264)..(264): a, c, t, g, unknown or other
  misc_feature (264)..(264): n is a, c, g, or t
  modified_base (295)..(295): a, c, t, g, unknown or other
  misc_feature (295)..(295): n is a, c, g, or t
  modified_base (364)..(364): a, c, t, g, unknown or other
  misc_feature (364)..(364): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcaggcacagggtcctgggcccagtctggcctgacacagcctgcctccgtgtctgagactcctggacagtcgatcaccatctcctgcactggaaccngcagtgacgttgtgcttatattatgtctctgttccaangctatcagcagccaccccgaattcttaattnggtagttctttcggtccgacccttgtagggtttctagtcgtcttctccggctaccgaagtctagcaacnccggtcctcctgaccctatctcgtcggcctccgacgtcctgggacggaccgagtcttagactttagtacctgaccgtgtcctactagttaaagtaaccgtaacgtacgtaccgaacgtaccctagtttaccccgttacgttacccggtttacggttaaacccgggtcggggttaaacccctaaacgggtttacccgtaaccggttttacccgttacccggtttaacgggttaacccgaacccccgggtaacccccggtaaaacccgggaccccccgttaaaacccccccgg

SEQ ID NO: 84272 - DNA, 897 bp, Homo sapiens
  misc_feature: GYAE6OF02JJ2YV.36.23.C01.1.454.CMB.1.raw
tcagtacgctgtctcacgaccggtgctcgatttagtacacgtgattagggattgggggggaaatactttctgagactcatggacctcctgcacaagaacatgaaacacctgtggttcttcctcctctggtggcagctcccagatgggtcctgtctcaggtgcagctgcagcagtcgggcccaggagtggtcggaagccgttacggacgacccttggtcccctcaccctggccgtcttgtcgtctcgggcgcccttcccgtcgggacggagtactggaacgtggtcggaggttcgggtccgccgtaccggccccgaaggggacggggtctggacggttggtagttcggaagtaaagtaagtacggacgggtaacccgggggtacaaccgtaaacgtacgtaacgtccgtaccggtcccgttacggacgggggttacctacggtaccctaaacgtagttaacgtcgtacggacgtaaacgaacgtaacggttacccgaaacggtaacccgtaactttcccgtacccggtaacggtacggtaccgttacggtacccctcggtacggttaccggacccgggtaccccgtccgggtaaacgtcccgggtaacccttaagttaaacgttcgttttaacggtcggttcgtacgggtaacggttttaccgtttttcgggaacgtaacgggtttgtttaaaccggggtttcgggggtaaaccgttaccggtttaccggggtaccgttttaccggggggttaaccgggggttaccggtaaacgggggttacctttaacccgggggtaaccccggggttttaactaaacccggggtttccccggttttacccggttaaccccggtttcccgggaaccggtttttacccccgggtaaaacccccccggg

SEQ ID NO: 84273 - DNA, 823 bp, Homo sapiens
  misc_feature: GYAE6OF02HYQB9.36.23.C01.1.454.CMB.1.raw
tcagtacgctgtctcacgaccggtgctcgattagtacacgtgattagggattgggggggggtctcaggaggcaccgctctcaggacatctccaccatggcctgggctctgctgctcctccaccctcctcactcgagggcacgacgggtcctgggcccagtctcggcctgacacagcctcgcctccgtgtctgacgactcctggacagtcgatccacctatcctcctgacctacgtacggaacccagcctaggtcgtacggtttggtgtactttaattaatttacttcgttccttacccgttcggttacctaacgtacggtaccttagttaccgaggacccgtaacggccccgtaaaccccgtaactttaaccttttaagtttacgtagggttacgtttccgttttcgggtccggtaccccgttacgggttaacgggggttttccttacggtttcccgtaccgtttccggtcccggtaccttacccgtaacggttcgtaccggaccgtaaacccgtcccgggttacccccttccgtaacgtaccctaactttccctaacggtaccgttaccctacccgggaggttcggtacgggaacggggtacccggtcgggttaccttacggtaaacgttttcgtttaacggtgaccctacggttacctaactaacgttacttaacggtaacggtaacgttaacgttaacgtttggtaaacttcccggtacgttcggtacggttccgggtacgggtacgggtaccgttaacgtcggggttaccctacccggttcgaccggtacgaccgtacccggaccgtccgtacccccgg

SEQ ID NO: 84274 - DNA, 707 bp, Homo sapiens
  misc_feature: GYAE6OF02GYKYO.36.23.C01.1.454.CMB.1.raw
  modified_base (211)..(211): a, c, t, g, unknown or other
  misc_feature (211)..(211): n is a, c, g, or t
  modified_base (230)..(230): a, c, t, g, unknown or other
  misc_feature (230)..(230): n is a, c, g, or t
  modified_base (244)..(244): a, c, t, g, unknown or other
  misc_feature (244)..(244): n is a, c, g, or t
  modified_base (274)..(274): a, c, t, g, unknown or other
  misc_feature (274)..(274): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgaccacagcctgccctcgtgtctgagactccgtggacagtcgatcaccntctcctgcacgtggaaccngcagtgacgttgtntacttataattatgtctccgtgttacaacngctattcgaggtcacgccgacccgtaaattcttaattagtgtacgttctttccgcggtcccgttacggtagggttttcctaggttccgtctttccgtccggtccttaccgtaacgttcgtacggacctaaacgtacccggtcccttacccgtcgtaacctacgttcctacgtaacgtaccctacgacggtcttacgggaacgggaaccgtacggtccgttaacggttacttaagtttacgtcgacgtacgtctacgtaattacgtacgttagtaacgttactaaggttacggttaacctaccggtcgttacggggtacgtttccgggttccggggtaccgggtaacgggtaacccgttaagggtttcccggtaacccggtttaccggttaaccgggttacccgtaacgggtacccccggtaagggttcccccg

SEQ ID NO: 84275 - DNA, 615 bp, Homo sapiens
  misc_feature: GYAE6OF02G8HBC.36.23.C01.1.454.CMB.1.raw
  modified_base (391)..(391): a, c, t, g, unknown or other
  misc_feature (391)..(391): n is a, c, g, or t
  modified_base (508)..(508): a, c, t, g, unknown or other
  misc_feature (508)..(508): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacgagggtcctgggcccaggtctggcctgacacagcctgccctccgtgtctgagacctcctggacagtcgatcaccattcctctgctacgtcggaaccagcaggtcgacggtttggtgtacttattaatttatagttctccgttcgttccaacagctattcaggcacgccgaccccgaacttactttaatttactagtagttcgtttcgtccggcccttcgtagggtttctagtcgcttctccggctcagtcngcacgccgcctcctgaccatctctacgctcgacggctaggacggacgacggtcttgacttattagtcgactacgctacacttagttacgtagtaacgttactaaggttcggttaacnccttacgttacggtcgtttaccggttacgggtaccgggtaacgggtaaccgtacgggtttaccgtaccgttaccggttacggtccgaaccgtaccgaacgggtcccg

SEQ ID NO: 84276 - DNA, 1041 bp, Homo sapiens
  misc_feature: GYAE6OF02GITHR.36.23.C01.1.454.CMB.1.raw
tcagtacgctgtctcacgaccggtgctcgatttagtacacgtgattagggagttggggggggtctcaggaggcagcgctctcaggacatctccacatggcctgggctctgctgctcctcaccctcctcactcagggcacagggtcctgggcccagtctggcctgacacagcctgcctccgtgtctgacgacctccgtaggacctaggtccgactccaaccgtattccctccgtgaccgtaaccttacgggaaaccctaggactaaggttcggtaaccggttttgggttcggtaccttttaacgttaaacttttaagttcggtttacccgtttcccccgtttacgggggtttacccccaaaaaccgtacgggtacccttaaagtttttacccgaaacggggttaccgaaccgggtacccccggtaaccccccccggttaaaaacttttccgttttaaaaacgtttttaacggttacggggttaaacgggtttttcccggtttttccccggggttccccgggttaacccccgtttaccggggtttaaaccgggggggttttttcccgttaaacgggtttccccggggtttcccttttaccgggttcccccggggtttaccctttaaccccgggttaaaacggtttccccgttaccgggggtaacccgtaaaaccccggtaccccggggtttaccccccttacccccgggttaaccgtaaaccccggttacttaccccgtttaaccggttaaccggtaaaccccgtttcccggaacggggttaccgtaacggggtaaccggggaaccggttaacgggtaccgttacgtaaccgttttaaagtttaccgttcgggacctacggtaccttccgtaaacgtttactacggttaaggtaaccttacgttaaacggttaccggttacacccgttagggtccggttggttaccgggttacggggacggttaaccggggtaccttaagggttcccggtaacccggttccgtaaccgggtcgtaacccggtcccggtaacggttcccccggg

SEQ ID NO: 84277 - DNA, 806 bp, Homo sapiens
  misc_feature: GYAE6OF02G8QLZ.36.23.C01.1.454.CMB.1.raw
  modified_base (237)..(237): a, c, t, g, unknown or other
  misc_feature (237)..(237): n is a, c, g, or t
  modified_base (253)..(253): a, c, t, g, unknown or other
  misc_feature (253)..(253): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctcggcctgaccacagcctgccctccgtgtcctgagaccttccgtggaccagtcgatccaccatctcctgcacgtgaaccngcaggtgacgttggtntcttaatattactgtctcgtgtaccaacacgctattcgagcgacgcccgaccccgtaaacttacctttaagtttacgtggtaacggtttccttttccggtcccggtaccccgttacggttaccggggttttcttacggttcccgttaccttttcccgttccccgggtacccttacccgtaaacgggttcccgtacgggtaaccctaacccggtaccccgggtaccccgtttccccggtaaccggacccctacgtttcccgtacgtacccggtacccgtccggtacgggtcgtaccgggaacgggtacccggtagggtccgttacgttaacgtttaacgttacgttcgaccgtacgtcccttacgttaacgttaagtaccgttaataaaggtttaacctaaggtttcggtaaacccttcccgtacggtttcgggtaccggttcggggtttacccggggacggggtaaccgggtaaaccgttaaccggtttaccggtaccccggtttaacggtcgggttaacccgtacccggtaccccggtaacggttcccccgg

SEQ ID NO: 84278 - DNA, 659 bp, Homo sapiens
  misc_feature: GYAE6OF02GF9ZI.36.23.C01.1.454.CMB.1.raw
  modified_base (233)..(233): a, c, t, g, unknown or other
  misc_feature (233)..(233): n is a, c, g, or t
  modified_base (248)..(248): a, c, t, g, unknown or other
  misc_feature (248)..(248): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctagacacagcctgccctccgtgtctgagactcctggacagtcgatcacctatctcctgcactaggaaccngcagtgacgttggtnctttataattatcgtcttcctagttaccaactagctattccgaggcacgcccgtaccccgtaaattcttaaactttatcggtacggttctttccggccggtcccctacggtagggtttcctacggtccgtctttccgtcccggcttaccgaagttcgtacggaccaacaccggtcccttcccgagaacctatcctaacgtacgaccgttcgacggtctaggaacgggacgaggtactagactttagttatcgactacgcttacgaattcgttacgagtaaactcgtaaagttcgtaactcccgtacgttcgggtcctttcgggttacgggaccgggtaacggtaaccgttaacggttccggtaacccgtttcggttaaacggacccgtaaccggacccgtaggttccccgg

SEQ ID NO: 84279 - DNA, 609 bp, Homo sapiens
  misc_feature: GYAE6OF02I43NH.36.23.C01.1.454.CMB.1.raw
  modified_base (236)..(236): a, c, t, g, unknown or other
  misc_feature (236)..(236): n is a, c, g, or t
  modified_base (402)..(402): a, c, t, g, unknown or other
  misc_feature (402)..(402): n is a, c, g, or t
tcagtacgctgtctcacgaccggtgctcgatttagtacacgtgattagggattgggggggaagaggaagactgacggtcctgtctcaggtgcagctgcagcagtcgggcccaggagtggtgaagccttcggagaccctgtccctcacctgcgctgtgtctggagcctccctcggcggagatgaatggtggagttgggtccgccagcccccagggaaggggctggagttggattggngaaataaatgagaccgggggcaccaactacaatgcgtccctcaggggtcgagtcaccatatctgcagacaagtaccaagaaccacttcctccctgacggctgacctctgtcgaccgccgcggacctcggccatatattattgtgacgtagtagttttgcgtaggtnttcggttcggggtcggttacgtcggtacggtcggtggggtcgtaagggacgtccgacggtactagtcgttccgtccctacgtccgccctcccgaaccgaaccgggccctacgttccggttcccttccccgtcggtcccgtcccgtccgctcccgacggcgccaccctccggacgacgccacgcggccggcccgtcggcgtcgtccgg

SEQ ID NO: 84280 - DNA, 709 bp, Homo sapiens
  misc_feature: GYAE6OF02FLDG8.36.23.C01.1.454.CMB.1.raw
  modified_base (278)..(278): a, c, t, g, unknown or other
  misc_feature (278)..(278): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatcctcctgcactcggaaccagcagtgacggttggtgcttataattatgtcttcctggttcccaaacncgctattcaggcacgccgacccccgtaaacttctttaaattttagtggtaaggtttcttttaccggtccgggtccccttcggtaacgggggtttttcctacggttccgtcctttccgttcccgggaccttcccgtaaacggtccgttaggggaccctaaaccgacccggtccccgttacccgtcgaccctactccttaccgtaacgtaaccctacccgacgggtcgtacgggaacggacggtaacgggcttacggaactttaagtttagttcgcacggtctacctaattaacgtacgtaagtaacgttcaaagttcggtaactaccgtacgttagggtcttacgggtttcgggaccgggtaacggggtaaccttaacgggttccggtaaccggtttccgtacggtccgaaccggaccctaacgggtccccg

SEQ ID NO: 84281 - DNA, 722 bp, Homo sapiens
  misc_feature: GYAE6OF02I2JW2.36.23.C01.1.454.CMB.1.raw
tcagtacgctgtctcacgaccggtgctcgatttagtacacgtgattagggattgggggggaaatactttctgagactcatggacctcctgcacaagaacatgaaacacctgtggttcttcctcctcctggtggcagctcccagatgggtcctgtctcaggtgcagctgcagcagtcgggcccaggagtggtgaacgtccttcggacgaccctcgtccctcacctgcgctgtgtctggcgccctcccgtcggcggagatgaagtgggtggtaggttcgggtccgccgacggcccccgaggggaacggggcgtggaggttggtagttaggtagtaaaagtaagtgggaacgggaccgggggaccaacccgaaactacgaagtcgtccgtcccgtacggacggggtccgagtaccactatactcgtcgtacaacgaactaacgtacccaaacgtaacctaccttccctacccgtggacgtccgtacgtaccttcgtcgtacggacccggcccggtaccggtaccgtccggtaaccctaagtttaacttacgtttagtcggtacgtacggttagtttacggttttacgacggttaacggttcggtttcgggttacggggtacggttacgtacgggttacggttcgggtacgggggtacgtaagggtccgtacggtaccggttactaccggttccgtcccgtccgtacgacccgtcccgtaacccgg

SEQ ID NO: 84282 - DNA, 684 bp, Homo sapiens
  misc_feature: GYAE6OF02F418I.36.23.C01.1.454.CMB.1.raw
  modified_base (259)..(259): a, c, t, g, unknown or other
  misc_feature (259)..(259): n is a, c, g, or t
  modified_base (291)..(291): a, c, t, g, unknown or other
  misc_feature (291)..(291): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcacctcagggccacgagggtccctggggcccagtctgccctgactcagcctgcgttccgtgtccgtgggtctcctggactagtcgatccaccattcctcctgccacgtaggaaccagcagtgtacggttggntcttaataattatgtcctcgttcgtaccaacngactatcaggtcacggtccgaccccgtaaattcttaaactttagtggtacggtttcttttaccggcccgttcccgtaggttacggggtttcctacgtccgtcttccgtccgtactaccgagttcgtacggacctaacgtcccggtccctccgtacgacctcgtacctacgtaacgtacctaccggaggtccgtagggtaaacgggacggtacggtaccgttaacgtaaccttttaagtttacgtccgaaccgtaccgttaccttactaaagttaccgttaaagtcggtaaagtcgtaagttaccgtacctcgtacgttgtacgttgggtaccggcggaacggtacctaagttccgaccgtacggtcgaccgacgtcccgacgtcgtaccccgg

SEQ ID NO: 84283 - DNA, 725 bp, Homo sapiens
  misc_feature: GYAE6OF02G5PWM.36.23.C01.1.454.CMB.1.raw
  modified_base (225)..(226): a, c, t, g, unknown or other
  misc_feature (225)..(226): n is a, c, g, or t
  modified_base (239)..(239): a, c, t, g, unknown or other
  misc_feature (239)..(239): n is a, c, g, or t
  modified_base (286)..(286): a, c, t, g, unknown or other
  misc_feature (286)..(286): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcgagggcacgagggtcctcgggcccagtcgtggcctgacacagcctgccctccgtgtcagagacctccgtggacagtcgactcacactctccnncacgtacggaacngctaggtacgtacgttggactattatatatcgtcctcgtgtaccaangctatcgacgcacgcccgaaccccgtaattctttaagttagtagtacggtttccgtttacgtcccggtcccttacgggttacgggtttcttacgtcgttccttaccggtcccgtactaaccgtacgtcgtacggtaccaacggtcccgtccctacccgtacgaaccctcttaccttaacaacccggtaccttcccgggaaggtttcggaacgggtaaccgggacggtaacgggtaacctttacggtaaacttttagtttaacgtcggacctaacggttccctaattaacttacggttaaacctaggtaacgttaacgttaagtaccgtactcccgtaaggttccgggttacgttacggggccgggaaccgggtacgtaaccggttacgtcccgggttaaccgtacggtacgtacccgacggtaacccggacgtccccgg

SEQ ID NO: 84284 - DNA, 602 bp, Homo sapiens
  misc_feature: GYAE6OF02F6I7C.36.23.C01.1.454.CMB.1.raw
  modified_base (219)..(219): a, c, t, g, unknown or other
  misc_feature (219)..(219): n is a, c, g, or t
  modified_base (230)..(230): a, c, t, g, unknown or other
  misc_feature (230)..(230): n is a, c, g, or t
  modified_base (245)..(245): a, c, t, g, unknown or other
  misc_feature (245)..(245): n is a, c, g, or t
  modified_base (274)..(274): a, c, t, g, unknown or other
  misc_feature (274)..(274): n is a, c, g, or t
  modified_base (506)..(506): a, c, t, g, unknown or other
  misc_feature (506)..(506): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggccccagtctggcctgacacagcctgcctccgtgtctgagacctctggacagtcgatcaccatctcctncactggaaccngcagtgacgttggtntcttatattatgtcttcctcggtaccaanagctattcaggcacggccgaccccgaactactttaatttgtgtacgttcctttcggtccgtccctggtacgggtttctacgttcgtcttccgtccgtcctacgagtcgtcggaccaaccgtccggtcccttccgtacacctattcctactacgtctccgtaggctacggaacgacggacgtcgtagtacttagttacttcgactcgactactataacgtagtgtaaacgttnaaacgttgtacttaccgtagtggtcgtggtcgggacgggtaccgtaacgttagttccgacggttaccggtagtacccgacgtacccgacggtcccg

SEQ ID NO: 84285 - DNA, 590 bp, Homo sapiens
  misc_feature: GYAE6OF02FU5NK.36.23.C01.1.454.CMB.1.raw
  modified_base (234)..(234): a, c, t, g, unknown or other
  misc_feature (234)..(234): n is a, c, g, or t
  modified_base (469)..(469): a, c, t, g, unknown or other
  misc_feature (469)..(469): n is a, c, g, or t
tcagtacgctgtctcacgaccggtgctcgatttagtacacgtgattagggattggggggaagaggaagactgacggtcctgtctcaggtgcagctgcagcagtcgggcccaggagtggtgaagccttcggagaccctgtccctcacctgcgctgtgtctggagcctccctcggcggagatgaatggtggagttgggtccgccagcccccagggaaggggctgagttggattggngaaataaatgagaccgggggcaccaactacaatgcgtccctcaggggtcgagtcaccatatctgcagacaagtccaagaaccacttcctcccgtgacggctagacctctagtcgacccgccgcggactcggccatacgtatttacttgtgcgagtagtttttgactaggattcgttgggtacggtagtcgtacgtcgtggggtacgaagggactcgacggtctatcgtcctctcncgcctccaccgaacggcccagtccggtcccttcccgtcgtccgtccccgtagccctcgacggcgcctaccctccggaacgacgcgaacgccggccggtacccgtcgggccgtcgtacccgg

SEQ ID NO: 84286 - DNA, 786 bp, Homo sapiens
  misc_feature: GYAE6OF02F40NP.36.23.C01.1.454.CMB.1.raw
  modified_base (253)..(253): a, c, t, g, unknown or other
  misc_feature (253)..(253): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacgagggtcctgggcccagtctggcctgacacagcctgcctccgtgtctgagactccgtggactagtcgatcaacctatcctcgtgcactggaaccagcgagtgtacggttggtntacgttaattatttagtcgttccttaccgttcggttacccaacgtacgtactacgttacgacgggaccgaacggacccgtaacccccgtaaaactttaccttttaaagttttaacgttacggttaccggttttccgttttaccgggttccccgggttaccccgttacgggtttacgggggtttttaccttaacggtttccggtccttttccggttacccgtcctttaccgtaacggtttccggtacggtaacccgaaccgtacccggttccccttaccccgtacgtaccctacttacccgtacctaaccggtaccttacccggagggtaccgtacgggtaacgggaaccggtaacgggtaccgttaagttaccgtttaagtttacgttaccgacgtacgttactaccgtaattacgtacgtagttaacgtacgtaagttcggtaactaccgtagttacgtcgtttacgggtccgggacggtaacgggtaaccgttaggtccgtaccgtcgtacggtacacggtaccgagtccg

SEQ ID NO: 84287 - DNA, 819 bp, Homo sapiens
  misc_feature: GYAE6OF02I1XSO.36.23.C01.1.454.CMB.1.raw
tcagtacgctgtctcacgaccggtgctcgatttagtacacgtgattagggattggggggaagaggaagactgacggtcctgtctcaggtgcagctgcagcagtcgggcccaggagtggtgaagccttcggagaccctgtccctcacctgcgctgtgtctggacgcctccctcggcggagatgaatggtggagttgggtccgccacgccccgagggaggggctggagttgtagttggtagaaataatggacggaccggggtcaaccaacgtacaatgaccgtccgtacgacggggtcgagtccacgtatatctagcgaagtaaccgaacgtaccgaaacgaaccctactttccctacccgttacggaacggtcctacggaacccttcgtcggtacgacccggcccggaccggtaccgtccggaccgtaacttattaacgttttacgttcggttacgggacgttaggtttacgtttttacggacgttaagggttacgttcggggttacggggtacgggtttacgtaccgggttaccgggttcgggttacgggggttacgtaaacggggtacgtaccggtaacgggttccttaacgttcccgtttcccgtccttaccgaccgtacccctacccgtaacccggaaaccgggtcccctaaccggttcccggtttaccccgtttacccccgttccggtacccggttcccccgtacgtcccgtacggtacgggtacccggtacccgtaccccggtacccggaacgtacccggaccgaaccggtaccgggtcccggacccgggtaccgggtcgttcccggtacccgg

SEQ ID NO: 84288 - DNA, 716 bp, Homo sapiens
  misc_feature: GYAE6OF02FNB8P.36.23.C01.1.454.CMB.1.raw
  modified_base (194)..(194): a, c, t, g, unknown or other
  misc_feature (194)..(194): n is a, c, g, or t
  modified_base (244)..(244): a, c, t, g, unknown or other
  misc_feature (244)..(244): n is a, c, g, or t
  modified_base (251)..(251): a, c, t, g, unknown or other
  misc_feature (251)..(251): n is a, c, g, or t
  modified_base (262)..(262): a, c, t, g, unknown or other
  misc_feature (262)..(262): n is a, c, g, or t
  modified_base (579)..(579): a, c, t, g, unknown or other
  misc_feature (579)..(579): n is a, c, g, or t
tcagtacgctgtctcacgaccggtgctcgattagtacacgtgattagggattggggggggtctcaggaggcaccgctctcaggacatctccaccatggcctgggctctgctgctcctcaccctcctcactcagggcacagggtcctgggcccagtctggcctgacacagcctgccctcgtgtctgagacctccnggacagtcgaatccaccatctccgtgcactgaaccagcagtgacgttggngtcttanaattatgttcnccttggttccaacagcattcacggcacgcgaccccgtaaactcttaacttatgacggtctttcggtccgccctcgtaggggtttctagtcgcttccgtccggcttaccgaagttacctcggaccaaaccgacccgggacccttccccgtgaaccctaagtttcctcgtaaccgacccgttaccccaacgggtccgtaggaaccgggaaccgaagggtcccttaggtaacctaaacgtttttaatgtacccgtaagtcctaccaaacttaccgttaaacgttcgtaaaacgtttaccaaaaggtcgggttttaaaacnccctaaccgttacgggtcttaggtttcccggggggaaccggggaaccggggtaacccctaaaacgggttttcggaaacccggtttaccccggtaagggttacccgaggtacccccgaacgggtacccgttacccccg

SEQ ID NO: 84289 - DNA, 592 bp, Homo sapiens
  misc_feature: GYAE6OF02FTYWE.36.23.C01.1.454.CMB.1.raw
  modified_base (200)..(200): a, c, t, g, unknown or other
  misc_feature (200)..(200): n is a, c, g, or t
  modified_base (230)..(230): a, c, t, g, unknown or other
  misc_feature (230)..(230): n is a, c, g, or t
  modified_base (244)..(244): a, c, t, g, unknown or other
  misc_feature (244)..(244): n is a, c, g, or t
  modified_base (254)..(254): a, c, t, g, unknown or other
  misc_feature (254)..(254): n is a, c, g, or t
  modified_base (268)..(268): a, c, t, g, unknown or other
  misc_feature (268)..(268): n is a, c, g, or t
  modified_base (298)..(298): a, c, t, g, unknown or other
  misc_feature (298)..(298): n is a, c, g, or t
  modified_base (342)..(342): a, c, t, g, unknown or other
  misc_feature (342)..(342): n is a, c, g, or t
  modified_base (360)..(360): a, c, t, g, unknown or other
  misc_feature (360)..(360): n is a, c, g, or t
  modified_base (365)..(365): a, c, t, g, unknown or other
  misc_feature (365)..(365): n is a, c, g, or t
tcagtacgctgtctcacgaccggtgctcgattagtacacgtgattagggagttgggggggggtctcaggaggcaccgctctcaggacatctccaccatggcctgggctctgctgctcctcaccctcctcactcagggcacagggtcctgggcccagtctggcctgacacagcctgcctccgtgtctgagactcctggacngtcgatccaccatctcctgcactggaaccngcagtgacgttggntcttatattntgtctctgtcaacngcatcagcagccgacccgtaatcttaattngtgtcttcgcgtcctgtaggttcagtcgtctcgtcgctcagtcnggacaacgcgtcctccgngaccntctacgtacgacctcgagtcgtaggaacggtacggacgtacttacgtaactttagttactcgacgtacgtactctaagtaacttacgtagtaagtacgtaagttcgttacctaccgtacgtcggtcgttacggtccgggacgggaaccgggttaccttaagggttaccgaccccggtttacggttaccggtaccggaacccgtacccggtaccgtcccgtacccccg

SEQ ID NO: 84290 - DNA, 876 bp, Homo sapiens
  misc_feature: GYAE6OF02GY7E3.36.23.C01.1.454.CMB.1.raw
tcagtacgctgtctcacgaccggtgctcgatttagtacacgtgattagggattgggggggggtctcaggaggcagcgctctcaggacatctccaaccatggcctgggctctgctgctcctcaccctcctcactcagggcacagggtcctgggcccagtctggcctgacacagcctgccctccgtgtctgacgaccttcctggacagtccgatccaacctatcctcccttcgacctacgtacggaaacccacggtaccaaggttcggtaacgggtttcggtacggtactttaagttaaagtttattcgttccgtttccgttcggtttaacccaaacgtacgtacctaacgttccgaagggacccaacggtccccggtaaaccccccgttaaaacctttaaccgttttaaaacgttttaacgttacggttaaacggtttcccgttttaccgggttccccgggttccccggtttaaccgggttacgggggttttccgttaacggttcccggttccgtttcccggtcccggtaccttaccgtaacggtccgttacggaccgtaaccggaccggttcccctcccgtacgtacccgtacttccgtacctacgtaccctacggtacggtcgtacgggacgggaaccggaggtacgttacgtaacttagttaacttcgactacgtacttactaaagttacgttaacgttaacgtaacgttaccgttaaaggttaccggttaactacccgttacgttcgggttaccgttacggggtacccgggtaacggggttaaccgggtaaccgttaacgggttacccgttaacccgggtacccggttaccgggtaaccgtttaacccgggacccggttacccggtaccccgg

SEQ ID NO: 84291 - DNA, 723 bp, Homo sapiens
  misc_feature: GYAE6OF02ICYID.36.23.C01.1.454.CMB.1.raw
  modified_base (185)..(185): a, c, t, g, unknown or other
  misc_feature (185)..(185): n is a, c, g, or t
tcagtacgctgtctcacgaccggtgctcgatttagtacacgtgattagggagttgggggggggtctcaggaggcagcgctctcaggacatctccaccatggcctgggctctgctgctcctcaccctcctcactcagggcacgagggtcctgggcccagtctggcctgacacagcctgcctccgtntctgacgtacctcctggacagtcgatcaaccatctccgtgacacgtacggaaccagtcaggtcgtacggttggtgtcttaattaattatgtcctccgttcggttacccaactagctacgttacgacggcacggccgacccccgtaacttactttaattagtgtacggtttcgttcgtccgtcccgtgttacgggttctcgtcgtcttcggtccgtctacctagtcgtacgacccgtacgacccggtcccgtacctaccgaccgtacttcccgtacttaacgacccttaccgacggtccgtaggggaaccggaccgggtaggtaccgttaagtacctttaagttcgttacgaccgtagttaccttaacgtaacgttacgtaacgttaggtaaacgtttacgtaaacggttacgttaccctaacgtacggttacgggtacccgtttcgggtaacggggaccgggttaacggtaaccgttacgggtaccggttacccgttccgttaccggaaccgaaccgggttacccgaggttcccccgg

SEQ ID NO: 84292 - DNA, 716 bp, Homo sapiens
  misc_feature: GYAE6OF02G30KC.36.23.C01.1.454.CMB.1.raw
  modified_base (285)..(285): a, c, t, g, unknown or other
  misc_feature (285)..(285): n is a, c, g, or t
  modified_base (301)..(301): a, c, t, g, unknown or other
  misc_feature (301)..(301): n is a, c, g, or t
  modified_base (570)..(570): a, c, t, g, unknown or other
  misc_feature (570)..(570): n is a, c, g, or t
tcagtacgctgtctcacgaccggtgctcgatttagtacacgtgattagggagttggggggggtcgtcgaggaggcagcgctctcagacatctccaccatggcctgggctctgctgcctctccaccctcctcaactcgacgggcaccgtagggtccgtcgggcccacgtcgtcggcctacggaccactacgcctcgccctccggtgtctaggagacctccgtggactaggtccatcaccagttctcctgcacgtcggaaccagtcaagtcggacgtttggtacgtnttaattaattacgttnttctccgttcggttaccaaactacgtctacgttacgacgcgacggccgtaaccccgtaacttactttaaacttgtacgtacggttcctttcggtccgttccccgtaggttacgggtttctacggtccgtcgttccgtccgtccgtacctaacgttcgtaccggtaacaccgacccgtcccgtcctcgacctactcctactacgtactccgtacgcgtaacggtcggaaccggaggtccgttaacggtaaccttagttacgttacgtacnggtccctataacgttactaccgttagtaacgttacaaaggtttcgaactaccgttacggtcgttacgttcggggtcgggtccggaacggggtaaccttacgtacggtaccgtaccggttaggacctcggttacccgaggttccccg

SEQ ID NO: 84293 - DNA, 634 bp, Homo sapiens
  misc_feature: GYAE6OF02HRUVH.36.23.C01.1.454.CMB.1.raw
  modified_base (178)..(178): a, c, t, g, unknown or other
  misc_feature (178)..(178): n is a, c, g, or t
tcagtacgctgtctcacgaccggtgctcgatttagtacacgtgattagggattgggggggaagaggaagactgacggtcctgtctcaggtgcagctgcagcagtcgggcccaggagtggtgaagccttcggagaccctgtccctcacctgcgctgtgtctggagcctccctcggcggngatgaatggtggagttgggtccgccacgcccccgagggaaggggctgagttggattggtagaaataaatggacggaccggggcaccaactacaagtcgcgtccctcgaggggtcgagtcaccatatctgcagacaagtaccaagaacctacttcctccctggacgtctcgacctcgtgtcgaccgccgcggacgccggccatatatttatggtgtacgtagttagttttgcgtaggacgttcgtggggtacgttagtcggtacgttcggtagggtacgaagggctacgtacggtctacgttcgtcctcctcacctccctacgaccgacgggcctacgtccgttcccgttccccgtccgggccctcccgtccgaccgtcccgtacggaccgcctacccgtaccggacgaccgaccgaccgaccggcccggtacccggtcgggtccgtcggtacccgg

SEQ ID NO: 84294 - DNA, 702 bp, Homo sapiens
  misc_feature: GYAE6OF02IFDXZ.36.23.C01.1.454.CMB.1.raw
  modified_base (232)..(232): a, c, t, g, unknown or other
  misc_feature (232)..(232): n is a, c, g, or t
  modified_base (273)..(273): a, c, t, g, unknown or other
  misc_feature (273)..(273): n is a, c, g, or t
  modified_base (280)..(280): a, c, t, g, unknown or other
  misc_feature (280)..(280): n is a, c, g, or t
  modified_base (352)..(352): a, c, t, g, unknown or other
  misc_feature (352)..(352): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcgagggcacgagggtcctgggcccagtctggcctgacacagcctgcctccgtgtctgagactccgtggacagtcgatcaccatcctcctgcactggaaccngcagtgacgttggtgacttataattatgtctcgtgttccanagcattnagcacgccgacccgaattctttaattagtgtaggttcttcgtacggtccctgttacgggttctaggtccgtnttcgtccggtctaccgtaagtcgtggaccaacgtaccgtcccgtaccctgacctacttcgtacctacgtaccgtaccgaggtaccgtaggacggggaccggtaacgggtacctaacggtttaacctttaagttttaccgtttacggctaaacggttcccttaacgtaaacgtttacgttaaccgttaaggtaaacgttacctaaaggtttacggttaaaccttaccgtacggttacgggttccgtttacgggttaccggggaaccgggtaacgggtaacccgtttaaacggttaccggtacccgttacgggttaaacggtcccgaaccgtaccccggaaggttcccccgg

SEQ ID NO: 84295 - DNA, 855 bp, Homo sapiens
  misc_feature: GYAE6OF02F3BLU.36.23.C01.1.454.CMB.1.raw
tcagtacgctgtctcacgaccggtgctcgatttagtacacgtgattagggattggggggaagaggaagactgacggtcctgtctcaggtgcagctgcagcagtcgggcccaggagtggtgaagccttcggacgaccctgtccctcacctgcgctgtgtcgtggacgccctcccgtcggcggagatgaagtgggtggaggttcgggtccgccgacgcccccgagggaacggggtctggtacggttggtagttgggtaagtaaaagttaaagtacggacgggaaccgggggacctaaccgaaacgttaacaacgtcggtaccgtcccgtacggacggggtcgtacgtacgaccgattacgtcgtgacgacgtacaacgtaccgaaacgtaacctacgttcctccgtacggtacgtcgtaccgtacttccgtggtccggacccgccggtaccggtaccgtcggaccgtaagttacgttaacgtttacgtttcggtacgtacggttaggtttacgtttttacggacgttaggtacgtttcgggtcgggtacggttagtaccgggtacgttcgggttacgggtacgtaaacggggtactacgtacggttacgtacgttaccgttccgttaccgtaccgtaccgtacccgtaaccgaaccggtaaccggacccgttacgttacccgggtttccctttaccccgggttacccgcccggttaccccgttccggtaacccggtaccgggtaaccggtaccgtcccggtaaccccggttaccgggaaccggtaccgtaacccgggtaccggtaaccgggtccccggggttacccggacccgggttccgggtaccgttacccgggg

SEQ ID NO: 84296 - DNA, 792 bp, Homo sapiens
  misc_feature: GYAE6OF02IGS4X.36.23.C01.1.454.CMB.1.raw
  modified_base (246)..(246): a, c, t, g, unknown or other
  misc_feature (246)..(246): n is a, c, g, or t
  modified_base (278)..(278): a, c, t, g, unknown or other
  misc_feature (278)..(278): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagactccgtggacagtcgatcacatctcctgcactacggaaccagcagtgacggttggtncttaataattatcgtactccgtcgttaccaanagctattcaggcacggtaccgaccccgtaaaacttactttaacttttagtaggtacggtttacctttcggtaccggtccccttacggttaggggtttcctacggtccgtaccgtttccgtcccggtccttaccgtaaacgttccgttacgggaaccctaaaaccgtcccgggtaccccttacccgtacggtaaccctaacgtttcccgttaaccgtaacggtaacccctttacccggaacgggttaccgtaacgggtaaaccggggaacccgggtaacgggttccgttaacggtaaacccttttaaagtttaaccggtttcggaacctaaacggttcccttacgtaaactttaacgttaaccgttaaggtaaacgtttaaccgtaaagttacggttaaccgtacccgtaacgtcgggtactttcgggtccgggaacgggtaacgggtaaccgttaacggttaccgtacccggttaccgttaacgggtaccaaccggtacccgaacgggtccccg

SEQ ID NO: 84297 - DNA, 694 bp, Homo sapiens
  misc_feature: GYAE6OF02JSD6P.36.23.C01.1.454.CMB.1.raw
  modified_base (143)..(143): a, c, t, g, unknown or other
  misc_feature (143)..(143): n is a, c, g, or t
  modified_base (170)..(170): a, c, t, g, unknown or other
  misc_feature (170)..(170): n is a, c, g, or t
  modified_base (172)..(172): a, c, t, g, unknown or other
  misc_feature (172)..(172): n is a, c, g, or t
  modified_base (220)..(220): a, c, t, g, unknown or other
  misc_feature (220)..(220): n is a, c, g, or t
  modified_base (245)..(245): a, c, t, g, unknown or other
  misc_feature (245)..(245): n is a, c, g, or t
  modified_base (252)..(252): a, c, t, g, unknown or other
  misc_feature (252)..(252): n is a, c, g, or t
  modified_base (262)..(262): a, c, t, g, unknown or other
  misc_feature (262)..(262): n is a, c, g, or t
  modified_base (464)..(464): a, c, t, g, unknown or other
  misc_feature (464)..(464): n is a, c, g, or t
  modified_base (673)..(673): a, c, t, g, unknown or other
  misc_feature (673)..(673): n is a, c, g, or t
tcagtacgctgtctcacgaccggtgctcgatttagtacacgtgattagggattgggggggggtctcaggaggcagccgctctcaggacatctccaccatggcctgggctctgctgctcctcaccctcctcactcagggcacgngggtcctgggcccagtctggcctgacncngcctgcctccgtgtctgacgctccgtggacctaggtcgaatccaaccngttcctccgtgacacgtggaacccngcaggtnacggttggtntctttaataattatcgtccttcctggttaccaacacgtctattcgaggctacgcccgacccgtaaattctttaattagtaggtcgtttcgttccgtccggtaccttaggtcgggtttctacggttccgtccgtttaccgtcccggtacttacccgtagtttccgtacgaaccctaacggtcccgggtccccttacccggtanaccccgtacgttccctccgtacgaccctaccggacggtacgtacgggaacgggtaccggtacggtacttacggtactttacgttacgtacgtcgtaaggtccctacgtagttactacggtaacgaagttacctaaaggttcgtaaactccgtacggtcgttcggtacggtcgggaaccggtacggtacttaacgggtcctacgtcggtntaccggacgtccggtacgtcg

SEQ ID NO: 84298 - DNA, 628 bp, Homo sapiens
  misc_feature: GYAE6OF02IYXI3.36.23.C01.1.454.CMB.1.raw
  modified_base (211)..(211): a, c, t, g, unknown or other
  misc_feature (211)..(211): n is a, c, g, or t
  modified_base (243)..(243): a, c, t, g, unknown or other
  misc_feature (243)..(243): n is a, c, g, or t
  modified_base (317)..(317): a, c, t, g, unknown or other
  misc_feature (317)..(317): n is a, c, g, or t
tcagtacgctgtctcacgaccggtgctcgattagtacacgtgattagggattgggggggggtctcaggaggcagcgctctcaggacatctccaccatggcctgggctctgctgctcctcaccctcctcactcagggcacagggtcctgggcccagtctggcctgacacagcctggcctccgtgtctgacgactcctggacagtcgatcacntctctgcacgtgaaccagcagtgacgttggtntacttaataattatcgtctccgtggttccaactacgctattcgaggcacgccgacccgtaaacttcttaatttntggtagttctttcggtccggtcctggtacgggtttctacggtccgtcgtttccgtccggtccttaccgtaacggttcgtacggaccctaaccgtacccgggtcccttcccgtacgtaccgtacttccctacctacgtacctccgaggtctagggaacggcggtagtcgtagtacttattcgtcgactacgtccgtatatactacgtagtaacgttactaagttcgtactaccgtacgtggcgttacggtcgggacggtacggtaaccgtaggttaccgaccgttacggacgtcgacgtaccgacggtcccg

SEQ ID NO: 84299 - DNA, 714 bp, Homo sapiens
  misc_feature: GYAE6OF02HIG7B.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagacctcctggacagtcgatcaccatctcctgcactcggaaccagcagtgacggttggtgtcttataattatcgtctcctgttaccaaactaactattcaggacacggcccgaccccgtaaaacttacctttaatttagtaggtacggtttcctttccggtcccggtacccttggtacgggtttcctaggtccgtcttccgtccggtctaccgaagttcgtacgggacaaaccgccggtccctcccgtacgaccctacttctaccgtacgtacctacccggtaggtcccgttagggaacgggtaaccggtagggtaccctagggtaacccttttaattaacggttcgaccgtagtaccttacgaaattacgttaaccgtagtaaaccgttacgaaacgttcgggtaacctaccgttcgtacgggtcgttacgggttccgggaacgggtacgggtaaacccgttaggttacccggtaccggttacccggtagggtacccaccggtacccggtacggtccttcccccggg

SEQ ID NO: 84300 - DNA, 611 bp, Homo sapiens
  misc_feature: GYAE6OF02INRNQ.36.23.C01.1.454.CMB.1.raw
  modified_base (211)..(211): a, c, t, g, unknown or other
  misc_feature (211)..(211): n is a, c, g, or t
  modified_base (218)..(218): a, c, t, g, unknown or other
  misc_feature (218)..(218): n is a, c, g, or t
  modified_base (237)..(237): a, c, t, g, unknown or other
  misc_feature (237)..(237): n is a, c, g, or t
  modified_base (244)..(244): a, c, t, g, unknown or other
  misc_feature (244)..(244): n is a, c, g, or t
  modified_base (269)..(269): a, c, t, g, unknown or other
  misc_feature (269)..(269): n is a, c, g, or t
  modified_base (300)..(300): a, c, t, g, unknown or other
  misc_feature (300)..(300): n is a, c, g, or t
  modified_base (461)..(461): a, c, t, g, unknown or other
  misc_feature (461)..(461): n is a, c, g, or t
tcagtacgctgtctcacgaccggtgctcgatttagtacacgtgattagggattggggggtctcaggaggcagcgctctcaggacatctccaccatggcctgggctctgctgctcctcaccctcctcactcagggcactgggtcctgggcccagtctggcctgacacagtcctgcctccgtgctgagacctcctggaccagtcgatcaaccngtctccngacactggaacctgcagtnacgttgngacttatattatgtctctcgtcaangcattcagcagcgacccgtaaatcttaattntagagttcttcgtcggtccctcgagggtttactgtcgtcttcctcggtacctccgtaagtcgttggacctaacgaccggccttcccacgacctaattctactacggaaccttccgaacggtcgtacgacggacggtaggctacggtaaccttagttagtcncgtagaccttcgaagttactaacgtcgtaagtacctaaagtcggtactaccgttaccgtagggtcctttacggtccgggcgggtaacgggtaaccgaaacgtttcgtacccggttacctacggtaccggtaccgacccgaacggttcccg

SEQ ID NO: 84301 - DNA, 628 bp, Homo sapiens
  misc_feature: GYAE6OF02FSQFV.36.23.C01.1.454.CMB.1.raw
  modified_base (257)..(257): a, c, t, g, unknown or other
  misc_feature (257)..(257): n is a, c, g, or t
  modified_base (375)..(375): a, c, t, g, unknown or other
  misc_feature (375)..(375): n is a, c, g, or t
tcagtacgctgtctcacgaccggtgctcgatttagtacacgtgattagggattggggggggaaatactttctgagactcatggacctcctgcacaagaacatgaaacacctgtggttcttcctcctcctggtggcagctcccagatgggtcctgtctcaggtgcagctgcagcagtcgggcccaggagtggtgaagccttcggagaccctgtccctcaccttgcgctgtgtctggacgccctcccgtcgggccgganagtgaatggtggagttgggtccgccagccccccgagggaaggggctgagttggattggtgaaataaatgagaccgggggcaccgaactacaatgcgtccctcaggggcgagtcaccanatctgcagacaagtccaaacgaaccacttcctaccctgacgctcgtaccgtctcgtcgacccgccggccggtacctcgggacctacgttaagtatttatttggtcgtacggtagttaggttttttcgacgtaacgggtactttacgggtggggttaccggtagttaccggtacgttcggttggggtaccggtaagggtacttcggaccggttcgtacgttccgtccttcccgtactacggtccctaaccccgg

SEQ ID NO: 84302 - DNA, 541 bp, Homo sapiens
  misc_feature: GYAE6OF02IYWIF.36.23.C01.1.454.CMB.1.raw
  modified_base (140)..(140): a, c, t, g, unknown or other
  misc_feature (140)..(140): n is a, c, g, or t
  modified_base (213)..(213): a, c, t, g, unknown or other
  misc_feature (213)..(213): n is a, c, g, or t
  modified_base (233)..(233): a, c, t, g, unknown or other
  misc_feature (233)..(233): n is a, c, g, or t
  modified_base (247)..(247): a, c, t, g, unknown or other
  misc_feature (247)..(247): n is a, c, g, or t
  modified_base (256)..(256): a, c, t, g, unknown or other
  misc_feature (256)..(256): n is a, c, g, or t
  modified_base (270)..(270): a, c, t, g, unknown or other
  misc_feature (270)..(270): n is a, c, g, or t
  modified_base (274)..(274): a, c, t, g, unknown or other
  misc_feature (274)..(274): n is a, c, g, or t
  modified_base (280)..(280): a, c, t, g, unknown or other
  misc_feature (280)..(280): n is a, c, g, or t
  modified_base (300)..(300): a, c, t, g, unknown or other
  misc_feature (300)..(300): n is a, c, g, or t
  modified_base (353)..(353): a, c, t, g, unknown or other
  misc_feature (353)..(353): n is a, c, g, or t
  modified_base (371)..(371): a, c, t, g, unknown or other
  misc_feature (371)..(371): n is a, c, g, or t
  modified_base (387)..(387): a, c, t, g, unknown or other
  misc_feature (387)..(387): n is a, c, g, or t
  modified_base (422)..(422): a, c, t, g, unknown or other
  misc_feature (422)..(422): n is a, c, g, or t
  modified_base (463)..(463): a, c, t, g, unknown or other
  misc_feature (463)..(463): n is a, c, g, or t
  modified_base (469)..(469): a, c, t, g, unknown or other
  misc_feature (469)..(469): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacngggtcctgggcccagtctggcctgacacagcctgcctccgtgtctgacgtctcctggacagtcgatccacctntcctcctgcactcggaaccngcagtgacgttgtncttatattntgtctctgtaccangctntcagcngccgacccgaatcttaattngtacgtcttcgtccgcctgtggttctagtcgtcttcgtccggctcgtaagtcngtaccacgccgccttccngacctactctacgtanacctcgacgctggaggacgacgtgtctacttattnttcactgctacgtatagtactaggtaatgtaatcggtaacnccgtancggtctggttccggagggaacgtacgtagttaccggtaccgtcggtacgtacgaccgccggtacgtccccgg

SEQ ID NO: 84303 - DNA, 709 bp, Homo sapiens
  misc_feature: GYAE6OF02JIWR9.36.23.C01.1.454.CMB.1.raw
tcagtacgctgtctcacgaccggtgctcgatttagtacacgtgattagggagttggggggggtctcaggaggcagcgctctcaggacatctccaccatggcctgggctctgctgctcctcaccctcctcactcgagggcacgagggtcctggggcccagtctgggccctgaccacagcctgcctccgtgtctgacgacctccgtggacaggtcgatccaccatcctccgtgaccacgtaggaaccctggctaggtcgtacggttggtctactttaataacgttatcgtcttccgttacgtacccaagcgactacttacgaggcacgtaccgaccccgtaaactttctttaaagttctaggtacgtttcgttccggtacggtcccgtggtacggggtttctacgtccgttcctcgtcccggacttaccgagtcgtggacctaaccgccgtcccgttacccgtactacccgtacttcgttaccgtaacgtccccgttaccggaagtcggtacgggtaaccgggtaccggtacggttacctacggtttaactttaacgtttagttaccgcgtaccggtacttacaacgtttacacgtaaagttaaccgtataacggtcgttacgacctacggttcggtacgttcggggtaaccggaggttaacggcttaaggttccgacgttccggtacgtaccgaccgacgtcggtacccg

SEQ ID NO: 84304 - DNA, 835 bp, Homo sapiens
  misc_feature: GYAE6OF02GQGJU.36.23.C01.1.454.CMB.1.raw
  modified_base (258)..(258): a, c, t, g, unknown or other
  misc_feature (258)..(258): n is a, c, g, or t
tcagtacgctgtctcacgaccggtgctcgattagtacacgtgattagggagttggggggggtctcaggaggcagcgctctccaggacatctccaccatggcctgggctctgctgctcctcaccctcctcactcagggcacagggtcctgggcccagtctggcctgacacagcctgcctccgtgtctgagacctccgtggactagtcgatccacctatcctcctgccgactcggaacccagctaagtgtacggttggtntacttaagttaatttactcggttccttccgttggtttaccccaaacgtacggtactactttcgaacggtccgtacggcccgtaacccccggtaaaacttcgtttaaactttacgtacggttaccggtttaccgttttccggtaccggtaccccgttacggttacgggggttttcccttaacggtttcccgtccgttttacccggtcccgggtaccgtttaacccgaaacggtttccggtacgggtaacccgtaaaccggtaccccgggtccctaccccgtacggtaaccctagtttcccgttaacgtaaccgtacccgtacccgtaacggtccggttaacgggaccgggacggtaaccgggtcgttaacgtacgtttaacgttcgttacggcctaacggtcctaacggtacttacgtaaccggtagtaaaccggttacgtaaaggttccggttaaccacccggttacgttccgggttcgtttaaccgggtccggggtacggtaacccgggtaacccgttaaggttcccggtaaccgtaccggtacggtaccgtaccggaaccggtacggtaccccgg

SEQ ID NO: 84305 - DNA, 680 bp, Homo sapiens
  misc_feature: GYAE6OF02F6F4K.36.23.C01.1.454.CMB.1.raw
  modified_base (231)..(231): a, c, t, g, unknown or other
  misc_feature (231)..(231): n is a, c, g, or t
  modified_base (283)..(283): a, c, t, g, unknown or other
  misc_feature (283)..(283): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagacctcctggacagtcgatcaccatctcctgcacgtcggaaccngcagtgtacgttggtgtacttataattagtcgtccttcgttcgtaccaacgngctacttcgacgcacgccgaaccccgaattactttaattgtagtacgtttcctttccggtccgtccgttacggtcgggtttctacggttcgtccgtttccgtcccggtccttacgaacgttccgtacgacaaacccgtccggtacccctcccgtaacgtaccctcgttacctacgttacgacccgttccgaacgggtctaacgggacggaccgggacgtacgttaagtactttagttacgtgctaacgtcctaataacttacttacgtagtaacgttcaaaggttcgttaacctccgtaacggttcgttccggttacgggtccgggacgggtaacgtaaccggtaggttaccccgtccgttacggtacggtaccgaccggttaccgtcggtacccgg

SEQ ID NO: 84306 - DNA, 856 bp, Homo sapiens
  misc_feature: GYAE6OF02JQFCS.36.23.C01.1.454.CMB.1.raw
  modified_base (233)..(233): a, c, t, g, unknown or other
  misc_feature (233)..(233): n is a, c, g, or t
  modified_base (255)..(255): a, c, t, g, unknown or other
  misc_feature (255)..(255): n is a, c, g, or t
tcagtacgctgtctcacgaccggtgctcgatttagtacacgtgattagggagttgggggggggtctcaggaggcagcgctctcaggacatctccaccatggcctgggctctgctgctcctcaccctcctcactcgagggcacgtacggggtcctggggaccccagtcctcgggcctgaaccacagtccctggcccttccggtgttcctaggacgtaccttcccgtagggaacncggttacgaactccaaacccgngttcccttcccggtggacctaacgtacgggtaaaacccaggcctagggttcgtaacgggtttgggtcgtactttaagttaaattcgttcggttccttaccgttcggttaacccgaacttacggcctagtttaccgaacgggaccgtacggcccgggtaaccccccttaaacgtttaccgtttaaattttacggtaacgttcggggttttaccctttttccgggcccgggttaacccccggttacgttacgggggttttaccgtacggttccgttaccgtttaccggtcccggtaccgtttaccgaaacggttttccgtacgggaacctaacggtaacccgggttccctcccggttagtaccctacttaccgtacgtaccgttacctccgtaacgggtcgttaacgggaacgggttaccggacggttaccggttacgttaacgttacggttacgttacgcgtacgtacgttacaacgttacgtacgtacgtaacgttcgaaacggttcgtacgtactacggtacgttcgttcgggtcgggaacggtcggtaaccttacggtcgttaccggactttacgggacctacggaccgtagtccccgg

SEQ ID NO: 84307 - DNA, 837 bp, Homo sapiens
  misc_feature: GYAE6OF02JGTOH.36.23.C01.1.454.CMB.1.raw
tcagtacgctgtctcacgaccggtgctcgatttagtacacgtgattagggattggggggaagaggaagactgacggtcctgtctcaggtgcagctgcagcagtcgggcccaggagtggtgaagccttcggagaccctgtccctcacctgcgctgtgtcgtggacgcctccctcggcggagatgaagtgggtggaggttcgggtccgcccgacgcccccggaggggaacggggcgtggtaggttggtagtttaggtagtaaaagtaaagtcggaacgggaacccgggggaccaacccgaaaacgttaacgaacgtacggtcccgtccccgtacggaacggggttcgacgtaccgaaccgtactactcgtacgaccgaagaacctaaacggtacccaaacggtaaccctaccttacccgtacccgtacggacggtaccgtaccgtaacctccgtcggtaccggacccggaccggaccggtaccgtaccggtaccctattaacgttaagtttacttcggtacggtacggttaacggtttaggtttttaccggacgtacggggttacgtttccggggtttacggggtaccgggtttacgttaccgggtacgggttacgggttcgggtacggtaacgggtacgtaccgggtacgtaccgtacggttccgtcgtccgtaccgtaccgacccttaacccgaccggacccggtaccctacggtcccgttacccgttccccgtcggtcccgtacccgtcgtacccgttccgaccggtaccgacccgtccgtaccgtacgacgaccgaccggtaccggccggtcccggttcgggccgtacgtcccgg

SEQ ID NO: 84308 - DNA, 599 bp, Homo sapiens
  misc_feature: GYAE6OF02GEJKE.36.23.C01.1.454.CMB.1.raw
  modified_base (271)..(271): a, c, t, g, unknown or other
  misc_feature (271)..(271): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaanagctattcaggcagcgacccgaaactcttaaatttatgtaggtctttcgtcggcctcgagggtttctagtcgtcttctccggctccaagtctggcaacgacgcctccctgaccatctctagacctaccgaggctggacggacgaggtctgtaacttattacgttcgctacggcttacaattactaactaggtaacgttacgtaaagttgtaaccttaccgacgttcggtacgttggttaccggggacgggtaccgggtaaaccgtaagggtttccgaacccggttccggttaacgggtaaccaccggtacccctaggggttacccccg

SEQ ID NO: 84309 - DNA, 859 bp, Homo sapiens
  misc_feature: GYAE6OF02HISL6.36.23.C01.1.454.CMB.1.raw
tcagtacgctgtctcacgaccggtgctcgatttagtacacgtgattagggagttggggggggtctcaggaggcagcgctctcaggacatctccaccatggcctgggctctgctgctcctcaccctcctcactcagggacacagggtcctgggcccagtccgggcctggacacagcctgcccttccgtgtctgacgtacctccgtaggacagtcgactccaacctagtcctcctagacctacgtacgggaaccaggccgtaggtacggtacggtttggtacgttacttttaaagttaagtttacttcggttccttaccgttcggttaacccaacgtcggtactacgttcgaggccgaaccggcccgaaccccgtaattactttaacgttagtcggttacggtttcctttacggccggttacccgttagggttacgggtttctagtccggttacttccggtccgtactaccgtaacgttccgtacgaaccgtaaccgtccggtacccttacccggtactaaccgtaccttaccgtaccgtaacggtaccttacccgggtaggtacccgttaggggaccgggtaaccgttaaggttccttaagttaaccgttttaagttacgttcggacgtactaccgtttacaaactttaacgttacgtaaacgggttaaacctaacgttcgggtttaaaccgttccgtacccgttaacggggtttcgtccggggtttttaaccgggccggggggttaaaccgggaaccggtttaacccgttaacgggtttacccgggtaacccggtttaccgtttaacgggacccggtaaaccccggtccccggttaaggtccccctttaacccccgggg

SEQ ID NO: 84310 - DNA, 745 bp, Homo sapiens
  misc_feature: GYAE6OF02H6Y1J.36.23.C01.1.454.CMB.1.raw
  modified_base (177)..(177): a, c, t, g, unknown or other
  misc_feature (177)..(177): n is a, c, g, or t
  modified_base (203)..(203): a, c, t, g, unknown or other
  misc_feature (203)..(203): n is a, c, g, or t
  modified_base (208)..(208): a, c, t, g, unknown or other
  misc_feature (208)..(208): n is a, c, g, or t
  modified_base (217)..(217): a, c, t, g, unknown or other
  misc_feature (217)..(217): n is a, c, g, or t
  modified_base (222)..(222): a, c, t, g, unknown or other
  misc_feature (222)..(222): n is a, c, g, or t
  modified_base (236)..(236): a, c, t, g, unknown or other
  misc_feature (236)..(236): n is a, c, g, or t
  modified_base (253)..(253): a, c, t, g, unknown or other
  misc_feature (253)..(253): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcacgtcgagggccacgtacgggtcctgggcccaggtctggacctgacacngtcctgccctcgtgtctgagcctccnggacngcgatcacntctcngcacgtcggaaccngctagtcgacgtttggngtcttataattatgtctctcggttaccaactgctattacaggtcacggaccgaccccgtaaacttcttttaaactttaagttcggtaacgtttccgtttccggtccggtccccgttacggttaacggggttttctacggttccgtccttttaccgtcccggtccgtaccgtacgttccgtacggtaccaaccgtacccggtccccttccgtacgtaacctagttcccgttacgttaaccggtaccttaccggacggtcgtacgggtaacgggtaacccggacgggttcctaacggtttaattaacgtttaccgtcgaccgtacgtaccgttacgtaaacgttaactaacggtaaagttacgaccgtacgactaaccgttcgtactttaccgttacgggtaacgcgggttaaacccgtagggttacccctacgttccggttaccggttcggacccgttacccggaacccggtacccggacccctaaaccccgg

SEQ ID NO: 84311 - DNA, 712 bp, Homo sapiens
  misc_feature: GYAE6OF02F53Z2.36.23.C01.1.454.CMB.1.raw
  modified_base (234)..(234): a, c, t, g, unknown or other
  misc_feature (234)..(234): n is a, c, g, or t
  modified_base (288)..(288): a, c, t, g, unknown or other
  misc_feature (288)..(288): n is a, c, g, or t
tcagtacgctgtctcacgaccggtgctcgatttagtacacgtgattagggattgggggggggtctcaggtggcagcgctctcaggacactctccaccatggcctgggctctgctgctcctcaccctcctcactcagggcacagggtcctgggcccagtctggcctgacacagcctgccctccgtgtcctgagacctcctggacagtcgatcaccatctcctgcactggaaccanctagtgaccggttgtgcttaataattatgtccttaccgttggttacccaagacncgtattccaagggccaggcccggtacccccgtaaaacttccgtttaaaattttacgtacggtaacggtttccttttaccgggtccgggtccccgtacgttaagggggttttccctaaggttccgtcctttccgtacccggtactacccgtaagttcgtacgggaacctaaccgacccggtcccttaccccgtagtaacctccttacttacctaacgtacctccggtaggtcctacgggaacgggtccggacggtacttacggtacctttaattacgttacgaccttaagggtccttaaccgtaattaaccgtttaacgtaagtaacgtacttaaagtcggtaaactcccgtatcgggtactacggtttcgggacggtacggaaccttagtcgtacccgtcgttcggaactcgaccgtagtcccg

SEQ ID NO: 84312 - DNA, 697 bp, Homo sapiens
  misc_feature: GYAE6OF02FG64S.36.23.C01.1.454.CMB.1.raw
  modified_base (246)..(246): a, c, t, g, unknown or other
  misc_feature (246)..(246): n is a, c, g, or t
  modified_base (394)..(394): a, c, t, g, unknown or other
  misc_feature (394)..(394): n is a, c, g, or t
  modified_base (425)..(425): a, c, t, g, unknown or other
  misc_feature (425)..(425): n is a, c, g, or t
  modified_base (497)..(497): a, c, t, g, unknown or other
  misc_feature (497)..(497): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgccctcgtgtctgagactcctggacagtcgatcaccatctcctgccactggaaccagcagtgtacgttggtntcttataattatagtccttccgtggttccaaactagctattcgaggccagccgacccccgtaaacttccttaatttagtgagttcttttccggtccggtcccctagttacggggtttctagtcgtccttcctccggctccgtagtccncggaccacgtaccggccctcccgtgaccctntctactacgacctccgtaggcgtagggaacggacggacggtccgttaggactttacgttaagtcgaccgtanccgttacaagttaacctaacgttcgtaaaacgttccgtaaagttcgggtaaaccttcccggtaaccgttgggtcccgtttacgggggttcccggggaacgggtaaaccggggaacccgttttaacgggttacccggtaacccgggttttcccgtaaccgggtaccggtaacccggtaccccgggttaaggtcccccccgg

SEQ ID NO: 84313 - DNA, 701 bp, Homo sapiens
  misc_feature: GYAE6OF02FHT5X.36.23.C01.1.454.CMB.1.raw
  modified_base (199)..(199): a, c, t, g, unknown or other
  misc_feature (199)..(199): n is a, c, g, or t
  modified_base (229)..(229): a, c, t, g, unknown or other
  misc_feature (229)..(229): n is a, c, g, or t
  modified_base (275)..(275): a, c, t, g, unknown or other
  misc_feature (275)..(275): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgacgactcctggacngtcgatcaccatcctcctgcactggaaccngcagtgacgttggtgcttataattatgtcttccgtggttaccaacngctattcgagcacgccgaccccgtaaactcttaatttatcgtagttctttccgccggtccctacgtacgggttttcacggttcgtcctttccgtccggtcctaccgtaacgttcgtacggaccgtaaacgtcccggtcccttacccgtacgaaccctactccgtaccgtaacgtaccgtaccgtacggtacgtacggacggtacggtacggtacgttacgtaacgttaacttacgttacgtaccgtacgtacctacgtaacttacgtaacgttacgtaacgttaacgtaacgttacgtacgttaccgtacgttacggtacgttcggttaccgggtaccgggtaacgggtaacccggttaacggttacctacccgggggggttaccttaccgggttaccggtaccggtacccggtacggtaccccgg

SEQ ID NO: 84314 - DNA, 875 bp, Homo sapiens
  misc_feature: GYAE6OF02GZCWS.36.23.C01.1.454.CMB.1.raw
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagactctggacagtcgatcacctatctcctgcacgtggaaccagcagtcgtacggttggtcgtacttataaatttatcggttccttcccgttacggttacccaaacgagtcctaacttcgaagggtaccacggtacccgtaacccccgtaaaccgtttacttttaaactttacgtaggttacggtttaccgttttccgtccggtaccccgttacgtacgggggtttttcctacggttccgttcctttacccggttcccggtaccttacccgtaaacgtttccggtacgggtaaccctaaaccgtaccccgggtaccccttaccccgtaccggtaacccgttaaccgtttcccttacccgtaaccggttaccccgtaacccggtaacggggtccgttaacggggtaacgggtaaccgggacgggtaccgttaacggttaaaccgttttaacgtttaacgtttacggtaccgtaacggttaccttacgtaacgtttacttaacccgttaaggtaacgtttaacaaggtttacggttaccgtaccgtaacggttcgggtccggtttacggggttcccgggggtaaccgggttaaccggggtaaccgttaaacggggtttaccggtaaccccggtttaccgggttaaccgggtaccggtaacccgggtacccggtaaaccgggttcccccgg

SEQ ID NO: 84315 - DNA, 657 bp, Homo sapiens
  misc_feature: GYAE6OF02FK0FN.36.23.C01.1.454.CMB.1.raw
tcagtacgctgtctcacgaccggtgctcgatttagtacacgtgattagggattgggggggaaatactttctgagactcatggacctcctgcacaagaacatgaaacacctgtggttcttcctcctcctggtggcagctcccagatgggtcctgtctcaggtgcagctgcagcagtcgggcccaggagtggtgaaccgccttcggagaccctgtccctcacctgcgctgtgtctggacgccctccctgggcggagactgaatgggtggaggttcggggtccgccgacggccccccgagggggaacggggcctggtaggttgggtagttggggtagaaaagttaaagtggaacggaccggggggaccaaccgaactaacgaatcgccgtcccgtacgaggggtacgagtccacatactctgcagaacaacgtaccgaacgaacctacttacctccctagacggtctacgtacctcgtgtacgacccgcgccggtacgtccggactagtactattacttgtgtcgtaggttagttttgacgtaggtacgttcgggttacgggcggttacgtccggtacggtcggttcggggtaacgaaggggtactacggtaccggtctacgttccggtaccttcccgtacgtacgtcccctaaccccgg

SEQ ID NO: 84316 - DNA, 795 bp, Homo sapiens
  misc_feature: GYAE6OF02GH86I.36.23.C01.1.454.CMB.1.raw
  modified_base (277)..(277): a, c, t, g, unknown or other
  misc_feature (277)..(277): n is a, c, g, or t
tcagtacgctgtctcacgaccggtgctcgattagtacacgtgattagggattgggggggggtctcaggaggcagcgctctcaggacatctccaccatcggcctgggctctgctgctcctcaccctcctcactcagggcacagggtcctgggcccagtctggcctgacacagcctgcctccgtgtctgacgactccgtggacagtcgatcacatcctctcgcacgtaggaaccagcagtgacggttggtgacttataattagtgtctcgtgtaccaangcatcgacgcgacgccgaccccgtaaattcttaatttgtaggtacgttctttacggtccggtaccctggttacgggtttaccacggttccgttccttccgtccggtccttaccgtaaggttccgtacggacctaacccggtaccggtccccttacccggtacgaccctacttaccgtacctaacgtacccttaccggtaaggtccgtacgggaacgggtaacccgggtaacgtaccggtttacgtaaaccggttttaacgttttcgttaacgggacccttacgggttaccttaaacgttaaacgtttaacgtttaaccgttaaggtaaaccggttaaataaaccggttttgggtaacccttacccgtaacgggttacgttacccgggttcggggtttacccgggaacggggttaacccggttaaacccggtttaacgggttaacccggtaacccgggttttacccggtaaacgggttacccggaacccgggttaccccggtaagggttacccccccgg

SEQ ID NO: 84317 - DNA, 813 bp, Homo sapiens
  misc_feature: GYAE6OF02IPRHI.36.23.C01.1.454.CMB.1.raw
  modified_base (259)..(259): a, c, t, g, unknown or other
  misc_feature (259)..(259): n is a, c, g, or t
tcagtacgctgtctcacgaccggtgctcgatttagtacacgtgattagggagttgggggggggtctcaggaggcagcgctctcaggacatctccaccatggcctgggctctgctgctcctcaccctcctcactcgaggcacgagggtcctgggacccagtctcggcctgaccacgagcctggccctccgtgtctgacgtacctccgtaggactagtaccgatccacctacttcctccgtgacctacgtaccggaaaccnggaccaggtcgtacggtttgggtgttactttaaattaactttagttcgttaccgttccgttacggttacccaaacgtacgtactaacgttacgacgggtaccaaccggtacccgtaaccccgtaaacttttaaccgtttaagtttacggtaggtacggtttccgtttaccggtccgtccgttacggttacgggtttctacggtccgtccgtttccgccgtcttacgacgttcgtcgaaccacgtccgtccctacctcgaccgtactccgtacgtacgtaccgtcgaggtcgtaacggacggtaaccggtcggtaccgttacgttaccgttaagtttacgttcgacctacggtacttaacgtaaactttaccggtaaagttacggtaacgttaacttaacggttaacgtaccgtacccggttaatccggggttcggtttaccgggtacccggggtaacgggtaaaccgggtaacccggtttaagggttaccccggttaaccggtttacccgggtacggaccccgtaaccggtacccgggttaccgtacccccggg

SEQ ID NO: 84318 - DNA, 577 bp, Homo sapiens
  misc_feature: GYAE6OF02GBSEZ.36.23.C01.1.454.CMB.1.raw
  modified_base (250)..(250): a, c, t, g, unknown or other
  misc_feature (250)..(250): n is a, c, g, or t
  modified_base (279)..(279): a, c, t, g, unknown or other
  misc_feature (279)..(279): n is a, c, g, or t
  modified_base (313)..(313): a, c, t, g, unknown or other
  misc_feature (313)..(313): n is a, c, g, or t
  modified_base (330)..(330): a, c, t, g, unknown or other
  misc_feature (330)..(330): n is a, c, g, or t
  modified_base (460)..(460): a, c, t, g, unknown or other
  misc_feature (460)..(460): n is a, c, g, or t
  modified_base (487)..(487): a, c, t, g, unknown or other
  misc_feature (487)..(487): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagtactcctggaccaggtcgatcaccatcctcctgcacgtacggaaccagcagtgacgttggntcttataattatgtctcctggttaccaanagctattcaggcagccacccgaacttcttaattngtacgtcttcgcgcctntcgggttcagtctcttctccggctaccaagtctacgacaacgtaccggtcctccgtagacctatccgtcaacgtactccgagtcgtgaacgggcaggtcttacggacttattacgtcgtactagaccgtntaacgttactaacgttcgaaacgttanaaacgtttcggaactccgaacgtggtacttggtacgggacggtacgggaactagggttccaccggttacaggaccacgaccaggtacccg

SEQ ID NO: 84319 - DNA, 1078 bp, Homo sapiens
  misc_feature: GYAE6OF02H80TC.36.23.C01.1.454.CMB.1.raw
  modified_base (199)..(199): a, c, t, g, unknown or other
  misc_feature (199)..(199): n is a, c, g, or t
tcagtacgctgtctcacgaccggtgctcgattagtacacgtgattagggagttgggggggggtctcgagggaggcgagcgctctcaggacatctccaccatggcctgggctctgcctgctcctccacctcctcactcagggcacagggtcctgggcccagtctgggcctagaccacagcctgccctaccgtgtctgganaccttccgtgggacacggttcgaacttccaaccctatttcctcccgtagaccgtaacgtacgggaaccaagggcctaaggttcgggtaaccggtttgggttcggacgttttaagttaaactttaaagttcggttttccttccccgtttacggggtttacccaaaccgtaggtaaccttagtttacccgttaacgggtccgaaccggtaccccggtaaacccccggtaaaaccgtttaaccctttttaaacgttttttaaccggttacgggtttaaaccgggtttcccgttttttaccgggttaccccggggttaaccccggttttccggggtaaaccggggggttttttaccgttaacgggtttaccccgggttttaacccggtttccggtttccccggggttcccggtaaacccccgtttaaaacggttcccggttaccggggttaaaccggttaaacccccgtaaaccgggggtacccccgtttacccccgggtttcccgtaaaccccgtttaaccgtttcccgtttaacccgttaaccggtttaaccccgtaaccccggtaccgggtaccgttaacccggggttaaacggggaccgggggttaaccgtcggtttaaaccgggtaacccgtttaaaggttttacgtttaccggtaacgttacgggaccttttacccgtaatttacgttaacccgttaaccgtaaaggttaaccgttaaacgtttacgggtaaaccgtttacccgtaccggttacggtacggttttacccggttacgggggtaacccgggggttacgttaacccggtaacgggttttacggtaccccggttacggtaccggtttaccggaacgttacccggaaccgggtttacccggg

SEQ ID NO: 84320 - DNA, 632 bp, Homo sapiens
  misc_feature: GYAE6OF02FKM2R.36.23.C01.1.454.CMB.1.raw
  modified_base (239)..(239): a, c, t, g, unknown or other
  misc_feature (239)..(239): n is a, c, g, or t
  modified_base (255)..(255): a, c, t, g, unknown or other
  misc_feature (255)..(255): n is a, c, g, or t
  modified_base (285)..(285): a, c, t, g, unknown or other
  misc_feature (285)..(285): n is a, c, g, or t
  modified_base (496)..(496): a, c, t, g, unknown or other
  misc_feature (496)..(496): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgacgacctccgtggacagtcgatcacctagtcctcctgccacgtacggaaccngcagtgtacgttggtncttataattatgtcttccgtgttaccaacngctagttcaggtcacggccgaccccgtaaattcttaaatttagcggtagttccttcggtccgtcccgtaggttacgggttctacgtccgtcttcgtccggtctaccgtagtcgtacggaccaaaccgcccggtcccttcccgtagacctacgtctacctacgtcctccgtaggtctaggacggtacgacgtctgtacttattatcgactanctagtattacgtacgtagtaagtactaaggttctacgtaccgtacgttcgtcgttacgggtcggggacggtaacgggtaccgtacggtttcgacccgttccggtacggtacccgacggtacccgaggttcccccgg

SEQ ID NO: 84321 - DNA, 511 bp, Homo sapiens
  misc_feature: GYAE6OF02F1TFD.36.23.C01.1.454.CMB.1.raw
  modified_base (228)..(228): a, c, t, g, unknown or other
  misc_feature (228)..(228): n is a, c, g, or t
  modified_base (268)..(268): a, c, t, g, unknown or other
  misc_feature (268)..(268): n is a, c, g, or t
  modified_base (413)..(414): a, c, t, g, unknown or other
  misc_feature (413)..(414): n is a, c, g, or t
tcagtacgctgtctcacgaccggtgctcgattagtacacgtgattagggattggggggggtctcaggaggcagcgctctcaggacatctccaccatggcctgggctctgctgctcctcaccctcctcactcagggcacagggtcctgggcccagtctggcctgacacagcctgccctcgtgtctgagactcctggacagtcgatccaccatctcctgcactggaaccngcagtgacgttgtgcttatattatgtctctggttccaacngcattcaggcagcgccccgtaactcttaattatgagtctttcgtcggtcctctagggtttctagtcgtctctccggctcaagtctggcactcgcctcctgaccatctctacgactcaggctgacgcgagctagtactattatgcnnctcatatacgtgaatacaatcggtactacgtactgtctagttcgggacggtacggaccgtaagttcgacccgtcgtacgtcgacgtcccgagtcccg

SEQ ID NO: 84322 - DNA, 666 bp, Homo sapiens
  misc_feature: GYAE6OF02FKBMI.36.23.C01.1.454.CMB.1.raw
  modified_base (201)..(201): a, c, t, g, unknown or other
  misc_feature (201)..(201): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagacctcctggacngtcgatcaccatcctcctgcacgtggaaccagcagtgacgttggtgcttaataattatgtctcctggttccaacagcattcaggcacgccgaccccgaaacgttcttaattttagtgtaggttcttttcggtccggtccccttcgtaggggttttctaggttcgtctttccgtcccggtcctaccgtaacgttccgtagggacctaaaccgtccgggtcccttaccccgtagaaccctacttcctaccgtaacggacctacccgacggtccgtaggtacgggacggtacggtcgttacggaacctttaagtttacgttcgaccgtacgccttactaacttacgttaacgttaggaaacgttacgtaaagttcggttaactcccgagttcggtacgttcgggttcgggcgggaacgggtaacctaaggttaccgtaccgtcgttaggtccacgtacccgagtcccg

SEQ ID NO: 84323 - DNA, 668 bp, Homo sapiens
  misc_feature: GYAE6OF02FK6ZL.36.23.C01.1.454.CMB.1.raw
  modified_base (584)..(584): a, c, t, g, unknown or other
  misc_feature (584)..(584): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcacgtggaaccagcagtcgtacggttgtgtcttaataattatcgtcttccgttggttaccaacagctattcgaggcacgccgaaccccgtaaatttacttaatttagtcgtacggtttcctttcggtccggtccccttaggtacggggttttctaggtccgtcgttccgtccggtcttaccgaagttcgtggacctaaccgtccggtcccttccgacggtaccctatttaccacgttaccgtacctaccggaggtccgtacggaaggtaccggacggtcttaggtaacctttattacttcgactacgtccttacgaatttactacgtaggtaacgttaccaaagttcgtaactaccgtagttcggngttacgggtccgggacggtaacgggtaccttaagggttaccgacccgttacggttaacggccgaaccggtaccgagggtccccg

SEQ ID NO: 84324 - DNA, 734 bp, Homo sapiens
  misc_feature: GYAE6OF02H083I.36.23.C01.1.454.CMB.1.raw
  modified_base (232)..(232): a, c, t, g, unknown or other
  misc_feature (232)..(232): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacgagggtcctgggcccagtctcggcctgacacagcctgcctccgtgtctgagactcctggacagtcgatccacatcctctgcacgtcggaaccngcagtgacgttggtgtcttataattatgttcctccgttcggttacccaacagctattcaggcacgccgaccccgtaacttacctttaatttacgtggtacgtttcgtttccggtccgtcccgttcggtacgggtttctacgtccgtcgtttccgtccggtccttaccgaacgttcgtacgtaccgtaaccgcccggtcccttacccgtacgaccctacttcccgtacgttaccggtacccttacccggaccgggttacgttacgggaacgggtaaccgggtacggttaccgttaacgttaacctttagtttaacgttcggacctaccgtccttactaacgttaacgttacgtaacggtaacgttaccgtaaggttcggttacttacccgtacgttacggttccgtttcggggtaccgggtaccggggtaacgggtaacccgttaggttacccggtacccggttccggttaccggaccgtacccggcccgtaacgggtccccg

SEQ ID NO: 84325 - DNA, 706 bp, Homo sapiens
  misc_feature: GYAE6OF02GL3U7.36.23.C01.1.454.CMB.1.raw
tcagtacgctgtctcacgaccggtgctcgatttagtacacgtgattagggagttgggggggggtctcaggaggcagcgctctcaggacatctccaccatggcctgggctctgctgctcctcaccctcctcactcgagggcacgagggtcctcgggcccagtccgtggcctgacacgacgcctgcccttccggtgttactggacgtacctccgtagggactagtcgactcaccattcctctgcctacgtacggaaccagcctaggtgtacggttggtcgtacgttaatacttattcgtccttcgtacgttacaacgtcgctattcgagtcacgccgacccgtaattacttaattcgagtacggttcgtttcggtaccgtcccgttcggttacgggttttcgtacgttccgtcctttcggtaccggtccgttaccgtaacggttcgaccggtacaaaccgtccggtacccttcccgtacgaccttacgttaccgtactacgtaccttcgaccggtacgtacgggacggtacgacgtacgtacgtaacttgttacgtgtaccaggttcctaacgtaattcgtaacgtgttaaacgtcgtaacgtagtaccgtcccaggttcgtcggttcggttcgggagggttaccgggtaacctacggtttacgacccggttaccggttagacccggaaccgtaccggacggtccccg

SEQ ID NO: 84326 - DNA, 883 bp, Homo sapiens
  misc_feature: GYAE6OF02II4E3.36.23.C01.1.454.CMB.1.raw
  modified_base (176)..(176): a, c, t, g, unknown or other
  misc_feature (176)..(176): n is a, c, g, or t
  modified_base (212)..(212): a, c, t, g, unknown or other
  misc_feature (212)..(212): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcgagggcacgagggtcctggggacccagtcctggcctagacacngcctgcccgtcgtcgtctaggagcctccgtggaacnggtccgatcccaccattcccgtccgtgcctaacgacgggaaccagtcagggttcggtacggtttggtcgtactttaagtatttagtcggtccttaccgtcggttaccaactaggcctacgtcgaaggccgtacgcccgggtaacccctaaactttcgtttaacgtttacgtcggttacggtttccgtttaccggtccggtacccgttacgggttacgggttttacgtcgttccggttccttcccggttaccggtccttaccgtacgtcgttaccgggacctaaacccggtcccgtcccgttaccgtaccggtacctacgttcctaccgtacgtaccctaccggtagtaccggtacggaccgggtacggtacggtaccgttcggtaacgtttacgttacgtttacggacccgttacgtaccgtttaacctaacgtttaccgttaacgttaacggtaaccgttacgttaacgttaaccgggttaacccttaccggaacccggttcggggttaaccgtttccggggttaacccggggtaccgggggttaacccggggtttaaacccggtttaaccgggtttaccccgggtttaaccccggttttaccggggttaaacccggttacccggggttaaaccccgggtacccgggttaaacccggtttcccccccggg

SEQ ID NO: 84327 - DNA, 751 bp, Homo sapiens
  misc_feature: GYAE6OF02HT3DR.36.23.C01.1.454.CMB.1.raw
  modified_base (129)..(129): a, c, t, g, unknown or other
  misc_feature (129)..(129): n is a, c, g, or t
  modified_base (142)..(142): a, c, t, g, unknown or other
  misc_feature (142)..(142): n is a, c, g, or t
  modified_base (225)..(225): a, c, t, g, unknown or other
  misc_feature (225)..(225): n is a, c, g, or t
  modified_base (541)..(541): a, c, t, g, unknown or other
  misc_feature (541)..(541): n is a, c, g, or t
tcagtacgctgtctcacgaccggtgctcgatttagtacacgtgattagggagttgggggggggtctcaggaggcagcgctctcaggacatctccaccatggcctgggctctgctgctcctcacctcctnactcagggcacgngggtcctgggcccagtcctgggcctgaccacacgtcctgcccgtcgtgtctgacgtccttcgtggactggtcgatccaacctntcctccgtgactacggtacggaaccaggcagggtgttaccggttgggtctacgttaattaatttagtcgtttcctaccggttacgtttaccgaactacggtactacgttccgaacggccgacgcccggtaaccccgtaactttacctttaagttagtacggttacggttccgtttccggtcccggtccccgtttaggtacggggttttaccgacggttccggttccctttccggtacccgtccgttaccgtaaacgttcggttacgaccgaaccgtcccggtcccttaccgtccgactactccttactcggtaccncccggtaaggtctaggggaaccggcggtacggttacgaacgttacgtttaagtttccgtaacgcgacgttactacccgtaattaccgtacgtttacggaacttagaaaccgttcggtaacttccgtagtacggtcgttcggggtccggagggtaccgaaccgtaggttcccggacgtttccggtacgtacgtaccgtaccgacggtcccg

SEQ ID NO: 84328 - DNA, 775 bp, Homo sapiens
  misc_feature: GYAE6OF02JN4WB.36.23.C01.1.454.CMB.1.raw
  modified_base (168)..(168): a, c, t, g, unknown or other
  misc_feature (168)..(168): n is a, c, g, or t
  modified_base (223)..(223): a, c, t, g, unknown or other
  misc_feature (223)..(223): n is a, c, g, or t
  modified_base (238)..(238): a, c, t, g, unknown or other
  misc_feature (238)..(238): n is a, c, g, or t
tcagtacgctgtctcacgaccggtgctcgatttagtacacgtgattagggattgggggggggtctcaggaggcagcgctctcaggacatctccacatggcctgggctctgctgctcctcaccctctcactcgaggcacagggtcctgggcccagtctggcctgacacngcctgcctccgtgtctagacgacctccgtggactagtcgatcaccatcctccgtncactcggaaccagcngtgcgttaggtgtacttataattacgtgttctccgttagtaccaactacgctacttacgaggtaccacggcccgacccccgtaaacttcgttttaatttacgtaggtacgtttacctttccgggtcccggtaccccgttggtaaccggggttttctacggtttccgtccgttttccgttccccgggtaccttaacgacggttcttacgggccctaaaccgttaccccggtccctttacccggtctaacccgtacttcctaccgtacgtaccccgtccgtacgggtccgtacggtacgggtaaccggacgggttccgtacggttaactttacgtttaccgtggtaccgacggttacctaacgtactttacgtaaactttaccggtaaagttaaccgttaagtacggttaccgacccgttagtacccggttgtttaccgggttccgggaaccgggtaaacgggtaccgttaacccgggtttaggtaacccccggttcggttaaccggaccgtaccgacccgggttaaccggtcccccgg

SEQ ID NO: 84329 - DNA, 781 bp, Homo sapiens
  misc_feature: GYAE6OF02G28Z2.36.23.C01.1.454.CMB.1.raw
  modified_base (572)..(572): a, c, t, g, unknown or other
  misc_feature (572)..(572): n is a, c, g, or t
  modified_base (686)..(686): a, c, t, g, unknown or other
  misc_feature (686)..(686): n is a, c, g, or t
tcagtacgctgtctcacgaccggtgctcgattagtacacgtgattagggagttggggggggtctcaggaggcagcgctctcaggacatctccaccatggcctgggctctgctgctcctcaccctcctcactcgagggcacgacgggtcctacgggcccagtcgtggcctgacacagcctgcctccggtgtcgtgacgtacctccgtaggacaggtccatcaaccatccgtcctgccaacgtacggaaccagacgtaggtacgtacggttggtactactttaattaaattacgttcgttccttccgttacggttacccaaacgacgtactaacgttaccgacggtcgaaccgtaccccggaaaccccgttaaacgtttaactttaaacgtttacgtaggtaaccggttttctttccggtacccggtacccgttacggttaacgggggttttaccttacggtccgttccgttttccgtacccgggttcctaaccgtaacggttcgtacggtacctaaaccgtacccgggtccctaccgtacgaaccctagtacccgttacgacgtacctaccgnggtacgtaacggtacggacgtcgtacgtagtaaccttagttacgtgtacctagtacctcgtaaagtttaacgaccgttaagtaaacgtacgttaaagtccggttaactacccgngttacggtctttaccggggacggtaccgggtaacggtaacctaaggttccggtacccggttaactagggtacccaacgtccgtaacggtccccgg

SEQ ID NO: 84330 - DNA, 699 bp, Homo sapiens
  misc_feature: GYAE6OF02GGQ9H.36.23.C01.1.454.CMB.1.raw
  modified_base (200)..(200): a, c, t, g, unknown or other
  misc_feature (200)..(200): n is a, c, g, or t
  modified_base (460)..(460): a, c, t, g, unknown or other
  misc_feature (460)..(460): n is a, c, g, or t
  modified_base (560)..(560): a, c, t, g, unknown or other
  misc_feature (560)..(560): n is a, c, g, or t
tcagtacgctgtctcacgaccggtgctcgatttagtacacgtgattagggagttgggggggggtctcaggaggcagcgctctcaggacatctccaccatggcctgggctctgctgctcctcacctcctcactcgagggcactagggtcctgggcccaggtcctggacctgacacgtacgccttgccctcgttgtctgganacctcctggacagtcactcacctatcctcgtagcacgtacggaaccagctacggtgacgttggtcgtcttataattatcgtcttccgtcggttaccaaccgtagctaacttcaggtcaacgccgaccccgtaaattcttaatttagtcgtacggtttctttccggtcggtcccttaggtcgggtttactacggttcgtccttcgtccggtctacccgaaggttcgtacgccgaacgtccggccgttaccctagtaacccnttaccgtctaacggacctcccggaagtcgttaacgggacggtaacggtcgtcgttacgttaacttaacgtttacgttcgaccgttaggccttaaaccgtntttaaacgtactacggttaaacgtacgtaagttcggtaaacttcccgtagttgtacgtccgggttaacgggccggaaggttaacccgtacggttcggtacccgttacggtacgtacggtaacccgcgttaaccggtccg

SEQ ID NO: 84331 - DNA, 899 bp, Homo sapiens
  misc_feature: GYAE6OF02HQ1TU.36.23.C01.1.454.CMB.1.raw
  modified_base (247)..(247): a, c, t, g, unknown or other
  misc_feature (247)..(247): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcaagggcacgagggtcctagggcccagtctggcctgacacagcctgcctccgtgtctgagacctccgtggactaggtcgatccaacctatcctccgtgcctaacgtcggaaaccngtccaaggtcgacggttggtgtacctttaagtaaattactacgttacctccgttacggttaccaacgtagtacctaagttaccgaacgggtccaacggtccccggaacccccggtaaaactttacgttttaaatttacgtacggtaccggttttaccgttttaccggtaccggtcccgttaggttacgggggttttactaacggttccgttccgttttacccgtacccgggtaccttacccgtaaacggttccttacgggaacctaaaccgtacccggtaccccgttcccgtaaggtacccgtaattccccgttaacgttaaacccgtaccgtttaacccgggaacggtaccgtttaacgggaaccgggtaacccggtaagggtaccttaacggttaaacctttaacgttttaccgtacgggaaccttaaccggacgtttaccaaacgtttacgtaaaccgttaggtaaaccgtttacgtaaacggtttacggtaaactttcccgtaaccggttagggttaccggtttaccggggtaaccggggttacccgggggaaacggggtttaaccctaaacggggttttacccggtaacccgggttaccggttaaacggttcccgggaaacccgtaacccggtaccgggtaccccgg

SEQ ID NO: 84332 - DNA, 653 bp, Homo sapiens
  misc_feature: GYAE6OF02IDF4Q.36.23.C01.1.454.CMB.1.raw
  modified_base (178)..(178): a, c, t, g, unknown or other
  misc_feature (178)..(178): n is a, c, g, or t
  modified_base (256)..(256): a, c, t, g, unknown or other
  misc_feature (256)..(256): n is a, c, g, or t
  modified_base (275)..(275): a, c, t, g, unknown or other
  misc_feature (275)..(275): n is a, c, g, or t
  modified_base (645)..(645): a, c, t, g, unknown or other
  misc_feature (645)..(645): n is a, c, g, or t
tcagtacgctgtctcacgaccggtgctcgatttagtacacgtgattagggagttgggggggggtctcaggaggcagcgctctcaggacatctcccaccatggcctgggctctgctgctcctcaccctcctcactcgagggcacgacgggtcctcgggcccagtcgtcggcctgacacngcctgcctccgtgtctgacgtacctccgtaggacaggtcgtatccaaccattcctccgtgacctacgtacggaacccnggcaggtcgacggttggtntacttattaacttatcgtcttctcggttaccaatgctatcgagcacgccacccgtaattctttatgtgtacgttcgttcggccgtccgtggttacggttctacgtcgtcttccgccggtctcgtaagtccgtacgacaaccgtccggtccctcccgtacgtaccctacgtccgttaccgtaacgtccgtccgtaacggtcgtacgggacggacggtcgtccttaggtacttacttagtcgctacgccgttataacgttctagtagtaagtacttacggtacgtccgtaccgtagtcggtacggttcgggtcggaacgggtacggacgttacggtccgtaccgtaggtaccgtaccggtacgaccccggtntaccccgg

SEQ ID NO: 84333 - DNA, 817 bp, Homo sapiens
  misc_feature: GYAE6OF02JUTND.36.23.C01.1.454.CMB.1.raw
  modified_base (216)..(216): a, c, t, g, unknown or other
  misc_feature (216)..(216): n is a, c, g, or t
  modified_base (238)..(238): a, c, t, g, unknown or other
  misc_feature (238)..(238): n is a, c, g, or t
  modified_base (600)..(600): a, c, t, g, unknown or other
  misc_feature (600)..(600): n is a, c, g, or t
tcagtacgctgtctcacgaccggtgctcgatttagtacacgtgattagggattgggggggggtctcaggaggcagcgctctcaggacatctccaccatggcctgggctctgctgactcctcacccgtcctcactcagggctacgagggtcctgggcccagtctggcctgacacacgtcctgccctcggtagtctaggacgccttccgtggggaacncggttacgattcccgaaacctnttccttccggtaggaccaacggttacggggaaaccccagggtcctaagggtcgtaccgggtttggtcgtactttaagtaattaatcggttctaccgtacggttaccaaccgtaggtacctaacgttacgacgggtaccgaacgccccggtaacccccggtaaaactttaccttttaaagtttacgttaaccgggttaacgggttttacccttttcccgggtaccgggttccccgtttaccggggtacgggggtttttacctacgggtttccccgtcgttttaacccggtcccgggtactttaccccggaaaggtttccgtaacggtaccaaaccgtccgggtaccctccctacgtaaccgtntacccttagtacccgtacgtaccgtcggcgtacgggaacgggaccggtagtaccgtacgtacgttacgttacgtcgtacggactccgttacgtactaacgtacgacgtacggtaataacggtacggtactacccgttagtacgggtctcggggttaacgaccgggtagaaccgttggttaccgaccgttacggacgttcgacgtaccgtgggtaccc

SEQ ID NO: 84334 - DNA, 807 bp, Homo sapiens
  misc_feature: GYAE6OF02GPYPQ.36.23.C01.1.454.CMB.1.raw
  modified_base (619)..(619): a, c, t, g, unknown or other
  misc_feature (619)..(619): n is a, c, g, or t
tcagtacgctgtctcacgaccggtgctcgatttagtacacgtgattagggattggggggggtctcaggaggcagcgctctcaggacatcctccaccatggctgggctctgctgctcctcaccctctacactcgagggcacgagggtcctgggcccagtctggcctgaccacacgcctgcccttccgtgtctgagacctccgtaggaccaggtcgaatccacctatcctcctgccactacgggaacctagcgaggtacggcggtttgggtctctttaaataacttagtgttaccttccgttcggttaccaaacgtgacctacgttccaagggccacggtacccgaccccgttaaaacgtttcttaaagttttaccgtaggttacggttttccgttttaccggtccggttcccctaggttacggggttttacacgttccggttacctttccggtccggtacctaccgtaaacggttccgtacggaccgtaaaccgcccggtacccttcccgtaacgacctacgttaccttccgtaacgttacccgaccgtaacgggtacctagggggaaaccgggtacggcgggtaaccgttacgtaaacttagtttaccgtgacccgtanaccttacgtaatttaccgttaaccggtagttaaccgttaacgttaaggttaccggttaacctccgttacggtacggttcggtttaaccgggttaccgggtaacgggtaacccggggtaacttaacgggtttaccgttacccggttggtaacccgggtacctacccgggtacccgacgggttacccccg

SEQ ID NO: 84335 - DNA, 879 bp, Homo sapiens
  misc_feature: GYAE6OF02HDDZX.36.23.C01.1.454.CMB.1.raw
  modified_base (848)..(848): a, c, t, g, unknown or other
  misc_feature (848)..(848): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtccgtgggcccagtctcggcctgacacacgccctcgcctccgtgtcgtgacgtaccttccgtggacaggtccgaactccaacctatccgttcctgaccacgtacggaaccagtaccgaggttcggtacggttgggtcttaacgttttaattaacttttacgtacgtttccttacccgttaacggggtttaccccaaaacgtaggtaccttaaacgtttccggaaccggggtaccgtaccggaaccccccggttaaacccccgtaaaaacttttaccttttaaaaactttttcgggtaacgggttaccggttttcccgtttttacccggtcccgggttaccccttttacgggttaggggttttcccgttaacggttcccgttccgtttaccggtccccgggtaactttacccgtaaacggttccgtaccggtaccaaaccgtcccggggtccccttacccgacggtaacccttcgtccttacccgtagttaccccttcggagggtctaccggggtaggaacccggtggttaccttaacgtattttaacttgtcgactacggttactaaccgtataaacgttcgttaaagaaccgttatacgtcgtacctaacggtcgtcgggtacgtttccggggtaacggaccgggttaaacggtcccgttaacggtttacccggtaaccgggtttcaacccgggggtaaacccnccgggttaacccggtcccggtaacccccggg

SEQ ID NO: 84336 - DNA, 694 bp, Homo sapiens
  misc_feature: GYAE6OF02HNUY0.36.23.C01.1.454.CMB.1.raw
  modified_base (154)..(154): a, c, t, g, unknown or other
  misc_feature (154)..(154): n is a, c, g, or t
  modified_base (162)..(162): a, c, t, g, unknown or other
  misc_feature (162)..(162): n is a, c, g, or t
  modified_base (167)..(167): a, c, t, g, unknown or other
  misc_feature (167)..(167): n is a, c, g, or t
  modified_base (179)..(179): a, c, t, g, unknown or other
  misc_feature (179)..(179): n is a, c, g, or t
  modified_base (211)..(211): a, c, t, g, unknown or other
  misc_feature (211)..(211): n is a, c, g, or t
  modified_base (218)..(218): a, c, t, g, unknown or other
  misc_feature (218)..(218): n is a, c, g, or t
  modified_base (227)..(227): a, c, t, g, unknown or other
  misc_feature (227)..(227): n is a, c, g, or t
  modified_base (251)..(251): a, c, t, g, unknown or other
  misc_feature (251)..(251): n is a, c, g, or t
  modified_base (325)..(325): a, c, t, g, unknown or other
  misc_feature (325)..(325): n is a, c, g, or t
  modified_base (520)..(520): a, c, t, g, unknown or other
  misc_feature (520)..(520): n is a, c, g, or t
  modified_base (526)..(526): a, c, t, g, unknown or other
  misc_feature (526)..(526): n is a, c, g, or t
  modified_base (541)..(541): a, c, t, g, unknown or other
  misc_feature (541)..(541): n is a, c, g, or t
  modified_base (603)..(603): a, c, t, g, unknown or other
  misc_feature (603)..(603): n is a, c, g, or t
tcagtacgctgtctcacgaccggtgctcgatttagtacacgtgattagggagttgggggggggtctcaggaggcagcgctctcaggacatctccaccatggccgtgggctctgctgcctcctccaccctcctcacgcgaggcacgtcgggtccncgggaccngtcgnggcctgacacgngtcctgcctcgtgtctagacgcctcgtggacngtacganaccaacctntcctcgtacgacacgtacggaacncgcgtaggtcgacgggtttgtcgtattaataagttatcgttcgtaccgttgttaccacgacgtctagttaccgngacgcgtacccgtacccgtaatttactttaagttacgtgttacggttctttcccggtccggtacctcgggttacgggtttgtccggtcgtccgttaccgccgttccgtacgacgttacggtcggacaccgtacccggtcctacgtccgtaactcgtacgtcgtaacgtcgtaccgacgtcgaacggtacggacgngtacgngttactagtcgttanacgtctagtaccttagtaacgtagtaacgtaccgttaagtaccggtacgttaaccgtccgtnttaccgggttcgttaccgggggtcgaccgggtacggtaccggttacggttccggtacgttaccggcgtaccgtacgtacccggacgtcccg

SEQ ID NO: 84337 - DNA, 839 bp, Homo sapiens
  misc_feature: GYAE6OF02HT0QC.36.23.C01.1.454.CMB.1.raw
  modified_base (245)..(245): a, c, t, g, unknown or other
  misc_feature (245)..(245): n is a, c, g, or t
tcagtacgctgtctcacgaccggtgctcgatttagtacacgtgattagggagttgggggggggtctcaggaggcagcgctctcaggacatctccaccatggcctgggctctgctgctcctcacctcctcactcgagggcaccgagggtcctcgggcccagtcgtggcctagacacgagcctgcctccgtgtctgacgacctcgtggacgagtcgatccacatcctccgtgctacgtacggaaccngacgtaggtcggtacggtttggagttactttaagtaagtttacgtcggttaccttccggttacggttacaaaacgcgtcgtacttcggacgtaccgaccggtacccggtaaccccgtaaaattttccgttttaaagtttacggtagggttaccggttttccgtttaccgggtccgttacccgttacgggttacggggttttcttaccggttccgttaccgtttcccgtccgggtaccttaccgtaacggttccgtacgggtaccctaaacccggtcccggttccctacccgtccgtaaccgttactccgttaaccgaccgtaccgtcgtaagggtccggtaacgggaaccgggacggtacgtcgtaacgtttaacgttacgtttacgacggtactaaccgttaccttacgtaaagttttacgaacgtttagaaaccgttagtaacggttacgttaaccgtacgtaggttacggtaccggttacggggttacccgggggaaaggtcccggtaaaagtacccggggttttcccgtaaaccccggtcggttaaacgggttaccccgaaccggtttacccgggtaccttaaccccggg

SEQ ID NO: 84338 - DNA, 868 bp, Homo sapiens
  misc_feature: GYAE6OF02H4TG4.36.23.C01.1.454.CMB.1.raw
tcagtacgctgtctcacgaccggtgctcgatttagtacacgtgattagggattgggggggggtctcaggaggcagcgctctcagacatctccaccatggcctgggctctgctgctcctcaccctcctcactcgaggcacgaggtcctgggcccagtctcggcctggaccacgtagcctcgccctccggtgtctggacgtccttcccgtggacgacgtcgatccaacctatcctcctgacctacgtacgggaaccagcctaggtacggtaacgggtttcggtataccgtttaattaactttagttacgttcccttaccggtacgtttaacccgaaccgacggtacttaacgttaccgaaccgggtaccgaaccgtacccccggaacccccgttaaaaccgttttaccgttttaaacgtttacggttacggtttacgggttttccgttacccggttcccgggttaccccgttacgggtaacggggttttccgtacggttcccggttcctttccggtccggtaccgttccgtaacggttacgtcggtacccgtaaacccgtcccggtccccttacccgtacccgtaccttaacgtcgttaaccgttacgaacccttacccggaggtccgaacgggtaaacggtaccgggtaacggccgttaccgttaaacgttattaccgtttacggctaacgtctacctaacgtttacgaacttacggtaaacgtaacgttacggttacgtaaccgtaccgttacggttacggttaccggttacgggcggggttaaccgggacgggttaacccggtaagtttacccgggtaccgtttaacccggacggttaacccgaaccggtccccgaaggttcccccg

SEQ ID NO: 84339 - DNA, 732 bp, Homo sapiens
  misc_feature: GYAE6OF02H7L3V.36.23.C01.1.454.CMB.1.raw
  modified_base (162)..(162): a, c, t, g, unknown or other
  misc_feature (162)..(162): n is a, c, g, or t
  modified_base (227)..(227): a, c, t, g, unknown or other
  misc_feature (227)..(227): n is a, c, g, or t
  modified_base (278)..(278): a, c, t, g, unknown or other
  misc_feature (278)..(278): n is a, c, g, or t
tcagtacgctgtctcacgaccggtgctcgatttagtacacgtgattagggagttgggggggggtctcaggaggcagcgctctcaggacatctccaccatcggcctgggctctgctgcctcctccaccctcctcactcgagggcacgcgggtcctcgggcccngtcgtcggcctagacacgacgcctcgccgttccgtgtctggagcctccgtggacagtcgatcacnttccgcctgacactacggaaccagcagtcgtagttggtgtacttataattntcttacgtctcgtaccagtcgatacgttacgcgacacggaccctaccctaaaacttttcttttaaattgtacgtcggtttccgtttttccggccggtcccgtttagggttaccgggttttagtacgttccgtaccttccgtccgtactacggtacgttcgacggaccgtaaacgcccggtaccttcccgaacgtacctctacgtcccgttaacgccgttacgaagggttccgtagggaaacccggaggtacggtcgttaaccgttaagttactttcggacggtctacgttactaccgttaatacgtaccgtaggttaaacttcggtaaattcggtaaaccttcgtacgtcgggttccgtaggggttacccgggacggtaaccggttaccgttaagggttcccgttacgggttccgtaaccggttacggaccgttaccgggaaccggtccccggg

SEQ ID NO: 84340 - DNA, 817 bp, Homo sapiens
  misc_feature: GYAE6OF02GB0ZQ.36.23.C01.1.454.CMB.1.raw
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgacgactccgtggacagtcgactccaccatcctctgctacgtacggaacctgctaggtcgtacggttggtacgtactttaattaagtttactcggttcctttaccggttcggtttaccccaaacgtacgttactacgttcgaaggtccgaccggaccccggtaacccccgtaaaactttacctttaaagttttaacgtcggttaacggttttccgtttccgggtcccggtaccccgtttacggttacggggttttccttacggttccgtaccgtttccgtacccgggtacctaccgtaacggttcgtacgggaaccctaaccgtacccggtcccttacccgtgtaaccctagttccctaaccgtaccgtacccgtaccggacggtaccgtagggtaaccgggaccgtacggtaccttaaccggtacgtttttaacgttaacggtccgtacgttaccggtacttaacctaaattacccgtttacgttaaacgtaacgttaacgttaacgttaaccggttccaacgttcggttacggtcggttacggggtaacgggaccggtaacgggtaacctacggggtttaaccgacccgttcgtaccggaccggtaacccgtccggtaaccggtccccg

SEQ ID NO: 84341 - DNA, 657 bp, Homo sapiens
  misc_feature: GYAE6OF02JBIAG.36.23.C01.1.454.CMB.1.raw
  modified_base (168)..(168): a, c, t, g, unknown or other
  misc_feature (168)..(168): n is a, c, g, or t
  modified_base (183)..(183): a, c, t, g, unknown or other
  misc_feature (183)..(183): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacncagcctgcctccgtntctgagacctccgtggaacagtcgatccaccatcctcctgccacgtacggaaccagcagtggtacgttggtgacttataattatgttctccgtcggttaccaacagactacttcgaggcacggccgaccccgtaaacttactttaaactttacgtagtacggttcgtttccggtccgtccccgtacggtacgggttttacgtacgttcgtcttccgtccggtcctaccgtacgtcgtacgaccgtaaccgacccggtccctacccgtcgaccctactcctaccgtaacgtacctccggagtcgtaggacggacggacgtcgtagtacttattacgttcgactacgtctactacttatactagagtactaagtacgtacgtaccgtagtcggtcgtcgggttacgggccgggtaacggtacgtaacgtccggttaccggtaccggttaggtccgacggtaccggacggtccccgg

SEQ ID NO: 84342 - DNA, 822 bp, Homo sapiens
  misc_feature: GYAE6OF02GG164.36.23.C01.1.454.CMB.1.raw
  modified_base (183)..(183): a, c, t, g, unknown or other
  misc_feature (183)..(183): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtntctgagtacctccgtggacaggtccgatccacctatcctccgtgacactagggaacccagacaggtcgacggtttggtgtactttaattaattatcgttccttaccgtcggtacccaacagtactacgttacgaacggcacggcccgtaaccccgtaaacttaccgtttaaatttagtacggtacggtttaccgtttcggtacccggtccccgttacgggttacggggttttcctaacggttccggtcctttaccggtccggtccgttaacccgtaacggttccgtacggtaaccctaaccggacccgggttaccccttacccgtaccgtaaccctacgtttccctaaccgtaacgtacccgttacccggtaagggtccggttacgggtacggaccgggtaacggtacgttaacgttaacgttaccgttttacgtacgggtacctaacggttccttacgttaacgttaaccgttacgttaacggtaacgttaacgtaacggtttaaccggtaacctacccgtacgttccgggttacgttccggggtaacggggtaccgggtaacgggtaacgttaaccgggtacggttaccccgttacgggtaaccggtaccgaaccggtacccggtacggtaccccgg

SEQ ID NO: 84343 - DNA, 728 bp, Homo sapiens
  misc_feature: GYAE6OF02GFOJT.36.23.C01.1.454.CMB.1.raw
  modified_base (169)..(169): a, c, t, g, unknown or other
  misc_feature (169)..(169): n is a, c, g, or t
  modified_base (183)..(183): a, c, t, g, unknown or other
  misc_feature (183)..(183): n is a, c, g, or t
  modified_base (202)..(202): a, c, t, g, unknown or other
  misc_feature (202)..(202): n is a, c, g, or t
  modified_base (219)..(219): a, c, t, g, unknown or other
  misc_feature (219)..(219): n is a, c, g, or t
  modified_base (255)..(255): a, c, t, g, unknown or other
  misc_feature (255)..(255): n is a, c, g, or t
  modified_base (267)..(267): a, c, t, g, unknown or other
  misc_feature (267)..(267): n is a, c, g, or t
  modified_base (285)..(285): a, c, t, g, unknown or other
  misc_feature (285)..(285): n is a, c, g, or t
tcagtacgctgtctcacgaccggtgctcgatttagtacacgtgattagggagttggggggggtctcaggaggcagcgctctcaggacatctccaccatggcctggctctgctgctcctcacccttcctcactcagggcacgagggtcctgggcccagtctggcctgacnagtcctgcctcgtntactgacgacctcgtgganacgtcatcaccattccncctgactactggaaccagtctagtgtacggttggtntacttattattntcgtcttctcggtacacngactattcgaggtcacgtccgtaacccgtaaacttctttaaagttcgtagtacggtttaccttcggtccgtccgttacggttacgggtttctaacggtcccgttcgtttccgtcccggtaccttacccgtacgtttacgcggtaaccctaaccgtacccggtacccgtcccgtaccgtaacctaccgttccgtaccgtcgtaaacccgtacgggccggttaacgaccggggtaacgtaaccggggtaccgtcgttaaacgtttaccgtttaatttaccgttacccgacgttaccacgttttaaccgaagttaacgtaacgttaacgaccgtttaaacgacggtttacgacctacttaccggtgtccgttaaccggttacggggacggtaacgtaccgttaacggtccgacggttcgtacgacctacggtccgaacgttccccg

SEQ ID NO: 84344 - DNA, 846 bp, Homo sapiens
  misc_feature: GYAE6OF02IZT1G.36.23.C01.1.454.CMB.1.raw
  modified_base (167)..(167): a, c, t, g, unknown or other
  misc_feature (167)..(167): n is a, c, g, or t
tcagtacgctgtctcacgaccggtgctcgattagtacacgtgattagggattggggggggtctcaggaggcaccgctctcaggacatctccaccatggcctgggctctgctgctcctcaccctcctcactcagggcacgagggtcctgggcccagtctggcctgacncagcctgcctccgtgtctgacgtacctccgtcggacctaggttcgactaccaaccctattccttccctagcctacgtacgggaacccaggctaggttcggacggtttgggtcgtactttaattaagtttaacgttcgttccttccgttccggtttaacccaacgacgtactacgttcaacgggtacgaccggtcccggaacccccggttaaaacctttaaccttttaacttttaacgttacgggttaacggttttccccgtttttccggtacccgggttccccgttaccggggtttaagggggttttaccgttacggttttccgttacccgtttccgtaccccggttaccttacccgtaaacggttccgttacggacccgtaaaccgacccggttacccctacccgtaccgtaacccttactcccgtttaagacccgttactacccggacggtcgtacgggacggaacggtggaccgttattaaccttagtttaccgtataccgtacgtcgttaactaacttaacgttacgttacgaaaggtacttaaacgtttcggtaactaaccgtacgttacgtcgttacggtacggggacgggttaaccgggaaaccgttggtaacccgttaccggttaaccggttcggtaccgtaacgtacccgggtacgttcccgtaccccgg

SEQ ID NO: 84345 - DNA, 729 bp, Homo sapiens
  misc_feature: GYAE6OF02IZAHW.36.23.C01.1.454.CMB.1.raw
  modified_base (352)..(352): a, c, t, g, unknown or other
  misc_feature (352)..(352): n is a, c, g, or t
  modified_base (590)..(590): a, c, t, g, unknown or other
  misc_feature (590)..(590): n is a, c, g, or t
tcagtacgctgtctcacgaccggtgctcgatttagtacacgtgattagggattggggggggtctcaggaggcagcgctctcaggacatcgtccaccatggcctgggctctgctgctcctcaccctcctcactcagggcacgagggtcctgggcccagtctggcctgacacagcctgcctccggtgtctgagaccttccgtggaccaggtcgaatccaacctattccgtcctagccacgtacggaaccagtcagtgtacgttggtgtacttaataattatgttacctccgttaggttaccaaagtcgcttaagttaccgaggtacaccggacccgtaaccccgtaaaactttntttaaacttttagtcggtaacggtttcctttaccggtccgtaccgttacggttacggggtttacctacgtccgttactttcccgaccggtacctaccgtaagtccgtacggacctaacgacccggtcccttacccgtaggtaacctacgttccgtaacctacggtaacccctacggaaggtccgtaaggaaccgggtacgacggtaccgttacgtaaactttagttaacgcgtaaccnggttacctacaagttacgtacgtaagtaacgttactaaggttacgtactaccgtagtacggttcgttacgggtcgggacgggtacggtaacctagggttaccgaccttacggtacgtaccgaacgccgtaacggtcccg

SEQ ID NO: 84346 - DNA, 705 bp, Homo sapiens
  misc_feature: GYAE6OF02IELMZ.36.23.C01.1.454.CMB.1.raw
  modified_base (292)..(292): a, c, t, g, unknown or other
  misc_feature (292)..(292): n is a, c, g, or t
  modified_base (408)..(408): a, c, t, g, unknown or other
  misc_feature (408)..(408): n is a, c, g, or t
  modified_base (567)..(567): a, c, t, g, unknown or other
  misc_feature (567)..(567): n is a, c, g, or t
  modified_base (619)..(619): a, c, t, g, unknown or other
  misc_feature (619)..(619): n is a, c, g, or t
tcagtacgctgtctcacgaccggtgctcgatttagtacacgtgattagggagtttggggggggtctcaggaggcagcgcctctcgaggacagtctcccaccatggcctggctctgctgctacctcaccctcctcacgtcgacgggccacgtagggttcctgggccccagtctggcctgaccacgcgtccctgtcccttccgtgtaccgtggaacgtaccttcccgtcgggaacctcgggttaccacttacccgaacctattccctaccgttggaacctaccgtacggaaccnggccctaaggttccgacgtttggtcgtaccttataattactcgtccgttaccttcggtacctaacgtgactattcgacgtacacggtcccgaacccgtaaacttctttaaacgttntcgtacgttccgttcgtccgtcgtcggttaggttctacgttcgtcttccgccggtactaccgtacgtccgtcgtaccaacgtccggtccctcctacgactacctacctacgttaccgactaccgtaggacgtaggaacggcgtaaggcttagtaacttnttacgtcgacacgtcaagttacttagtaccgtgaacgttactaatgtaaccncgttacgcggtacgttcggtccggtacgggaacgtccgtaacgttccggtaccgtcgttaaccgtcgacggtaccccaggtccccg

SEQ ID NO: 84347 - DNA, 840 bp, Homo sapiens
  misc_feature: GYAE6OF02HVUIP.36.23.C01.1.454.CMB.1.raw
  modified_base (190)..(190): a, c, t, g, unknown or other
  misc_feature (190)..(190): n is a, c, g, or t
tcagtacgctgtctcacgaccggtgctcgatttagtacacgtgattagggagttgggggggaaagtactttctgagactcatggacctcctgcacaagaacatagaaacacctgtggttcttcctcctcctggtggcagctccagatggtccgtgtctcaggtgcagctgcagcgaggtcggcccgaggngtggtgagtcctcggagtacctcgcctcaccgtgccgcgttgtcggtgtcgggacgtccccgttccggtccggacgggagtacgtaggtaggtagggttcggtacggttccgggtaccggacccgtaacccggcccccgggaaagggggtaacggggtccgttaggtaaggttggtaacgttaggtaagtaaaacgttaaagttcggaaccgggaccgggactaaacccgtaaacgttacaagttccggccgttaccgcgggttaacgggaccgtacggtaccaaccgttaataccgttacggcgtaaccgaagtaaaccgtaaccgtaacccgaaaactaacccgtttacccttaacccgttaccggttacggacggttaccgtaacgtacccgggttacttacgggtaaccccgaaccggggcccggttaaccgggaccttaaccggtacctaaacgtttaatttaaacgggtttctaacgggtcgggttaaacccgggttagttttaacggggtttcccttaacggaagttcggtttaccggggtacggtaacgttacgtaccggtaccggtccgggtttagggtacgaacggttcaaccgttcggaattacggtccgtacttcccggaagccctacgtaaccccgg

SEQ ID NO: 84348 - DNA, 737 bp, Homo sapiens
  misc_feature: GYAE6OF02HRTFM.36.23.C01.1.454.CMB.1.raw
tcagtacgctgtctcacgaccggtgctcgattagtacacgtgattagggattggggggggtctcaggaggcagcgctctcaggacatctccaccatggcctgggctctgctgctcctcaccctcctcactcagggcacgagggtcctgggcccagtctggcctgacacagcctgcctcgtgtctgacgactccgtggacaggtcgatccaccatccgttcctgacactacggaaccagtcaagtgtacggttggtgtactttaataatttagtcgttcttccgttggtttaaccaaacacgtacttaacttcgacggtcgacggacccgtaaccccgtaaaactttcttttaaacgtttacgtaggttacgtttccgggttttccgtacccggtcccgtttaacggtacggggttttcctacggttccgtcctttccgtccggtacctaccgtaacggttcgtcggaccaaccgtacccggtcccttcccgtacgtacctacgttccgttacgtaacgtacctaccgtaaggcgtaggaacgggacggtacgtgtacgttaacttattatcgactacgtccttagtaacttaacgtacttaaggtacttaactaacggtaggttaccttaccgtacgtacggttcgggttggtacccgggggaggtaaccgggtaaccgttaacgttccggtaaccggtcccgaaggttacccgacccggacccgtaggtaccccgg

SEQ ID NO: 84349 - DNA, 961 bp, Homo sapiens
  misc_feature: GYAE6OF02JYL05.36.23.C01.1.454.CMB.1.raw
  modified_base (136)..(136): a, c, t, g, unknown or other
  misc_feature (136)..(136): n is a, c, g, or t
  modified_base (145)..(145): a, c, t, g, unknown or other
  misc_feature (145)..(145): n is a, c, g, or t
  modified_base (237)..(237): a, c, t, g, unknown or other
  misc_feature (237)..(237): n is a, c, g, or t
  modified_base (812)..(812): a, c, t, g, unknown or other
  misc_feature (812)..(812): n is a, c, g, or t
tcagtacgctgtctcacgaccggtgctcgatttagtacacgtgattagggagttggggggggggtctcaggaggcagcgctctcaggacatctccaccatggcctgggctctgctgctcctccaccctcctcactnagggcacgngggtcctcgggcccagtccgtggccctgacacacgtcctgcccgtccgtgtccgtagacgaccttccgtagggacagtaccgatccaaccgnttcctccgtggacaccgtagggaaacccagtacgaaggttcgtacggttttaggtcgtaacttttaaattaagtttattccggttcctttcccggttacggtttaaccccaaacgttaccgacttacgttaccggtaacggaccgtaaccgggaccccgtaaacccccgttaaaaacttttaccgttttaaaagtttttacggttacggggtttaacgggttttcccgttttaccggggtttacccccgggttacccccggttttaacgggtttaccgggggttttttacgtaaccgggtttcccgttacccgttttccccggggtcccggttaccccgtttaacggtaacgggttttccggaacccgggtaaccttaaaccccggggtccccgggttacccccttaccccgggttaacctaaaccccgtttaactttccgttaacccgtttaccgtaaccccggttcccggtacgggttaccgtaccgggggtaaaccgggaccgggttaacgtacccggtttaacggtttaaccttttaagttaccgttccgggaccgtaccttaaaccgttnaaccggtttagttaacccggtaagtaccgttaagacggtttacgtaccgcttaccgtgggtccgtttaagggccgggtaacgtaacggtaacccggttacgtacgttaccggtacccggtaggtcccgaacggtacccgtacgtcccgg

SEQ ID NO: 84350 - DNA, 727 bp, Homo sapiens
  misc_feature: GYAE6OF02JXPIF.36.23.C01.1.454.CMB.1.raw
  modified_base (335)..(335): a, c, t, g, unknown or other
  misc_feature (335)..(335): n is a, c, g, or t
  modified_base (542)..(542): a, c, t, g, unknown or other
  misc_feature (542)..(542): n is a, c, g, or t
  modified_base (572)..(572): a, c, t, g, unknown or other
  misc_feature (572)..(572): n is a, c, g, or t
  modified_base (615)..(615): a, c, t, g, unknown or other
  misc_feature (615)..(615): n is a, c, g, or t
  modified_base (645)..(645): a, c, t, g, unknown or other
  misc_feature (645)..(645): n is a, c, g, or t
  modified_base (703)..(703): a, c, t, g, unknown or other
  misc_feature (703)..(703): n is a, c, g, or t
tcagtacgctgtctcacgaccggtgctcgatttagtacacgtgattagggagttggggggggtcgtcaggaggcagcgctctcaggacatctccaccatggcctgggctctgctgctcctcaccctcctcactcagggcacacgggtcctgggcccagtcctggccctgaccacagcctcgcctccgtgtctggacgaccttcctgggaacctaggttcgataccaacctagttccttccagaccacttacgggaaacccagcgtagttcggaccgttttgggtctactttaagttaatttagcggtttaccttccgtacgggtttaccccaaanacggtacagtttacgacggccacggccccggaaccccctaaaactttcctttaaaattttacgcgggttaacgtttccgtttttaccggcccggtaccccggttaccggttaggggttttaccgtacgttccgttcccgtttccgtacccggtcttacccgaacggttctccggactaaaccgtccccgggttccctcccggtaacnccctaaacttcctcggaactaccgtaccgngggtcctacgggagtacgaggtcctagttacctattagtccgnaacgttcactagttacagtagacttaacgngtaacgtcaccgtgcggtcttcgggcggacgggacgtaaacgtggttaccacccgttnaacggtcgacgtcccgattcccgg

SEQ ID NO: 84351 - DNA, 745 bp, Homo sapiens
  misc_feature: GYAE6OF02HI0NY.36.23.C01.1.454.CMB.1.raw
tcagtacgctgtctcacgaccggtgctcgattagtacacgtgattagggattgggggggggtctcaggaggcaccgctctcaggacatctccaccatggcctgggctctgctgctcctcaccctctcactcagggcacgagggtcctgggcccagtccgtggcctgacacgagcctgcccttccgtgtctgacgtaccttccgtaggactagttcgactccaaccattcctccgtgccacgtacggaaccagcctaggtgtacggtttggtagtacttaattaatttagtacgttccttccggttacggttacccaaactacggtctaacgttaccgaggaccacgacccggtaacccctaactttacctttaatttacgtaggtaacggtttcctttacgggtccgtaccccgttacggttacggggtttacagttccgtccgttaccgtcggcctacgtaagttccgtagggacctaaccgcccgtacccttcccgtacgtaccttactacttaccgtaaccgtaccgttacccgacggtacgacggtacgggaacggtacgtacgtacgtaaacgtttacgttagttcggactagtaccttacgtactaacgttacgtagtaacgttagtaacgttacggtactaccgtacgtcggtacgttcggttacggacgggtaacgtacgttaacggaccgttaccggtacgtacgggacctaccggtacgtacgtccgttacccgg

SEQ ID NO: 84352 - DNA, 848 bp, Homo sapiens
  misc_feature: GYAE6OF02JH5FY.36.23.C01.1.454.CMB.1.raw
tcagtacgctgtctcacgaccggtgctcgattagtacacgtgattagggattgggggggggtctcaggaggaaccgctctcaggacatctccaccatggcctgggctctgctgctcctcaccctcctcactcagggcacagggtcctgggcccagtctgggcctgacaccgctcgtccgtccgtcgtcgtcgaggacgtaccttcggacggacgtacggtactactacctaactccttcctaccggtctaccgttaccggtaaccgaaccgtacgacgtacggttacgggtcgggttggtaccttatttaaagttattcggttctaccgttccggttacgtaaccaagtcgtacttacggacgacgtacggacccgtaccccgtaaccttaactttaacgttacgttaggtacggtaccttttcgtacccggtaccgttccgttacggggttcgtttacgtacggtccttaccgttcgtcggtccctacgaccttacggttacaccgtacccgacggtaccccttacccgtccgtaaccgtaccttaccgttccgtccgggtccgtacccgtaccggtaccgtacggtacggtacgggtaccggtacggtacgttagtttaacctttaccggttacgttccgttactacctaacgttaccgttaacgaccggttcggtaacgtttcggttaccggtttaccgggttccggggtacccgtaccccggtacccgttccgtaccgggtacccgttacccggtacggtaccgtacccggtaaccgtcccgttacccgtaccccggttacccggtccttaacccggttcccgttacccgtccccggtaccccg

SEQ ID NO: 84353 - DNA, 659 bp, Homo sapiens
  misc_feature: GYAE6OF02JGGCF.36.23.C01.1.454.CMB.1.raw
  modified_base (143)..(143): a, c, t, g, unknown or other
  misc_feature (143)..(143): n is a, c, g, or t
  modified_base (173)..(173): a, c, t, g, unknown or other
  misc_feature (173)..(173): n is a, c, g, or t
  modified_base (190)..(190): a, c, t, g, unknown or other
  misc_feature (190)..(190): n is a, c, g, or t
  modified_base (193)..(193): a, c, t, g, unknown or other
  misc_feature (193)..(193): n is a, c, g, or t
  modified_base (200)..(200): a, c, t, g, unknown or other
  misc_feature (200)..(200): n is a, c, g, or t
  modified_base (266)..(266): a, c, t, g, unknown or other
  misc_feature (266)..(266): n is a, c, g, or t
  modified_base (302)..(302): a, c, t, g, unknown or other
  misc_feature (302)..(302): n is a, c, g, or t
  modified_base (358)..(358): a, c, t, g, unknown or other
  misc_feature (358)..(358): n is a, c, g, or t
  modified_base (454)..(454): a, c, t, g, unknown or other
  misc_feature (454)..(454): n is a, c, g, or t
  modified_base (580)..(580): a, c, t, g, unknown or other
  misc_feature (580)..(580): n is a, c, g, or t
tcagtacgctgtctcacgaccggtgctcgatttagtacacgtgattagggagttggggggggtcgtcgaggaggcagcgctctcaggacatctccaccatggccgtggctctgctgctcctcaccctcctcactcagggcacngggtcctgggcccagtcgtggcctgacacngcctgcctccgtgtacnganccttccnggacacgtcgatccactatcgtcctgcctacgtggaacccagtcacgtggtaaccgttggtacgtnttaatacttattgtccttcgtacggttcccgaaacncggtaccatttccgaggccacggtacccgaccccgtaaacttcttttaagttacgngttaggttcctttcggtccggtaccttcgggttagggtttactggttcctcgtttcgccggtatcccgaagtctcggacctaacgccggtccttcncgtaccacttctactacgtacgtccaagggtctacggacggaacgtcggtacttggtaacctttagttacgtccgagtacgtctaacgtattactagtaaacgttacgtactaaagtcggttaacnccgtacgtcggtacttacggtcggggacgacggtaacctaggtacgttacccgtcgtacgactacggccgtacgtcccg

SEQ ID NO: 84354 - DNA, 784 bp, Homo sapiens
  misc_feature: GYAE6OF02IKCFB.36.23.C01.1.454.CMB.1.raw
  modified_base (154)..(154): a, c, t, g, unknown or other
  misc_feature (154)..(154): n is a, c, g, or t
tcagtacgctgtctcacgaccggtgctcgattagtacacgtgattagggagttggggggggtctcaggaggcagcgctctcaggacatcctccaccagtcggcctgggctctgctgcctcctccaccctcctcactcgacggcacgcggttccncgggcccagtccgtggaccctagaccacgcggtccctcgccgtccgttgtcgtacgacgacctccgtacggacgacgtcgactccaccgattcctccgagcacgtaggaacctagactgtcggtacgttggtcctactttaataagtttctacgttccgttaccgttacggttaccccaagacgtccgtagttacgaacggcgtaaccggaccccgtaaccccgtaaactttctttaagtttacgtcggtttaccgttccgttttaccggcccgtcccgttaagggtcgggttttccgacgttccgtcccgtttaaccggtccggtacctacgtaaccgttgtaccgtaaccgaaccgtccggtaccccttcgtcaacgtcctcgtacgtacgtccgtaccgaggtcgtacggtaaccggacgtaacgcttaccgttagttattcgttacgcgacttacgtcaaacgtttccgtaaagtacgttacgaatttaaccggagtttacccctagttaccggtaccgttcgggtttaaccgggtcgggtaaaccgggtccgggtaactttacgggttacccgttaacccggtggtacccggttaacgacccccggtacgttacccgggtccccg

SEQ ID NO: 84355 - DNA, 660 bp, Homo sapiens
  misc_feature: GYAE6OF02GHECL.36.23.C01.1.454.CMB.1.raw
  modified_base (224)..(224): a, c, t, g, unknown or other
  misc_feature (224)..(224): n is a, c, g, or t
  modified_base (236)..(236): a, c, t, g, unknown or other
  misc_feature (236)..(236): n is a, c, g, or t
  modified_base (251)..(251): a, c, t, g, unknown or other
  misc_feature (251)..(251): n is a, c, g, or t
  modified_base (278)..(278): a, c, t, g, unknown or other
  misc_feature (278)..(278): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctagacgtactccgtggaccagtcgatccaccatcctccngcacgtgaaccngcagtgacgttggtncttataattatgtctctgttaccaacngctattcagcacggccgaccccgaaacttccttaatttatcgtaggttctttccggtccggtcccctaggttggtttctagttccgcttttcctccggtcctaccgaagttccgttaggccaaactccgggtaccctcccgtccgtaccacttccttacgtaacgaaccgttcccgaggtccctgggtaacggacgtacggtcttagacttttacgtttatccgctcggtacttactaagttacctaacgttagtaagtaactaagttacgtctaccgtaacgttcgtacgttcggggttccggtaccggggtacggtaaccggttagttccggtaccgtttaccggtaacggtaccgtcggtaacccgacggttaccccgg

SEQ ID NO: 84356 - DNA, 699 bp, Homo sapiens
  misc_feature: GYAE6OF02FIAEM.36.23.C01.1.454.CMB.1.raw
  modified_base (285)..(286): a, c, t, g, unknown or other
  misc_feature (285)..(286): n is a, c, g, or t
  modified_base (317)..(317): a, c, t, g, unknown or other
  misc_feature (317)..(317): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacgagggtcctgggcccagtcctgggcctgacacagcctgccctcgtgtctgacgtacctccgtggacagtcgataccacctattcctccctgccagtggaaccaggctagtgacggttgtgcttatattatgtctcctggttccaanncatcagcagccgacccgtaattcttaattangtagttctttcgtccggtccctgtcgggttctagtccgtctttcgtcccgctaccagttcctggacctaccgaccggtccctacccgtacgtacctcttacgtaccgtacgtaccgtacccgagggtcctaagggagggtaccggaggttacgtacgtaactttaagttacttcggacctaggtaccttactaagttaaccgttaacgttaacggtaacggtttaacgtaaacgttacggtaccgttacccgtaacggttcggtaacggttccggggttaaccgggaccgggtaaacccggggtaaccgttaacgggtttacccggtaacccggttacgttaacccgggtacaacccgggtacccgtaccgggttaccccgg

SEQ ID NO: 84357 - DNA, 638 bp, Homo sapiens
  misc_feature: GYAE6OF02JW6E4.36.23.C01.1.454.CMB.1.raw
  modified_base (173)..(173): a, c, t, g, unknown or other
  misc_feature (173)..(173): n is a, c, g, or t
  modified_base (451)..(451): a, c, t, g, unknown or other
  misc_feature (451)..(451): n is a, c, g, or t
  modified_base (502)..(502): a, c, t, g, unknown or other
  misc_feature (502)..(502): n is a, c, g, or t
tcagtacgctgtctcacgaccggtgctcgatttagtacacgtgattagggagttggggggggtctcaggaggcagcgctctcaggacatctccaccatggcctgggctctgctgctcctcaccctcctcactcgagggcacagggtcctgggcccagtctcggcctgaccacngcccttgccctccgtgtctgacgctcctggacaggtcatcaccagtcctcctgcacgtggaaccagcaaggtcgacgttggtgcttataatatgtctctggttccacagcattcaggcacgcgaccccgaattactttattatgtacgttctttcgtccgtccgttcgtacgggttctagttcgtacctttcgtaccggtccttaccgtaacggttccgtgggtacccaaaccggtccggtcccttcccgttacgccctagttccctactacgtaccnccgtagtctggaacgtcggtacggcttcggtaacttattacgtcgtaccgngtacgtacaagtttctacctaaggacttacgaaaggttccgtaatacccgtagttccgtagttacggtccgggtagggtacggaacccgttaggtccgtaaccgttgtacggtaccaccggtacccgaggtccccg

SEQ ID NO: 84358 - DNA, 658 bp, Homo sapiens
  misc_feature: GYAE6OF02FUJYQ.36.23.C01.1.454.CMB.1.raw
  modified_base (169)..(169): a, c, t, g, unknown or other
  misc_feature (169)..(169): n is a, c, g, or t
  modified_base (171)..(171): a, c, t, g, unknown or other
  misc_feature (171)..(171): n is a, c, g, or t
  modified_base (184)..(184): a, c, t, g, unknown or other
  misc_feature (184)..(184): n is a, c, g, or t
  modified_base (230)..(230): a, c, t, g, unknown or other
  misc_feature (230)..(230): n is a, c, g, or t
  modified_base (252)..(252): a, c, t, g, unknown or other
  misc_feature (252)..(252): n is a, c, g, or t
  modified_base (504)..(504): a, c, t, g, unknown or other
  misc_feature (504)..(504): n is a, c, g, or t
  modified_base (524)..(524): a, c, t, g, unknown or other
  misc_feature (524)..(524): n is a, c, g, or t
tcagtacgctgtctcacgaccggtgctcgatttagtacacgtgattagggagttgggggggggtctcaggaggcagcgctctcaggacatctccaccatggcctgggctctgctgctcctcaccctcctcactcagggcacagggtcctgggcccagtctggcctgacncngcctgcctccgtntctgagacctcctggacaggtcgatcacctattcctcctgcaccgnggaaccagcagtgtcgttggtntacttataattatgtccttccgttcggtaccaatcgctagttcaggcacgacccgacccccgtaacttacttaaagtttgtgggtacggtttcctttccggtccggtccccgttaggtacggggttttctacgtccgtccttccggtccgtacctcagttccgacgtaccgaactcccggtccctcccgtacgacctctccttacgacgtcccgtacgaggtccgagggaacggacggtcggtcttaacgtntttaagttcgtcgcgtactnttacaacttagtaacgtggaacttcgagttacgtacctccggtattccgggtgttacgggtccggagggtaaccggttaacgtcgtttaccggacccgttcggttacgggacctacgggaccctacggtccccg

SEQ ID NO: 84359 - DNA, 665 bp, Homo sapiens
  misc_feature: GYAE6OF02GEU62.36.23.C01.1.454.CMB.1.raw
  modified_base (173)..(173): a, c, t, g, unknown or other
  misc_feature (173)..(173): n is a, c, g, or t
  modified_base (448)..(448): a, c, t, g, unknown or other
  misc_feature (448)..(448): n is a, c, g, or t
  modified_base (475)..(475): a, c, t, g, unknown or other
  misc_feature (475)..(475): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacgagggtcctgggacccagtctcggcctgacacncgcctgcctccgtgtctgactactctggaccagtcgatccacactctcctgctacgtacggacctagtcgaggtgtaccggtttggttcgtactttaattaagttattcgttccttccgttcggttacccaacacgacctattcgaggaccgacggaccgtaccccgtaacttacctttaagtttagttacgtacggtttcgtttcgtccggtacccgttggttacgggtttcgtacgtcgtcgtttaccgtccgtctcgtacggtcacgtcacnccggtcctccgagtaccatcgtactanacttcgagtcgaggacggacgagtctactacttagttacgttagcgacgtctacgtaataccgtacgtaagtaacgtcgtaagtacgtactaccgaggttcacgggtttacgggcggaacggttacgggtaaccgttacggtccggttaccgttacggttacggaccggtaccgaccgtcggtaccccgg

SEQ ID NO: 84360 - DNA, 821 bp, Homo sapiens
  misc_feature: GYAE6OF02IAQT8.36.23.C01.1.454.CMB.1.raw
  modified_base (190)..(190): a, c, t, g, unknown or other
  misc_feature (190)..(190): n is a, c, g, or t
tcagtacgctgtctcacgaccggtgctcgatttagtacacgtgattagggagttgggggggggtctcaggaggcagcgctctcaggacatctccaccatggcctgggctctgctgctcctcaccctcctcactcagggcacgagggtcctgggcccagtctggcctgacacacgcctcgcctccgtgtcnggacgactccgtaggacaggtcgattccaccgattcctaccgtgacacgtacggaaccagccgtaaggtcgtacggtttggtcgtactttaacttaaagttattcggttccttaccgttacggtttacccaaaccgtgtacacgtttcacggtaccgacggtcccgtaccccggtaaaccttaaccgttttaacgtttacgtcggtaacggttttcgtttccggtaccgtcccgttacggttacgggtttacgttacggtccgttccgttacggtcccgtccgtaaccgtacgtaccgttagaccgaacccgtacggtacccctacccggttaccaccgtaccgttaccgtaccgttaccggtacccgtaccgtacggtaccggtacggggaaccggggtaaccggtaaccgggtcgtaaacggttactttaaacggtttacgtttcgaccgtaccgggttcttaacttaacgtttaaccgtaacggttaacggtaaccgttagtaacggttacggtaaccgttacgaccgtcggtacgtttacgggtcgggaccgggtaacggtaccgttaccggtacgtacccggttacggacccggttacggaccgggtacccgaccggttaccccgg

SEQ ID NO: 84361 - DNA, 817 bp, Homo sapiens
  misc_feature: GYAE6OF02FMDS1.36.23.C01.1.454.CMB.1.raw
tcagtacgctgtctcacgaccggtgctcgatttagtacacgtgattagggattgggggggggtctcaggaggcagcgctctcaggacatctccaccatggcctggctctgctgctcctcaccctcctcactcagggcacgagggtcctgggcccagtctggcctgacacagcctgcctccgtgtctgagacctccgtaggacaggtcgaatccacctatcctcctgacacgtacggaaaccagactaggtgtacggttggtagtactttaataagtttagtacggttccttccgttacggttaacccaaactaacgtcctaagttaccgaagggtcctaaccggtacccccggtaaaccccccgttaaaactttaccttttaaaaggttttaccgtacgggttaacccgggttttacccgtttttaccggggtacccccgggttaacccccgtttacgggggttaaccgggggttttacccttaacgggttccccgttaccgttttccccgtacccggggttaccctttacggtaaaccggtttccgtaaccggggtaacctaaaaccccggtcccgggtcccccttacccgtacgaacccttactacgtaccgtacgtccgtaccgtaggactacggacggtaacgtcgtacgtaagtacgttactttgacgtactacggtctactaacgttatactaggtactaacgtagtactaccgtactggttcggttcgtcggttacgggaccggttaaggaccttaagggtcccgtaccggtacgttaaccggtcggtaacccgaccggtaccggtcccg

SEQ ID NO: 84362 - DNA, 755 bp, Homo sapiens
  misc_feature: GYAE6OF02JE0N6.36.23.C01.1.454.CMB.1.raw
  modified_base (144)..(144): a, c, t, g, unknown or other
  misc_feature (144)..(144): n is a, c, g, or t
  modified_base (189)..(189): a, c, t, g, unknown or other
  misc_feature (189)..(189): n is a, c, g, or t
  modified_base (204)..(204): a, c, t, g, unknown or other
  misc_feature (204)..(204): n is a, c, g, or t
tcagtacgctgtctcacgaccggtgctcgatttagtacacgtgattagggagttgggggggggtctcaggaggcagcgctctcaggacatctccaccatggcctgggctctgctgctcctcaccctcctcactcagggcaacgngggtcctgggcccagtctggcctgacacagcctgcctccgtgtcngacgactcctggacngtcgatcacatctctgcacgtcggaaccagcagtgacgttggtagtcttaatattatcgttaccttccgttggttaccaactagactagttacgaggaccacggaccgtaaccccgtaaaatttactttaaagttttacgcggtaacggtttccttttccgggaccgtccccgtaggttaaggggttttcttacggtccgtccgtttaccgttcccgggtccttaccgaacggttaccgtacgggtaccctaaaacccgccggttaccccttaccggttacaaccctacgttcccgtactaacggtaacctccggacgggttaccgaagggtaacggggtaaacggtccggtaacttacggaaaccttttattaccgtacgacgtatacccgttataaacgttactaaacgttaagtaacgtacgtaaagttacggttaactacccgtaaggttccgtacggtttcgggttaacgggacggttaaccgggtaaccttaacggttaccggtaccgttccggtaacgacggttaccgaccggtaaggtccccg

SEQ ID NO: 84363 - DNA, 803 bp, Homo sapiens
  misc_feature: GYAE6OF02F2M6U.36.23.C01.1.454.CMB.1.raw
  modified_base (164)..(164): a, c, t, g, unknown or other
  misc_feature (164)..(164): n is a, c, g, or t
  modified_base (175)..(175): a, c, t, g, unknown or other
  misc_feature (175)..(175): n is a, c, g, or t
  modified_base (276)..(276): a, c, t, g, unknown or other
  misc_feature (276)..(276): n is a, c, g, or t
  modified_base (315)..(315): a, c, t, g, unknown or other
  misc_feature (315)..(315): n is a, c, g, or t
  modified_base (500)..(500): a, c, t, g, unknown or other
  misc_feature (500)..(500): n is a, c, g, or t
  modified_base (780)..(780): a, c, t, g, unknown or other
  misc_feature (780)..(780): n is a, c, g, or t
tcagtacgctgtctcacgaccggtgctcgatttagtacacgtgattagggattggggggggggtctcaggaggcagcgctctcaggacatctccaccatggcctgggctctgctgctcctcaccctcctcactcgagggcacgtaggggtcctgggcccagtcnggcctgacacngcctgcctccgtgtctgacgtactccgtggactaggtcgactccgaacctattccttccgtcgactacgtacggaaccacgcgaaggtggtacggttggtntacttaagtaattgtcgttccttccgtcggttaacccanacgtactacgtcgacggaccgtaccgcccgtaaccccgtaaatttcgttttaaaagtttcgttccggtaccgggttttacctttcccgggtccgtttaaccccgggttagggtttacggggtttcccgtacgttcggttccctttacggtccggtacccttaacgttaacgtcgtacccggtaanaccccggtaccgggtcccttacccggactaccgttactcccgttacacggaaccttccggaagtcggtaacggggaacggtcggtaagtccgttaacggtacttttacgtaacgttcggaccgtactacgttaacacggttttaactacgggtttaaacgacgtaaaccgtttgtacggttaaccctacgtacggtttcgtaccggggtttacgggtcgggaacggggtaaaccgttaaccggttacgttacccggggaccttacggttacggttacccncgggtaacccgttcggaccccgg

SEQ ID NO: 84364 - DNA, 1155 bp, Homo sapiens
  misc_feature: GYAE6OF02FNRTK.36.23.C01.1.454.CMB.1.raw
tcagtacgctgtctcacgaccggtgctcgatttagtacacgtgattagggattgggggggaaatacttctgagactcatggacctcctgcacaagaacatgaaacacctgtggttcttcctcctcctggtggcagctcccagatggtcctgtctcaggtgcagctgcagcaggtcgggccaggaggtggtgagccttacggacgtacccttcgtccctcacctggccgctgtcgtcgtcggtcgccctcccgtcgggcggagactaggtaaagtggtcgggacggttcggggttccgcccaaccgggccccccgaaggggggtaacgggggtcctagggtagtttaggttacggttaggttaacgtaaaaagttaaacgtaggaaccggggtaaccccgggggggtaccaaaaccccgtaaacccgttaaaccggttaaaaccgtcggttaccccggtttacccccggttacggggtaaccgggggggtcggttaaccgtaaccgtaaccccgtactttaccggtttaccgtaaccgccgtaaacggtaaaccgtaaaccggttaccccgtaaaacggtaaacccccgtaaccccgtttttaccccgtaaccccgttacgggtaacccgggttacccgttaaaccccggtaacccgtttacccgggttacccgggttaaccgggtaaccccccgggtacccccggggaacccccggggtttaaccgttacccccccggggtaacccgttaaaacgtttaaacccggttttaaacgttttaacccggggtttttacggttaaacggggttaaccgggttaaaccggggtttttaaggggtttttttttaaacccgaacccggggttaaaccgggggttttaacgggtttacccccggggttttaaacggggggggggtttaacccctttaaacccgggggtttacccggggtttaacccggggtacccggggggtttttaaccggggggttaaaccccggggtaaaaccgggggttttaaccccgttaaacggggttaaccccccggggtttaaaggttaaccccggggtttttacccccgtttaccccccgttaaacccccggtttacccggggtaaccccggttttccccccggtttaaaaaccccccccgggg

SEQ ID NO: 84365 - DNA, 898 bp, Homo sapiens
  misc_feature: GYAE6OF02GSWV7.36.23.C01.1.454.CMB.1.raw
  modified_base (232)..(232): a, c, t, g, unknown or other
  misc_feature (232)..(232): n is a, c, g, or t
tcagtacgctgtctcacgaccggtgctcgattagtacacgtgattagggagttggggggggtctcaggaggcagcgctctcaggacatctccaccatggcctggctctgctgctcctcaccctcctcactcagggtccacagggtcctgggcccagtcctggcctgacacagcctgcctccgtgtctgagactcctggacagtcgatcaccgatcctcctgcactggaacanccagtcgacgttggtgtacttataattatgttactccttggttacccaactagcctaattcgacggctacggccgtacccccggaaattcctttaaatttaacgtggtaaggttccgtttccggtaccggtccccgtacgtacggggttttacctaggttccgtcgtttccgtcccgggtccttacccgtaaaggttcccgtagggtaccctaaaaccgtcccggggtccccttaccccgtacggtaaccccgtactttccgtacccgtttaaggaaccccgtttcccgaaacggggtccttaagggaaccggggtaacccggtaaggggttaccctaggttaaaacccgtttaaggtttagtttcccgggacgtaaccggttaccgttaaccggtaacgtttaaacgttaccgttaaccggggtaaacgtttaacccggtaaaacggtttaccgggttaaacccttacccccgggttaaacgttaccggggggttccgtttaaacccgggggttttacccgggggtaaccggggggttaaaccggggtttaaacccccgttaaaaccggggttttcccgggttaaacccccgggttttcccggtaaacgggttaaccccgggtttaaccgggtaacccccccggtaaaggggtttacccccccgg

SEQ ID NO: 84366 - DNA, 724 bp, Homo sapiens
  misc_feature: GYAE6OF02IM2QQ.36.23.C01.1.454.CMB.1.raw
  modified_base (143)..(143): a, c, t, g, unknown or other
  misc_feature (143)..(143): n is a, c, g, or t
  modified_base (159)..(159): a, c, t, g, unknown or other
  misc_feature (159)..(159): n is a, c, g, or t
  modified_base (171)..(171): a, c, t, g, unknown or other
  misc_feature (171)..(171): n is a, c, g, or t
  modified_base (176)..(176): a, c, t, g, unknown or other
  misc_feature (176)..(176): n is a, c, g, or t
  modified_base (184)..(184): a, c, t, g, unknown or other
  misc_feature (184)..(184): n is a, c, g, or t
  modified_base (187)..(187): a, c, t, g, unknown or other
  misc_feature (187)..(187): n is a, c, g, or t
  modified_base (191)..(191): a, c, t, g, unknown or other
  misc_feature (191)..(191): n is a, c, g, or t
  modified_base (218)..(218): a, c, t, g, unknown or other
  misc_feature (218)..(218): n is a, c, g, or t
  modified_base (235)..(235): a, c, t, g, unknown or other
  misc_feature (235)..(235): n is a, c, g, or t
  modified_base (249)..(249): a, c, t, g, unknown or other
  misc_feature (249)..(249): n is a, c, g, or t
  modified_base (260)..(260): a, c, t, g, unknown or other
  misc_feature (260)..(260): n is a, c, g, or t
  modified_base (293)..(293): a, c, t, g, unknown or other
  misc_feature (293)..(293): n is a, c, g, or t
tcagtacgctgtctcacgaccggtgctcgatttagtacacgtgattagggagttgggggggggtctcaggaggcagcgctctcaggacatctccaccatggcctgggctctgctgctcctcaccctcctcactcgaggcacgnggtctcgggccagtcnggcctagacacngcctncctccgtntcngacnctcgtggacagtcatcgaccatctccngacagtcgaaccagcgngtagtcgttgagtntaattaagttngtcttcgtagttaaccaagactctacttacggngtacacgtaccggtacctaaacttctttaagttacgtagtaaccggtttcgttttaccggccggtaccccgtaggtttaaggggtttacctacgttcccgtacgtttaccccgtccgggtacctaaccgttaaacggtcgttcgggaaaccttaaccgaccccgggttacaccctttacgaacgtacctttacggtaccgttaaacaccgttaccggagttaacgttaggaaccggtagtacggtacgtaactaagtttaactacgtacgttacaccggtatttaacacggtttaactaacggtcggttaaactaacgtaccgtttacggacttactaacgggttcttacggtacggtacggacggtacgtaaccgtaaggttaccgtcccggtaagtaccggttaccaaccggttaccgaaccgttccgg

SEQ ID NO: 84367 - DNA, 1163 bp, Homo sapiens
  misc_feature: GYAE6OF02IDF2L.36.23.C01.1.454.CMB.1.raw
tcagtacgctgtctcacgaccggtgctcgatttagtacacgtgattagggattgggggggaagaggaagactgacggtcctgtctcaggtgcagctgcagcagtcgggcccaggagtggtgaagccttcggagacctgtccctcacctgcgctgtgtctggagcctccccgtcggcgggagatgaagtggtggagtgggtccgccacgcccccgagggaaggggctggtagttgggagttaggtaggtaaaataaaagtggaacgggacccggggggaccaacccgaaaccgtaaccaaagtcggcccgttccccgtacggtaacgggggtcgtaacggtccgaacccaacttacttacgtcgacgaacggtaaacgtaaacggttaaccccgaaaacggtaaaaccccgttaacctttacccgttacccccgttacgggaacggggtccttaccggtaccccttcggttaccgggtacggtaacccccggccccgggtacccggggtaaccggttccccggggtaccttaaacggttaaacttttacgttttaacggttttacggtaccgggtacgggttaagttttaacggggttttttttcgaaccggttaaacggggttacggttttcggggtttaccggggggtaccggggttttacggtaacccgggttaaccggggttaccgggttttacgggggggttaaccgggtaaaacgggggttacggtttaccccggggtaaacccgggttaaccggttaaccggtttacccggttacccctttaccccggttaacccgtacccggtaaaccccccgtttcccccggtaaaaccccgggtaaaccccgggggttccccccgttaaacccggggttttccccccggggtttaaccccccttttttccccccccggggtaaaccggggttaccccccccggttccccccggttttaccgggtcccccgtttaaccccggggaacccggggttaacccccgggtaaccccccgggttaaacccccgggtttaaccccggggaaccgggggtttaaaaccccggtccccggaaaacccccggggtacggggtaacccccccggggggtcccccccgggtttaacggggggttccccccggttacccgggtttacccccccgggg

SEQ ID NO: 84368 - DNA, 802 bp, Homo sapiens
  misc_feature: GYAE6OF02IC5UQ.36.23.C01.1.454.CMB.1.raw
  modified_base (173)..(173): a, c, t, g, unknown or other
  misc_feature (173)..(173): n is a, c, g, or t
  modified_base (252)..(252): a, c, t, g, unknown or other
  misc_feature (252)..(252): n is a, c, g, or t
  modified_base (611)..(611): a, c, t, g, unknown or other
  misc_feature (611)..(611): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcgagggcacgagggtcctgggcccagtcgtggcctgacacngcctgcctccgtgtctgacgtactccgtaggacaggtcgactaccacctattccgtcctacgcctacgtacggaaaccngcgtaaggtcggtacggtttggtacgtactttaattaagttatcggttccttccgttacggttacccaacgtctactacgttacgacggacaccggaccccggtaaccccgtaaactttacttttaacgtttaggtacggttacggtttccgtttccggtcccggtccgttacgggtttacggggtttctacggttccgtccgtttacccggtccggtacctttaccggtaacgttccggtacggtaccgaacccgtcccgggtacccctccgtacgtaaccctctaccgttacgtaccggtacctccggacggtcgtaacgggacggtacgtacgtcgtacgtactttagtcgttacnctacgtcttacctaagttctaaaccgttagaacgttaaccgttaaggttacggttaaccgtccgttacgggttcggttaaccggtttcggggtaaccggggaacggtttaaccgggtaaccgtttaacggtacccggttacccgttaacgggttacggtaacccggtacggtaccccggtagtcccccggg

SEQ ID NO: 84369 - DNA, 694 bp, Homo sapiens
  misc_feature: GYAE6OF02HVP6H.36.23.C01.1.454.CMB.1.raw
  modified_base (235)..(235): a, c, t, g, unknown or other
  misc_feature (235)..(235): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctcactcagggcacagggtcctgggcccagtctggcctgacacagcctgcctccgtgtctgagacctccgtggacaggtcgatcaccatcctcctgccactcggaaaccngctagtggacgttggtgtacttaataattatcgttcctccgttggttaccaactgctattcaggcagccgacccgtaacttactttaattagtgtacggttctttacgccggtccttcggtacgggtttcttacggtcgtactttccgtccggactaccgtaagtcgtagacgtaaacccgtccggtccccttacccgtacggtaccctaacgttcccgttacgtaacgaccttccgacggtccgtagggaacgggtacgacgacgttacgtaacgttattacttcggactacgctacgtaattacgtacgttagaagttaccgtaaggtttagaaccgttaccgtacggttacggtacggttacggttccggggaaccggggtaacggtaccggtaaaggtttccggaacccggttaccggttcggtaacccgtaccggtacccggaacgttccccgg

SEQ ID NO: 84370 - DNA, 712 bp, Homo sapiens
  misc_feature: GYAE6OF02I0768.36.23.C01.1.454.CMB.1.raw
  modified_base (129)..(129): a, c, t, g, unknown or other
  misc_feature (129)..(129): n is a, c, g, or t
  modified_base (277)..(277): a, c, t, g, unknown or other
  misc_feature (277)..(277): n is a, c, g, or t
  modified_base (303)..(303): a, c, t, g, unknown or other
  misc_feature (303)..(303): n is a, c, g, or t
  modified_base (308)..(308): a, c, t, g, unknown or other
  misc_feature (308)..(308): n is a, c, g, or t
  modified_base (318)..(318): a, c, t, g, unknown or other
  misc_feature (318)..(318): n is a, c, g, or t
tcagtacgctgtctcacgaccggtgctcgattagtacacgtgattagggagttgggggggggtctcaggaggcagcgctctcaggacatctccaccatggcctgggctctgctgctcctcaccctcctnactcagggcacgagggtccgtgggcccagtccgtgggcctgaaccacacggccttggcccttccggttgtctaggactcctcctgggaacagtccgaatccaacctctctcctgaccacggtacggaaccagcgagttgacggttgtntcttaatatatgtactcgtcgtacanagtcncttagacgcncgtaccgacccgtaactactttaattcgtagtacggtttccttcggtccgtcccttaggtacgggtttcgtacgttccgtccgttccgtaccgtcgtacctaaggtccgtacgacctaaacgcccggtccctaccgaccgtacctaacgtcttaccgaacggtaccctacggtacgttacggtacggacggtaacggtcgtacgtaacgtacttttaaacttcgttaacgacgtacgtactacgaagttactaacgtacgtaagtaacgttgttactacgttaccctacggttcggacgtttcgggtacccgggacggttaacggtaaaccggttagggtacccggttaccttaacggtccggtaccgtaccggaaccggttccggtaccccgg

SEQ ID NO: 84371 - DNA, 747 bp, Homo sapiens
  misc_feature: GYAE6OF02HYFMU.36.23.C01.1.454.CMB.1.raw
tcagtacgctgtctcacgaccggtgctcgatttagtacacgtgattagggattggggggggaaatactttctgagactcatggacctcctgcacaagaacatgaaacacctgtggttcttcctcctcctggtggcagctcccagagtcgggtcctgtctcgtaggtgcagctgctagcgacggtccgggacccgagggtaggtgggtagaacgtccgttcggacgaccctcgtcccctcacctggctcgtgtcgtcgtggacctcccgtccgtcgggacggacgtagtagtaaggttgggtagggtacggttaccgggtccgaccgaccggacccccgggtaaggggaacggggcgtacgggtaggttaggtaaggtttcgggtaagtaaaagttaaggtacgggtacgggaccggggaaccaaaccgtaaacgtaacgtacgtccgtccgacccgttacggacgggtaccgacgtaccacctatacgtacgtacgacaagaacaacgtaccaaacgtaacctaccttccgtaccgtgacgtcgtacgtaccgtacgtcgtaccgaccggtacccggacgtacccggtcgtactaagttacttaacgttgtgtacgtgtaagtttcgttacgagagttacgtccggggttaggtacgttaggtcgtacggtggtcggggtaacgtaaggtacgtagtaccggttacgagttcccggttaccacgtccacccgggttccctaacccgg

SEQ ID NO: 84372 - DNA, 679 bp, Homo sapiens
  misc_feature: GYAE6OF02GSCWX.36.23.C01.1.454.CMB.1.raw
  modified_base (174)..(174): a, c, t, g, unknown or other
  misc_feature (174)..(174): n is a, c, g, or t
  modified_base (188)..(188): a, c, t, g, unknown or other
  misc_feature (188)..(188): n is a, c, g, or t
  modified_base (221)..(221): a, c, t, g, unknown or other
  misc_feature (221)..(221): n is a, c, g, or t
  modified_base (237)..(237): a, c, t, g, unknown or other
  misc_feature (237)..(237): n is a, c, g, or t
tcagtacgctgtctcacgaccggtgctcgatttagtacacgtgattagggagttgggggggggtctcaggaggcagcgctctcaggacatctccaccatggcctgggctctgctgctcctcaccctcctcactcgagggcacagggtcctgggcccagtctcggcctagacacngcctcgcctcggtntctgacgactctggacagtcgatcacatcctcngactacgtcgaacagnagtggacttggggggggtctcgttataattatgtacttccgtacgttaccgacacgtacacttcgtacggcgacgccgaccccgtaacttaccttaattacgtagtagttcgttcgtaccggtccgtcgtcggtttacgtacgtcgtacgttcgtccgtctacctaagtcgtacgactaacgaccggtcctcccgtacgtacctacttaccgtacctacgtacctacgacggtacgtacggacggacggacggccttaggtaacttacgttacttacgacgtaccgtacttacgtacgttaacgtactacggtaacgttacgtaacgtacggttaacctacggtacgtcgttcggttacgggttcgggaacgggtaccggtaacgtacggttaccgtaccggttacgtaccggtacgtaccggtaccggtacggtaccccgg

SEQ ID NO: 84373 - DNA, 771 bp, Homo sapiens
  misc_feature: GYAE6OF02FSLL6.36.23.C01.1.454.CMB.1.raw
  modified_base (111)..(111): a, c, t, g, unknown or other
  misc_feature (111)..(111): n is a, c, g, or t
tcagtacgctgtctcacgaccggtgctcgatttagtacacgtgattagggattgggggggggtctcaggaggcagcgctctcaggacatctccaccatggcctgggctctnctgctcctcaccctcctcactcgagggcacgagggtcctgggcccagtctggcctgacacagcctgcctccgtgtctgagcctccgtggacagtcgatccaccatcctctgccacgtggaaccagcagtgacggttggtcgtacttaataagtttatgttccgttccgttacgttaccaactagctaattcgacggacaggacccgtaaccccgtaaattacgttttaaattttaagtggttaacggtttcgtttaccggtccggtccccttaggttacggggttttactacggttccgttccgtttcctaccggtcctaccgaacgttcgtcggtaacaccggtaccgtccctacccgtacgaccctacttccgtacgtaacgtaccgtaccgtaggtaccgtacgggtaacgggacggtaacggtaccgttaggtaaccgtttagttttacgttacggtacctacgggtaccttaagtaactttaaagttacgtaaacgggtaatttaacctaaaggtttacgttacgttaccgtaacggttcgggtcggttacgggttccggggtaaccggggtaacggtaccgttaacggtttacccgggtaccggtttaccggttaaccgggtaccgtccccgggtaacccggtaccggtcccgg

SEQ ID NO: 84374 - DNA, 684 bp, Homo sapiens
  misc_feature: GYAE6OF02G3UQS.36.23.C01.1.454.CMB.1.raw
  modified_base (249)..(249): a, c, t, g, unknown or other
  misc_feature (249)..(249): n is a, c, g, or t
  modified_base (324)..(324): a, c, t, g, unknown or other
  misc_feature (324)..(324): n is a, c, g, or t
  modified_base (455)..(455): a, c, t, g, unknown or other
  misc_feature (455)..(455): n is a, c, g, or t
  modified_base (526)..(526): a, c, t, g, unknown or other
  misc_feature (526)..(526): n is a, c, g, or t
tcagtacgctgtctcacgaccggtgctcgatttagtacacgtgattagggattggggggggtctcaggaggcagcgctctcaggacatctccaaccatggcctgggctctgctgctcctcaccctctcactcagggcaacgagggttcctcgggccctagtcctggcctagacacagcctgcccttccgtgtctgactactccgtggacgaagtcgataccactatccgccttgaccacgtacgaaccngactaggtagtacgttggagtactttaattaaatacgtgtaccttaccgtagttacccgaaacagtctaattcgnggacacgaccgacccgtaattcttaattagtaggtacgttctttacggtccgtacccttgggtacggtttctagttccgcgtttacccgtcggtactagtctacggacaacgaccgtcctaccacgtaccncgtctactacgacttacgacgttcgaaggtcggaaggtacggtctaagtaaccgtttatttaacgtcgaanacgtctacgtaattaaacgttatacgtaaagtacgtattacggtactaacccgtagttacggtcgttcgttacgggaaccggtaaacggttacgtaaaggttcccgtaaccgttacgtaccggtaagaccgggtaacaaccgggttcccgtaccccgg

SEQ ID NO: 84375 - DNA, 765 bp, Homo sapiens
  misc_feature: GYAE6OF02IO93T.36.23.C01.1.454.CMB.1.raw
tcagtacgctgtctcacgaccggtgctcgattagtacacgtgattagggattggggggggggtctcaggaggcagcgctctcaggacatctccaccatggcctgggctctgctgcctcctccaccctcctcactcacgggcacgagggtccgtcggggcccagtcctcggcctcgaccacacgccctcgcccgtccgtcgtctagacgacctccgtaggaccgacggtcgtactaccgacctactcctacctcgaccacgtacggaaccacgacgtacggtacgtacggttggtagtaccttaataattatcgttaccttccgttcggttacctaacgagtctacgttcgacggtccgaccggtacccgtaccccgtaaactttacctttaagtttacgtacggttacgttccgtttccggtacccggttaccgtacggttaccgggtttactcggttacgtccgtttccgtcccggtacctaccgtaacgttcgtacggaccctaaccgcccgttaccccgtaccgtccgtacctaacttccgtacgtaccgaccttcgaccgggtcgtacgggaacgggacggtcggtacttcgtaactttacgttacgttcgattacggtactaccgttaatacgttaatacggtaacttacgtaacgtcgtactaccgtcgtacggacgtttcgggaacggtaccgggtaacgtacggtttaacgcgtacccggtacgtaccggacccgtacggtacccggacgtccccgg

SEQ ID NO: 84376 - DNA, 787 bp, Homo sapiens
  misc_feature: GYAE6OF02JBK5A.36.23.C01.1.454.CMB.1.raw
  modified_base (575)..(575): a, c, t, g, unknown or other
  misc_feature (575)..(575): n is a, c, g, or t
  modified_base (622)..(622): a, c, t, g, unknown or other
  misc_feature (622)..(622): n is a, c, g, or t
  modified_base (735)..(735): a, c, t, g, unknown or other
  misc_feature (735)..(735): n is a, c, g, or t
tcagtacgctgtctcacgaccggtgctcgatttagtacacgtgattagggagttgggggggggtctcaggaggcagcgctctcaggacatctccaccatggcctgggctctgctgctcctcaccctctcactcgaggcacgcggtcgcggccagtcgcggtctagactacgcgtcctcgcctacggtcgtacggacgtcctcgtacgacgacgtacgtacaccacgtactccttaccgtcgacctacggtacggaaccacgccgtaagtcggttaacggttcggtacgtttacttaaagtttaagtgttaccgttcctttccgggtacttaaccaaagtcctagtaccttacggacgtccggaacccgtccccgtaaaccccgttaaatttaccgtttaaagttacggtacggttaacgttttccgtacgggtaccgtcccttagggttacgggtttaccagttccgttccgtaccgtccgtacctaacgttaacggtcgtacggtaaccgaaccgttcccggtccctaacgtacctaacgttctacccgtactacgtaccccgtagtaacgggngacgggtaacggtaaccggcttacgtaacggttaacttcgggtttanccggtaactacgtaccgttaaattacggttaactacgttaaacggaacctttaccgaagggtttacttaacccgaccgtttagggtcgtaccgtacggtcggggtaaacccgngttaacgtcgtacgtaccgttacggtgaccctacggctacgcccttacccgg

SEQ ID NO: 84377 - DNA, 674 bp, Homo sapiens
  misc_feature: GYAE6OF02G2IA9.36.23.C01.1.454.CMB.1.raw
  modified_base (128)..(128): a, c, t, g, unknown or other
  misc_feature (128)..(128): n is a, c, g, or t
  modified_base (298)..(298): a, c, t, g, unknown or other
  misc_feature (298)..(298): n is a, c, g, or t
  modified_base (450)..(450): a, c, t, g, unknown or other
  misc_feature (450)..(450): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctcctnactcaggcacgaggtcctgggcccagtcctggcctgacacagcctgcctccgtgtctgagactccgtggactagtcgatccacctatcgtcctgcctactcggaaccagacgaggtcgtacggttgtacgtctttaataacttagtgttacctccgttagttcccaaacngactattacgacggcacgacccggtacccctaaattcgtttaaatttgacgttacgtttcttccggtccgtacccgttcggtagggttttccacgttcgtcctttccgtccgccttacgtactcgcgacctacgaccgtccctccacgtacnctcgtactcgtaccgcgcggctaggaggtaccgcgtgtacgtatttcgtaatcgtacacgtcttacaacgttactacgttaaacggtaactacgtaacggttccgtacgtaccgtccgttacggtaccggtcgggtttaacgggacgggtaccggtaacgttacggttacccggtaccgttaccggttaccggtaaccgtaacccggtaccgacggttccccgg

SEQ ID NO: 84378 - DNA, 787 bp, Homo sapiens
  misc_feature: GYAE6OF02IUXE7.36.23.C01.1.454.CMB.1.raw
tcagtacgctgtctcacgaccggtgctcgatttagtacacgtgattagggagttgggggggggtctcaggaggcagcgctctcaggacatctccaccatggcctgggctctgctgctcctcaccctcctcactcagggcacgagggtcctgggacccagtctgggcctagacacagcctacgtccgtccgtgtctgacgtacctccgtaggactacggtcgtaacgtaccacctatccgttcctcgaccgtacgtaccggaaacctacgacgtaaggtcggtacgttggtacgttacttaataagttactcgttcttaccggtcggttaacccaacgacgtactaacgttcgaacggtacgaccggtaccgtaaccccggtaaacttactttaaagtttacgtacggtacgggtttacctttccggtaccggtccccgttaacgggttacgggtttcctaacgggttccgtccgtttacccgtcccggtacgttaccgtaacgttcgtacggacctaaaccggacgtacccgttaccgtacgacctacttacctacgtaccgtaacgtccgtaaggtccgtaaacggtcggaaccgtagggtccttaagtacgttagttacgtacgactacggtaactacgtacttaacgaaccttaagggtaacgtacttaaacgtacggttaccaaccgttaggtacgtcgttacgggacgggtaacccggaggtaaccgtacggtaccgtaaccggtaccggtacgtaccgacggttacccgtaaggtccccgg

SEQ ID NO: 84379 - DNA, 756 bp, Homo sapiens
  misc_feature: GYAE6OF02HHQJT.36.23.C01.1.454.CMB.1.raw
  modified_base (178)..(178): a, c, t, g, unknown or other
  misc_feature (178)..(178): n is a, c, g, or t
  modified_base (674)..(674): a, c, t, g, unknown or other
  misc_feature (674)..(674): n is a, c, g, or t
tcagtacgctgtctcacgaccggtgctcgatttagtacacgtgattagggattggggggggtctcaggaggcagcgctctcaggacatcgtccaccatggcctgggctctgcctagcctcctcaccctcctcactcagggcacgagggtcctgggcccagtctacggcctagaccacncgtccctgcccgttccgtaggtcctacgtaacgcttccgtaggacctaggtccgactacccgaactacgttcctccgtgccgaaccgttaacgaacccgtgctaacggtcggttaacggttggttacgtacttaaggttaactttacgtcgttacgttccgttcggttaaccaacgtacgtactacgttcgaggtcaccgtaccgtaacccgtaacgtccttttaaagtttcgtacggttacgttccggttacgtccggtacccgtacgtaaggggttttcctacggttaccgtactttccgtaccgggttactaacccgtagttaccgcggtaaacctaccgaaccggtcccctacgtaccgaccgttagtacctacgtacgtacgtaccgacgttaccgtacggaacggtacgacggttacgtaagttacgttacgtttgcgtactacggtactacgtaactggtaacttagaaccttcgaagttcgttaaacnccgttagtcgttacgtcggtaccggtaggtaaccggtactacggtccgtacgtacgtccgtacggccgtacggactccccgg

SEQ ID NO: 84380 - DNA, 926 bp, Homo sapiens
  misc_feature: GYAE6OF02GZFOM.36.23.C01.1.454.CMB.1.raw
  modified_base (190)..(190): a, c, t, g, unknown or other
  misc_feature (190)..(190): n is a, c, g, or t
tcagtacgctgtctcacgaccggtgctcgatttagtacacgtgattagggagttgggggggggtctcaggaggcagcgctctcaggacatctccaccatggcctgggctctgctgcctcctcaccctcctcactcgagggcacgagggtccgtgggcccagttcgtggcctgacacagcctcgcctcgtntcgtgacgacctctaggactacggtcgactaccacctacttccgtcctaggacctaccggtacggaaacccgacgacgtaaggttacggtaccgggttttagggtcggttaaccttttaaagtttaaactttacgttacgtttcccgtttacccgggtttaccggtttaaccccaaaaccgtacgtacgtaacgtttaccgaacgggtccgaaccggaccccggtaacccccggttaaacctttaacttttaagttttacgtacggttaacggtttccgtttaccggttcccggtcccgttacggttacggggttttactacggttccgttaccgtttccgtccgggtacttacccggtaacggttccgtacggaaccctaacccggtaccccgttacccgttcccgtaaccgtaccctaactttaccgtcccgtaaccggtacctacccggaggtccggtaacgggacgggaaccggtcgggttaaccgttaacgttactttaacgtttacgttacgcgtaaccgttcctacttaaagttacccgttaagttaccggtaaacgttaccggttaaggttaccggttaccgtaccggtacggttttacgggtcggttacccggggtaacggggtaccgggggtaaacggtaacccggttaccgggttacccggttaacccggttaccggttacccggtaaccccgtaccgggtaccccgttccggggttaaccccgg

SEQ ID NO: 84381 - DNA, 753 bp, Homo sapiens
  misc_feature: GYAE6OF02JTY4J.36.23.C01.1.454.CMB.1.raw
  modified_base (704)..(704): a, c, t, g, unknown or other
  misc_feature (704)..(704): n is a, c, g, or t
tcagtacgctgtctcacgaccggtgctcgatttagtacacgtgattagggattgggggggaaatactttctgagactcatggacctcctgcacaagaacatgaaacacctgtggttcttcctcctcctggtggcagctcccagatgggtcctgtctcaggtgcagctgcacgctaggtccgggacccgtagggtacggtggtagaacggtcccgtttacggaccgtaccctcggttccccacgaccgtcgccgtacgttgtcgtcgtacgggaccgtcccctcccggtcgggaccgtagtagtacgtaggtcgggtaggtcgggtaccgggtccccgacgtacccggaccccgggaaggggacgggtcctaggtacgttcgggagtttaggtaagtaaaagtaacgtgggaaccgggtaccgggacaaccgtaactaacgtaagcgtaccgtacccgtgggacggggttacctacgtaaccaacttactacgtccgccgtaacgaagtaaccgtaacggtaaacccaaacggttaaaccctccgttaccgtaccgtacggtacggtaccgtacgaccgttacggtcggaccggtccgaccggtacgtaccgacgtaacctattacgttacttacgtacggtcgtaggtaggtttacgttcgacggtcgttagttcggtaggtcgtacgtcgtcggtggtacggngtaacgcgtccgtagtcgtacgtcgtacctcgtacgtaccgcctaccgg

SEQ ID NO: 84382 - DNA, 897 bp, Homo sapiens
  misc_feature: GYAE6OF02IPFWY.36.23.C01.1.454.CMB.1.raw
  modified_base (120)..(120): a, c, t, g, unknown or other
  misc_feature (120)..(120): n is a, c, g, or t
  modified_base (208)..(208): a, c, t, g, unknown or other
  misc_feature (208)..(208): n is a, c, g, or t
tcagtacgctgtctcacgaccggtgctcgatttagtacacgtgattagggattgggggggggtctcaggaggcagcgctctcaggacatctccaccatggcctgggctctgctgcctccnccaccctcctcactcgagggccaccgtacgggtcctcggggaccccagtccgtcggcccgtagaccaacgcggccctcgccctcggtntctgacgtcctccgtaggaactagtcgactacacctatcctccgtcgccgaacgtacggaaaccaggtcctaaaggtccggtaacggttggtcgttaacttaattaacgttacgtcgttccttccgttacggttaaccaaacgtacgtactacgttaccgaacggtacgaccgaccccggtaaccccgtaaactttacgtttaaacgtttacgtaccggtttacgggtttacccgttccggttacccgggtacccgtttacgggttaaccggggttttaccgtaaccgtttccgttaccgtttcccgttacccggtacccgttaacgttaacggtccgtaggtaacccgtaaccccggtaacccgggttcccccgtaaccgttccccggtaaacgttaacccgtccgtttaacgtacccgggtacccttacccggaaacgggttcgtaaccgggtaaacgggtacccggtaaaccgggttccgttaaacggtttaacccgttaaagttttccggtaaacgtccgtaaaccgtcgttacgtaaacgttttactaacggttaaaacgtacgtaccgtttaaaggttccgttaactacgtaccgttacgtacggttcggaccggggtaacgtaccggtaacggtacgttaccgacggttaccgtagtcccgaacggaccgtacgtaacccgg

SEQ ID NO: 84383 - DNA, 757 bp, Homo sapiens
  misc_feature: GYAE6OF02JUKGN.36.23.C01.1.454.CMB.1.raw
  modified_base (123)..(123): a, c, t, g, unknown or other
  misc_feature (123)..(123): n is a, c, g, or t
  modified_base (137)..(137): a, c, t, g, unknown or other
  misc_feature (137)..(137): n is a, c, g, or t
  modified_base (210)..(210): a, c, t, g, unknown or other
  misc_feature (210)..(210): n is a, c, g, or t
  modified_base (335)..(335): a, c, t, g, unknown or other
  misc_feature (335)..(335): n is a, c, g, or t
  modified_base (353)..(353): a, c, t, g, unknown or other
  misc_feature (353)..(353): n is a, c, g, or t
  modified_base (551)..(551): a, c, t, g, unknown or other
  misc_feature (551)..(551): n is a, c, g, or t
  modified_base (734)..(734): a, c, t, g, unknown or other
  misc_feature (734)..(734): n is a, c, g, or t
tcagtacgctgtctcacgaccggtgctcgatttagtacacgtgattagggagttgggggggggtctcaggaggcagcgctctcaggacatctccacatggcctgggctctgctgcctcctccnccctcctcactcgngggccaacgtacgggttccgtcgggcccagttccgtcggccctgaccacgcgtcctcgcctccgtgtactganaccttccgtggactacgttacgactcacctactccgtcctggcctacgtacggaacctagctaggtcgtacggtttgtacttacttaagttacttagtcgttacctccggttacgtaccaaccgngtacctatacggaccggngaaccggtcccgtaccccgtaaacttctttaaagttcggtacggttcgtttccggttaccgtccgggttaccttacgggtttcgggttttaccgcgtttccgttccgtttccggtaccgttcctttaacacggttcgtacggaaccctaaccgcccggttacccaccgtaaccgtacgttaccttcgtacgttaaccnccgtaccgtaggtctaacggtaccggacgggtcctaggttcttaattacgtactcggacctacggtacttacgaattcggtacgtgtaacgtactagtacctagttcgacggtaggttctcccggggtaaggacgggttaacgtccgtaacgggtttaccaccgggtttaccgtaggtaaccnccggtaaccggcgttaaccccgg

SEQ ID NO: 84384 - DNA, 820 bp, Homo sapiens
  misc_feature: GYAE6OF02H6YSQ.36.23.C01.1.454.CMB.1.raw
  modified_base (250)..(250): a, c, t, g, unknown or other
  misc_feature (250)..(250): n is a, c, g, or t
  modified_base (269)..(269): a, c, t, g, unknown or other
  misc_feature (269)..(269): n is a, c, g, or t
tcagtacgctgtctcacgaccggtgctcgattagtacacgtgattagggagttgggggggggtctcaggaggcagcgctctcaggacatctccaccatggcctgggctctgctgctcctcaccctcctcactcgagggcacgacgggtcctgggcccagtctggcctagacacagcctgcctccgtgtctaggacgaccttccgtggacaggttcgattccaaccgattcctccgtgcacgtcggaaccngctaggtcgacggtttggngtaactttattaagttatcgttccttccgtaggtttacccaaagtcgtacttaacgttacgaggtccacgggaccgtaaccccgtaaactttacgtttaattagtcggttacggttttcctttccggtaccggtacccgttacgggttacgggttttcctacggttacccggttctttcccggacccggttccttaacccggtaacgttccgtaaccgggtaacctaaaccgacccgggttccctaccgtaccggtaacctacgttacctacgtaacgtaccgtaccgtacgggtacgtaacggaccggtacggacggttacttacggtaactttacgtttacgttcgacctaacggtcttaactaagttacgtacgttaacgggaacgtttaacgtaacgttcggtaccttaaccgggtcgttaccgggtcgtttaaccggggttcgggtaaccgggtaaccgggttaaaccgttaacgggttaccggtaacccgtttaacccgggttacgggtacccggtaaccgttaccccggggaacttcccccggg

SEQ ID NO: 84385 - DNA, 841 bp, Homo sapiens
  misc_feature: GYAE6OF02H5QLI.36.23.C01.1.454.CMB.1.raw
  modified_base (247)..(247): a, c, t, g, unknown or other
  misc_feature (247)..(247): n is a, c, g, or t
tcagtacgctgtctcacgaccggtgctcgatttagtacacgtgattagggagttggggggggtctcaggaggcagcgctctcaggacatctccaccatggcctgggctctgctgctcctcaccctctcactcgaggcacgacgggtccgtggcccagtctcggtcctgacacgacgcctgcctccgtgtctgacgtctccgtaggactggtcaatccaacctgtccgtcctgacacgtacggaaccngcaggtgtacggttgtagtactttaataatttacgtcgttcctccgttacggttaaccaacgtgtactacgttaacgaccggtacaacggccccgtaaaccgtaaactttcgtttaatttacggtacggttaaccggttttccgttccgggtaccggttaccccgttacgggtttaggggttttccctaaggttccccgttctttaccgggtcccgtactttaaacccgggtaagttcccgtacgggaaccccttaacggtacccggtccccttaaccggttaacgtaaccctaggttaccttacggtaaccgtaccggttaaccgacgggttacgtaacggggtaaacggtcggtaacggtccttaaacggttaaccttaaggtttacgacgtactaacggttacctattaaaacgtttcgtaacggtaacgttaaaccgttagtaaacggtttacggtaacccttaccgttagggttaccggttccggtttagggaacccggggttaacggtaaaccggttaacgggtaacgtttcccgggttaaacccgtcgggtaaaggtcccgtaacccgttaccgacgggttaccccg

SEQ ID NO: 84386 - DNA, 851 bp, Homo sapiens
  misc_feature: GYAE6OF02IM3Y7.36.23.C01.1.454.CMB.1.raw
  modified_base (122)..(122): a, c, t, g, unknown or other
  misc_feature (122)..(122): n is a, c, g, or t
  modified_base (130)..(130): a, c, t, g, unknown or other
  misc_feature (130)..(130): n is a, c, g, or t
  modified_base (132)..(132): a, c, t, g, unknown or other
  misc_feature (132)..(132): n is a, c, g, or t
  modified_base (134)..(134): a, c, t, g, unknown or other
  misc_feature (134)..(134): n is a, c, g, or t
  modified_base (192)..(192): a, c, t, g, unknown or other
  misc_feature (192)..(192): n is a, c, g, or t
tcagtacgctgtctcacgaccggtgctcgatttagtacacgtgattagggagttggggggggggtctcaggaggcagcgctctcaggacatctccaccatggcctgggctctgctgctcccncctcctcncncngacgcacggtcggtcgtcgctagtcgcgctcacacgcgtccgtcgtccgtcgtgtcgngactccgtcggtacgacgtagtactactaccaactccttccgtccgtcgtactaaccggtaccgaaccgtacgacgtaggtacggttacggttggtaccttaaatttaaacgttacttcggttccgttacccgtttaccggttacccgtaaccgaacgtaccttaccttaaacggtcggaccggtaaccgccccggtaaccccggttaaaaccttaacgttttacgtttaagttcggttcggttaccgttccccgtttacgggccccgttcgttaggggttttccgttaccgtcggttacttccgttcgggtaccctacgtacgtcggtacggtaccaaaccgtccggtcccttcccggtcctaaccggtaactacgttccctaacgccgttacccgtaagggtcggttaggaacgggacggtacgggttaacgttccggttaacttaacgtttacgttacggacgttccgagtttccctaacgtaacgtttaacgtagggtaacccgtataaccggttacggttaacgtacccttccggtagggttacgttcccgggttttacggggccgggttaaaacgggtaaccgtttaccgggtacggttacccgttaccgttcgggtaacgcccggtttaaccggaccggttctaaccccggg

SEQ ID NO: 84387 - DNA, 895 bp, Homo sapiens
  misc_feature: GYAE6OF02HRQ0F.36.23.C01.1.454.CMB.1.raw
tcagtacgctgtctcacgaccggtgctcgatttagtacacgtgattagggattggggggggaaatactttctgagactcatggaccctcctgcacaagaacatgaaacacctgtggttcttcctcctcctggtggcagctcccagagtgggtcctgtctcaggtgcagctgcagcgaggtccgggcccgaggaggtggtagaacgtccgttcgggacgaccctcgtccccctacaccgtgccgccgttgtcggtcgtcgggaccgtccccgttcccggcgggacggacgtagtaggtacggttaggggtcggggtagggttccgggtaccccggaccccgtacccggaccccccgggaagggggaacgggtcggtagggtacgggttagggtacggtttagggtaaggtaaaaacgttaaggacggggaccgggtaacccgggggaccaaacccgtaaaccgtaaaccgtaaggtccggtaccccggttacccggtacgggtaccggggtacgtaccgtaccaaccgttacgtacgtcgtacgaccaaacggtaaccgtaaaccgtaaaccgaaccgtaaccccttaccgttcccctaccggtaaggaccggtcctaaccggtccctttcgtacggtcccgaccccgggtccgggtacccggtacccggtaccggacccgttaatttacgttactttaaggtccgtacggtaacggttacgtttagttttaggaccgttggtaccggtttcggggttacgggtccgttcggttaccgggttccggggttacgggttacggggtaaacgtaccggggttacgtaacccggtacgttaccgttccggttcccgtaccgtttccccggacccgttacccggtaccccggtaaccccgg

SEQ ID NO: 84388 - DNA, 1086 bp, Homo sapiens
  misc_feature: GYAE6OF02JG03H.36.23.C01.1.454.CMB.1.raw
  modified_base (257)..(257): a, c, t, g, unknown or other
  misc_feature (257)..(257): n is a, c, g, or t
tcagtacgctgtctcacgaccggtgctcgatttagtacacgtgattagggattgggggggaaatactttctgagactcatggacctcctgcacaagaacatgaaacacctgtggttcttcctcctcctggtggcagctcccagatgggtcctgtctcaggtgcagctgcagcagtcgggcccaggagtggtgaacgccttcggaagccctgtcccctcacctgcgctggtcgtctggagcctcccgtcgggcggagntgaatggtggaggttgggtccgccacgcccccgagggacggggccgtggaggttcggtagtttgggtagaaaacgttaaagtaggtaacgggaaccggggggtcaaacccgtaaaaccgttaacgtaaacgttaccggaccggttaccccgttaccggtacggggggttaccggtaacggggtacctaacccgttaaacgttaacgtttaccgttacggaaccgtaacggtaaaccgttaaaaccgggttaaaccccgaaaaacggttaaacccccggtttaaaccttttacccccggtttaacccccggtttacgggtaaacccgggggtacccgtttaaacccgggtaaacccccgttttcccggtttaacggggtttaaccccggggaaaccccgggttaccccccgggggtaacccggggttaacccggttaccccggggtaaacccccgttaaaacggttttaaccggttttaaaacccgtttttaagggtttttacccgggtaaccggttaccgggggtttaaaccgggttttaaccggttttttttttaacggggacccggtttaaaaccggggggttaacccgttttaccggggggtttttaacccgggggggtaaccgggtttaaccgggtttacccgggttaaccccgggtttttaccgggggtaccgggggttaaacccgggtttaaacgggggttaacccggttaaacccggggttaacccggtttttaaccgggtaacggtttcccccgggtttacccggttttacccccgggtttaacccgtaccccgggtttacccccgttaaaccccccgggg

SEQ ID NO: 84389 - DNA, 834 bp, Homo sapiens
  misc_feature: GYAE6OF02FIU7L.36.23.C01.1.454.CMB.1.raw
  modified_base (232)..(232): a, c, t, g, unknown or other
  misc_feature (232)..(232): n is a, c, g, or t
tcagtacgctgtctcacgaccggtgctcgatttagtacacgtgattagggtagttggggggggtctcaggaggcagcgctctcaggacatctccaccatggcctgggctctgctgctcctcaccctcctcactcagggcacagggtcctgggcccaggtcctggccctgaccacagcctgcctccgtgtctgggttcctccgtggacaggtcgaatccaccacgttcctccngaccacgtacggaaccagctaaggtcgtacgtttgggtaggtaaacctaacgttcctaagttaccgttccgtaccgtttaccgggtaaccctaaacgtaccggtaacccccgacgggtaacccaaaccccggtaacccccctaaaacttaccgaacgttttacccgtttaagtttttaccgggaaccggtttcgggtaacggtcccgggtaccctacgtaacgttaacttttaccgtaacgttccggtctttaccgtcgttcggtaccttaccggaacgttccgcgtaaacccggaccgttacccgggtacccttccctaaccggtaacctacgttacccggttcgtaccgggtcctacccggtacgtaccgttagggaaccgggcgtaacggtccgttagttaacgttacgtttaacctcgtttacccactacttacgttacgacggtaccggtagtttccgttcgtttccggtccggtacgggtcccgaaccgtaccgttccgacccgtacggttcccggtaaccgaccgggtaccccgtaaggttccccacccggttcccccgtaccggtctaccccgttcggttaccccgtcccccgg

SEQ ID NO: 84390 - DNA, 758 bp, Homo sapiens
  misc_feature: GYAE6OF02IAZ5E.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcaggcacagggtcctgggcccagtctggcctgacacacgcctgccctccggtgtccgtgagaccttccgtgggacaggtcatccacctattcctccgtgctacgtacggaaccagccaaggtcggtacggtttggtgtcttaattaattatcgttcttccgtacggttaccaatgctacttcgacggcaccggtacccgtacccccgtaaactttacgtttaaacttttacgtacggttaacgttttccgtttccggttcccggtcccgttcggttacgggggttttactacggttccgtcttccgtccggtcttaccgtaacgtcgtacggtaccaacgtcccggtcccttcccgtcgtaccctacttctctaaccgtaccgtccgacgggtctacggaaacgggtaccggtcggaccgttagtaaccgtttaactttagttccgtcgtaacgtcttaacctaacgtttacgttaacgtaaccgttaagttacccgttaagttcggttaacctcgtacgtcgggttccttggtaacccggggacgggtaacgggaacccgtttaagggttcccggtacgttacccggtacggtacccggtacggttacccccggaggtacccccgg

SEQ ID NO: 84391 - DNA, 991 bp, Homo sapiens
  misc_feature: GYAE6OF02F3MUS.36.23.C01.1.454.CMB.1.raw
tcagtacgctgtctcacgaccggtgctcgatttagtacacgtgattagggattgggggggggtctcaggaggcagcgctctcaggacatctccaccatggcctggctctgctgctcctcaccctcctcactcgagggcacgtagggtccgtcgggcccagtcgtcggcctagacacgacgcctcgccgttccgtgtcgtggacgtaccgtcccggtaggaccgtggttacgtactaccacctacttcccttcctaggtacctaccgtacgggaacccaggaccgtagggtacggttacggtttgggtacgttactttaattaagtttacgttcgttaccgttaccggtttaccgtacccgaaatacgtaccttagttcgacgggaccgaccggaccccgtaaacccccgtaattttaaccgtttttaaagttttacggtaaccggggttcggtttttacccgtttcccgggttccccggttccccgtttacggggtttaccggggttttaaccttcccggttacgttcccgtttacccggttcccggtccctaaaccggtttacggtttaacgtaccccgggaacctaaccccgggtaacccggttcccccgtttacccgtaacccgtacccgttaacctttacccgtacccggtttaaacgtaccccgttacggtaaacccgggttccgggttaaaacgggggtaacggaacccgggtagtttcccggttaacttaaaccgggttttaacctttacggttaacgacccggttacgttaccctaaaaggttaccttttaaacggttcccgtaaaaggtttaacgttaaacgttacgttaacggttaacctacccggtttaggaccggttttccgggtaccggggtacggggaaccggggtttaacccggaaccgtttaacgggttaccgggtcccgggtttaccgtaaccggggttaccaacccgggttaccgtaacccgggtacccccgg

SEQ ID NO: 84392 - DNA, 833 bp, Homo sapiens
  misc_feature: GYAE6OF02F5GU0.36.23.C01.1.454.CMB.1.raw
  modified_base (172)..(172): a, c, t, g, unknown or other
  misc_feature (172)..(172): n is a, c, g, or t
  modified_base (185)..(185): a, c, t, g, unknown or other
  misc_feature (185)..(185): n is a, c, g, or t
  modified_base (241)..(241): a, c, t, g, unknown or other
  misc_feature (241)..(241): n is a, c, g, or t
tcagtacgctgtctcacgaccggtgctcgatttagtacacgtgattagggagttgggggggtctcaggaggcagcgctctcaggacatcgtcctaccatggcctgggctctgctgctctcacctctcactcagggcacgaggtccgtgggcccagttctggcctgtacacgngcctgcctcggtntcgtgatacctctggactagtcgactcacctatccgtcctgcctacgtacggaacngacgtacgtcggtacgtttggactaccgttaataactttagccggtttacctccttaggttccaaagtacgaccttaacgttccggaacggccgtacggtaccccggtaaaccccttaagtttccgtttaaaacggtttcgacgggtaacgtttttcccgtttaacgggccccggtttccccgttaagggttacgggttttacctaacgggttcccgttccgtttaccgtccccggtagttaccgtaacggttcgtaaccgaacgtacccggtccgggttacccttccggtaagtacccttacgttaccggttactaaccggtaccgtacggaccggtacgttaggtaccggggaacctcgggttaacgacgtttaaccgttaaggtttaccgtaaccgtaacggtcgtaccgttaaattcgttaccgttaagtacgtaaccgtttaagtaaccgttacggtaccctacggttagtcccggttaacggttcggggtaacccgtacggggttaaaccggaccgtttacgggtaaaccgttcccggttaacgttaccgggttaccgacccggttaccggtacccggttacccgg

SEQ ID NO: 84393 - DNA, 770 bp, Homo sapiens
  misc_feature: GYAE6OF02F9T8F.36.23.C01.1.454.CMB.1.raw
tcagtacgctgtctcacgaccggtgctcgatttagtacacgtgattagggattggggggggtctcaggaggcagcgctctcaggacatctccaccatggcctgggctctgctgctcctcaccctcctcactcgagggcacgagggtcctgggcccagtctggcctgacacagcctgcctccgtagtctgacgacctcgtggactaggtcgatccacctacttcctcctgtacctacgtacggaaccagtacgaggttacgtacggtttggtacgtactttaagttaatttacgttcgttccttccgttacggttacccaacgtacgtactaacgttaccgacggacgacggtacccggtaacccccgttaaacttactttaaagtttacgtacggttcggtttaccgttttccggtcccggttccgtttacggttacgggttttcctacggttccgtaccgtttccggttaccgtacctttacgtaaccggttcgttaggaccgttaaccgacccggtcccttacccgtacgacccttacgtcgtaccgtacgtacccgtcgtacggtcgtacgggacgtacgggtacgtacgttacgtacttagtttaacggtcacctaggtcctaagtaacttacgttacgtaggtaacttacggtaactacggttacctacgtacggttcgttcggtacgggtccgggacggtaccggttaacggacgtttaccggtacgtaccgttaccggacgtacccggacctacggtaccccg

SEQ ID NO: 84394 - DNA, 788 bp, Homo sapiens
  misc_feature: GYAE6OF02G5BPD.36.23.C01.1.454.CMB.1.raw
tcagtacgctgtctcacgaccggtgctcgatttagtacacgtgattagggattgggggggaaatactttctgagactcatggacctcctgcacaagaacatgaaacacctgtggttcttcctcctcctggtggcagctcccagatgggtcctgtctcaggtgcagctgcagcagtccgggcccaggagtggtgaagccgttcggagaccctgtccctcacctgcgctgtgtcctggacgcctcccgtcggcggagatcggaatgggtgggtaggttcgggtccgtcccaacggcccccccgtaaggggaacggggccgttaggaggtttcgggagttgggtacggtaaaattaaaagttcggaacgggtacccggggggaccaaacccgtaaacgttaaccgaaagttcggtcccggttaccccgtacggtaaccgggggttaccggaacggttccgaacccgtaattaccgttctacggacctaaggaaccgtaacgtacccgaaacgtaaccctaacccgttacctacccgtaggacggtctaccggtaacccgttccgtcggtaccggtacccggcccggtaccggtaccgtaccggtaccctatttaaacgtaactttacgtttgtcgacggttaggttacggtttttacgcgttaacgggtagttcgggttcggggtacgttacgttcgggtacgggttcggtcggggtaacgtaaggggtaccttacgtaaccggttgtaacgttccggttctacccctcggtacccgaccccgttaacccg

SEQ ID NO: 84395 - DNA, 534 bp, Homo sapiens
  misc_feature: GYAE6OF02G8ML1.36.23.C01.1.454.CMB.1.raw
  modified_base (228)..(228): a, c, t, g, unknown or other
  misc_feature (228)..(228): n is a, c, g, or t
  modified_base (364)..(364): a, c, t, g, unknown or other
  misc_feature (364)..(364): n is a, c, g, or t
  modified_base (441)..(441): a, c, t, g, unknown or other
  misc_feature (441)..(441): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcatcaccatctcctgcactggaaccngcagtgacgttggtgcttataattatgtctcctggttccaacagcattcaggcagcgccccgaaactcttaatttatgagtctttcgtcgcctcgtagggttctagtcgcttctccgtctccaagtctggacaacncggcctccctgacccatctctagacctccgaggctggacggtacgaggtctgacgttattattcgcagtctcattanacgtagaacgtctaagtcgtaactccacgtggcttggttcggacgggaagggacctaggttcgaccggtcgtaggtccagtcccgaggtcccg

SEQ ID NO: 84396 - DNA, 810 bp, Homo sapiens
  misc_feature: GYAE6OF02F043A.36.23.C01.1.454.CMB.1.raw
tcagtacgctgtctcacgaccggtgctcgatttagtacacgtgattagggattggggggaagaggaagactgacggtcctgtctcaggtgcagctgcagcagtcgggccccaggagtggcgaagccttcggagaccctgtccctcacctgcgctgtgtcgtggagccctccctcggcggagactggaatgggtggacggtttcgggtccgccacgcccccgaggggaacgggctggaggttggacgttggtagaaataagtgacggaccggggcaaccgaaactacaactcgtccgtccgtacggacgggtacgacgtaccacctactacgtcgtacgacacgactaacgtaccaacgtacctaccttccgtccgtaggtacggtcgtaccgtaccgttcgtcgtaccggaccggccggaccggtaccgtaccggtacctaagttacgtttacgtttagttcgtacggtacgtaagtttacgtttttaaccgtttttacgttacggtttacgggtttacgggtttaagtttaacgttaacggttaacggggttaggggtttcggggtttacgtttagtaacgttacggtacgggtacgggtaacggtaaggtaacgttaacgttccggttaccgttccgtttacttcgttaccgtaccgtcccgtaaccgaccggtaccgtacccgttccgttacccggttcccgttacccgtaccgtacccgtacccgtaccgtaaccgaaccggtaccgtacccgtccggtaccgggtccggtaccgtaccggcccgggtcccggtccggtcggtccg

SEQ ID NO: 84397 - DNA, 974 bp, Homo sapiens
  misc_feature: GYAE6OF02IR4T7.36.23.C01.1.454.CMB.1.raw
tcagtacgctgtctcacgaccggtgctcgattagtacacgtgattagggagttggggggggtctcaggaggcagcgctctcaggacatctccaccatggcctgggctctgctgctcctcaccctcctcactcagggcacagggtcctgggcccagtctggcctgacacgtagcctgcctccgtgtctgagactcctggacagtcgatcaccatcctaccgtgaccacgtaggaaccagccaggtgtaacggttgggtgtactttaacttaatttaactcgtaccttcccgttggttacccaactaggtacctaacgtttaccacgggtaccaacggtcccggaaccccccgtaaacgttaccgtttaaaagttttactacgggtaacggtttcccgttttaccggtacccgggtccccgttacgggttacggggtttccgttacgttaccggtccgttttacccgtcccggtaccttacccgtaaacggttcgtacgggtaacctaacccgaccgggtaccccttaccccgtaacgaccctaacgttacccgttacgtaccgaacccggtttacccgacggttaccgtaaccgggaacggggtaacccggtaacggggtaccttttaaccgggtaaacccttttaaacggttttaacccgttttacggggtaacccttaaacgggttaccccgtttaaactaaaccgtttaaaccgtttaaacccggttaaacggggtttaaaaaccgttaaccgggttttaaaccggttaccgggttttaaaacctaaccccgttaaccggtttacgggtaccccgtttttaaccgggggttaaccggggggtacccggggtaaaccgggggtttaaacccggtttaaaaccggggtttcccgggttaaaaccccgtttcccgggtttaacccgggggttacccaaccccgggttaaccccgggtaacccgggttacccccgg

SEQ ID NO: 84398 - DNA, 910 bp, Homo sapiens
  misc_feature: GYAE6OF02HHD3O.36.23.C01.1.454.CMB.1.raw
tcagtacgctgtctcacgaccggtgctcgatttagtacacgtgattagggattgggggggggtctcaggaggcagcgctctcaggacatctccaccatggctggctctgctgctcctccaccctcctcactcgacgggcacgacgggtcctcgggcccagtcgtcggcctgacacacgtcctgtcctccgtgtctgacgaccttccgtaggaactagtcgtactaccaacctacttcctccgtagaccaacgtaccggaaaccacgacgtacggtcggtacggttacggtacgtactttaaacgttaatttacgttcgttccttaccgttacggttaacccaaacgacggtacaacgtttacgaacgggaccgtaccggaccccggtaacccccgttaaaactttacgttttaaacgtttacggtacggttaacggtttcccgttttccggaccccggttccgttaccgggtttacggggttttactacggttcccgtcgttttccggccccggtacgtttacccgaacggtttccgtacgggtaaccgtaacccggtaacccggtccccttaaccggttccggtaaactacgtttccctaacggttaacccgtaacccgtcggtacccgggttactaacgggaacgggtaccggtacgtccggttaaacgttcttaacgtttcgaaccggtactacgttactacgttaactttacgaccgttaaggtaaaccgtacgttaaacgttcggttaaacctccgtaacgggttaccggtacgggtttaccggggcggggttaaccggtaacggggtaaaccccgtttaacgggtttacccggtaacccccggtttaacggttttaacccggggaccccggttaactaacccccgggttaagggttccccccgg

SEQ ID NO: 84399 - DNA, 903 bp, Homo sapiens
  misc_feature: GYAE6OF02IHEXO.36.23.C01.1.454.CMB.1.raw
  modified_base (220)..(220): a, c, t, g, unknown or other
  misc_feature (220)..(220): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcagggcacgagggtcctgggcccagtctggcctgacacacgcctgcccttcgtgtcttggagaccttcctgggacacgtcgatccacnctcctcctgctacgtacggaaccagtcgaggtcgtacggttcggtgtacctttaagttaactttagttcggtacccgtttccgttacgggtttaaaccccaaacgtaacggtcccgttaaagtttacccggaacgggtaccccgtaaccgggttacccccgggaaaaccccccggttaaaaccttttaccgttttttaaaaacgttttaagggttaaccgggttaacggtttttccccgtttaaccgggtttacccgggtcccccctttacgggggtttaaacgggggttttccttaccggggttacccgtttacccgttttaaccgggttccggggttaaccccttaaccggtaaaacgggtttcccggttccgggaaccctaaacccgggtccccgggtttcctacccccgtttacggaacctacgtttccttaccggtaacgtaccccgtttacgacggtccgtagggtaaccgacggtagggcttacgtacttagttaagttcccgactaaggccctagttaactgttaaacgtgtaaacgttacgtaacgtacgtacctcgtaccggtacggtcgttttcggccgggtaccggggtaaggtacccgtttaacggttcgggtaacccgttacggttaaccgggtacccggtaacccggtacccggtaccggtcccccgg

SEQ ID NO: 84400 - DNA, 1047 bp, Homo sapiens
  misc_feature: GYAE6OF02JUD6J.36.23.C01.1.454.CMB.1.raw
  modified_base (172)..(172): a, c, t, g, unknown or other
  misc_feature (172)..(172): n is a, c, g, or t
tcagtacgctgtctcacgaccggtgctcgatttagtacacgtgattagggagttgggggggggtctcaggaggcagcgctctcgaggacatctccaccatggcctgggctctgctgctcctcaccctcctcactcaggcactgggtcctgggccagtctggacctcgacacngtcctcgtcctccgtgtccgtagacgtaccgtccgtcgggtaacacggttaccactacctacccaactttcccggtttcccacggcccgttaaacgtcccgggaaaaaccgtccggaaccgttcggggtttaacgtacccggggttttggggttaaacgttcccgttttaaaagtttaattttaccggggttaccttttaccgttttcccccgggttaaccgggttttaaccccgaaaacctacggttcccgtaaacttccggtaacgggggacccaaccgggtaaccccggttaaacccccgttaaaaacgtttaacttttttaaacgtttaaacggttaccggttagggttttacccccgttttccggttaaaccccggggtttacccgtcgggttttaaaccgggggtttacccgtttaacggtccccggttaacccgttttccccgggaacccccgtttaaaccggttaccccgggtttaaaacgttcccgggtttaaggaaaccccgtaaaccccggggttccccggtaacccccgttttaacccgggacccgtttaaccgttaaccctttcccgggttaacccgttaaacggttcccccgtaccgggttaaacccggggtagttaccggggaaaccgggtaacggttccggggtacccttacggttttaaaacctttgggttaacccttaagggtctacccgtttagaacccgtttaagtacgtttacggtagttaaccgtacggttacccttaaaggtttcccgttacgtccggcgtttacggttacggccgggtaacggtccgggtaaacgttccggtaccgtaccgggtaaccgttggaaccgtcccggaaacgtccggtaccccg

SEQ ID NO: 84401 - DNA, 679 bp, Homo sapiens
  misc_feature: GYAE6OF02JTP9L.36.23.C01.1.454.CMB.1.raw
  modified_base (182)..(182): a, c, t, g, unknown or other
  misc_feature (182)..(182): n is a, c, g, or t
  modified_base (268)..(268): a, c, t, g, unknown or other
  misc_feature (268)..(268): n is a, c, g, or t
  modified_base (464)..(464): a, c, t, g, unknown or other
  misc_feature (464)..(464): n is a, c, g, or t
  modified_base (472)..(472): a, c, t, g, unknown or other
  misc_feature (472)..(472): n is a, c, g, or t
  modified_base (483)..(483): a, c, t, g, unknown or other
  misc_feature (483)..(483): n is a, c, g, or t
  modified_base (590)..(590): a, c, t, g, unknown or other
  misc_feature (590)..(590): n is a, c, g, or t
tcagtacgctgtctcacgaccggtgctcgatttagtacacgtgattagggagttgggggggggtctcaggaggcagccgctctcgaggacatctccaccatggcctgggctctgcctgccttcctcaccctctcactcgagggcacgagggtcctgggccctagtcgtggacctgaccacgngtccctcgcccgtccgtgtccgtagacgacctcctggtacaggttaccgatccaccacttccgtccctaggccacgtacggaaccngtaccgtagtcggtaccggttgtcgtactttaataacgtttactgttccttaccgtcggttaaccaacgaacgtctaagttcgacgtcgtacgcccgaacccgtaacttacttacttagtcgtagttccgttcgccgtccgtgttacggttctacgtcgtcgttcgtccgctaccgagtcgacgacacgccgtccnccgttacncctagtctacnccgacgtacgcgtacgtacgggacgacggcgtcgtacttacgttcttacgtcacgtcgtactctacgtacgtaacgttgacgttacttagacgtacctacttccggnttccggttagtaaccggggttacgaacgggttacgtaacggtccgtaccggtacgttccggaactacccgggacgtacccgttcccggg

SEQ ID NO: 84402 - DNA, 845 bp, Homo sapiens
  misc_feature: GYAE6OF02GNB7G.36.23.C01.1.454.CMB.1.raw
  modified_base (176)..(176): a, c, t, g, unknown or other
  misc_feature (176)..(176): n is a, c, g, or t
  modified_base (276)..(276): a, c, t, g, unknown or other
  misc_feature (276)..(276): n is a, c, g, or t
tcagtacgctgtctcacgaccggtgctcgatttagtacacgtgattaggggagttgggggggggtctcaggaggcagcgctctcaggacatctcaccatggcctgggctctgctgctcctacaccctcctacacctgagggcactagggtcctcgggacccagtcgtacgccgtanacgacagtccctgccctccgggtatctagacgtacctcgtaggggaacctacgggtcactccaaccctagttcctccttaagccaaccgtagggaaaccncgcttaaggtccggttaggtttgggttacacgtttaataagtttagtcgttccgttccttacggttaccgaactacggactaacgtttcgaaggtcgtaccgaccggtaaccccgtaaacttacctttaactttttaacagggtaacgttcgtttccggtaccggtccccttacgggttacgggttttacgtacggtcgttccgttccgtcggttaccgtacccgttaacggtccggttaacgacgaccgtaacccgggttccgttaccggtacgtaacgtaacctttcggtaacctttaaccggacctacccggttaacgggaccgtacgggtaacgggaacccgggacggttaaccggtacgttaaaccgttaaggttttaacgtacgtacttacggtaccttacgtaaatttacgtttaagaaccggttaagttactaacgttaccggtactttaccgaccggtttcggtacgtaccgggttggaaccggggttaagaccccgttaaagggttcccgaaaccggttccgtaaccggtccggaaccgttaacccggcgttaacccgg

SEQ ID NO: 84403 - DNA, 813 bp, Homo sapiens
  misc_feature: GYAE6OF02JZ49P.36.23.C01.1.454.CMB.1.raw
  modified_base (156)..(156): a, c, t, g, unknown or other
  misc_feature (156)..(156): n is a, c, g, or t
  modified_base (575)..(575): a, c, t, g, unknown or other
  misc_feature (575)..(575): n is a, c, g, or t
tcagtacgctgtctcacgaccggtgctcgatttagtacacgtgattagggattgggggggggtctcaggaggcagcgctctcaggacatctccaccatggccgtgggctcgtgctgccttcctcaccctcctcactcgagggcacgagggttccgngggacccagtctcggctagaccacacgcctcggcccttcggtgttcgtaggacgtcctccgtaggtacctaggtacgtaactccacctacgttcctccgttacgcccgtaacgacgggaacccgtaggaccggttacggtacggttaaccggtttggttactacgttttaacttaaactttcgttcgttcccttaccggtttacggttaccgaacgtacgtacctaacgttcccgaagggtccgaaccggtcccgtaaacccccgttaaagtttatttaaacggttcgtaccggtttaacgtttccgtttaccgggtcccgtacgtttcggttacggtttccgtacggtccgtaccgttaccgtccgtccgtttacggttaacgtccgttacggtaaccgtaaccgttcccggtacccnccgttaaaccgcgtaaccgttccgtaccgtacgacccgtaccgtggtaacgtacggacggacgtacgttacgtaccttacggttacttcgtcgtattaaccgcgttaacttaacgtacgttaacgtaggtacttaaccgtaagtacgttaacgtctggttacgtggttaccggtaggccggttaacgcggttaacgtcggaccgtttacggacttcggacccgtagaccggtacccgg

SEQ ID NO: 84404 - DNA, 783 bp, Homo sapiens
  misc_feature: GYAE6OF02JLPA0.36.23.C01.1.454.CMB.1.raw
  modified_base (237)..(237): a, c, t, g, unknown or other
  misc_feature (237)..(237): n is a, c, g, or t
tcagtacgctgtctcacgaccggtgctcgatttagtacacgtgattagggattgggggggggtctcaggaggcagcgctctcaggacatctccaccatggcctgggctctgctgctcctcaccctcctcactcgagggcacgacgggtcctcggggcccagtctggcctgacacagcctgcctccgtgtctgacgctcgtgacagtcgactcacactctcctcgctacgtcggaacngcagtcgtacgttggtctacttaatagttagtcgtccttccgttacgtacccaagtacgtcctacgttcggtacgggcctaccggtacccccggtaaccccgtaaaacttttaccgttttaaaagtttacgttcggtacgggttttacccgttttcccgggtacccgggtaccccgtttacgggttacggggtttttacctacggttcccgttacccgtttcccggtcccgggttaccctaaccggttaaccgttccggtaaccggacccgttaaacccggcccgggttcccttacccgtaacgtaacccgttccgtacgtaccgttaccgaccgtacctacggggtctacggggtacggaacgggtcgtctacgttaattacgtactcgtactagtacctacgtacttacgtagtacggttaaacgtcgttaagttcggttaccacgttcggcggttcggtccggtacggggaaccgtaagggtacccgttaggtaccgttacccgggttaccgtaggtcccgtaccggacccgttacgcccggg

SEQ ID NO: 84405 - DNA, 722 bp, Homo sapiens
  misc_feature: GYAE6OF02HZ9A8.36.23.C01.1.454.CMB.1.raw
  modified_base (352)..(352): a, c, t, g, unknown or other
  misc_feature (352)..(352): n is a, c, g, or t
  modified_base (516)..(516): a, c, t, g, unknown or other
  misc_feature (516)..(516): n is a, c, g, or t
  modified_base (584)..(584): a, c, t, g, unknown or other
  misc_feature (584)..(584): n is a, c, g, or t
  modified_base (598)..(598): a, c, t, g, unknown or other
  misc_feature (598)..(598): n is a, c, g, or t
tcagtacgctgtctcacgaccggtgctcgattagtacacgtgattagggagttgggggggggtctcaggaggcagcgctctcaggacatctccaccatggcctgggctcgtgctgcctcctcctaccctcctctactcgaggccacgtacgggtccgtcgggccctagtccgtcggtctgaaccacacgcctaccgtccgtccggtgtcgacgacgtaccgttccgtacgggactacggtccaacttaccaacctactccgtctcgcctacggtaccggacaagcgtcggtaggtacggttcggtacttaatttagttaaagttgtcgttaccttcgttcggtaacaacggntctaagtccagtacgaccgtacccgtaacctacgtttactttactagtacgtccgttccgtttacgtccggggtaccctaggggtttaaccgttcgaccggtccttacctccggtccacgttaccgacgtccgaagtcccacgtaccccggtccctaatacccngtctactcgtactaccgtcgtgtacgaggacggacggtcgtacgttaactacggttatacgtcgtacngtacactacgtaanccgttaagtatcgtagtacgtctaccgtaacgtcggtacgttacgggccgggtaaccgtagggacccgttacggtccggtaacgttccggaaccggtacggtaccgaccggccgttaaccccgg

SEQ ID NO: 84406 - DNA, 823 bp, Homo sapiens
  misc_feature: GYAE6OF02F4XMY.36.23.C01.1.454.CMB.1.raw
  modified_base (193)..(193): a, c, t, g, unknown or other
  misc_feature (193)..(193): n is a, c, g, or t
  modified_base (681)..(681): a, c, t, g, unknown or other
  misc_feature (681)..(681): n is a, c, g, or t
tcagtacgctgtctcacgaccggtgctcgatttagtacacgtgattagggattggggggggtctcaggaggcagcgctctcaggacatctccaccatgcctggctctgctgctcctcaccctctcactcgagggcacgagggtcctgggccctagtctcggcctagaccacgacgtccctcgtccctccggtnttcctaggacgtacctcccggtaggaacacggtccgaactccacctacttcccttaccgtcgacctacgtaacgggaacccaggacgtacggttcggtcggtttaggtacgttacttaacgttaatttacgttcgttaccgttccgttacggtttacccgaacgtacgtacttaacgttaccggaacggtaccgtacccggaccccgtaacccccgttaaccgtttaactttaaccgttttaagtaccggttaccgtttccttttacccgggttccgtccccggtttaccggttacgggtttaccgtacgttccgtaccgtttccggtcccggttacctaaccgtacggtttcgacggtaccctaaccgtaccccggtcccttacccggtacgtaccgtacgtaccctacgtaccgtaccccgtaaccggtacgtccgtaacgggaaccggaccggagtaccgttacgtacctttaattacggttacncggtaacctcgtatacttagtacgtaactaagttaacctacgtacgtacgtacccgtgtcggtcgtacgggtcgggacggttacggaacgtttacgtccggtaccttaccggtaacgtctaacccggaccgtaccgtcccgg

SEQ ID NO: 84407 - DNA, 685 bp, Homo sapiens
  misc_feature: GYAE6OF02GQ19G.36.23.C01.1.454.CMB.1.raw
  modified_base (193)..(193): a, c, t, g, unknown or other
  misc_feature (193)..(193): n is a, c, g, or t
  modified_base (202)..(202): a, c, t, g, unknown or other
  misc_feature (202)..(202): n is a, c, g, or t
  modified_base (243)..(243): a, c, t, g, unknown or other
  misc_feature (243)..(243): n is a, c, g, or t
  modified_base (263)..(263): a, c, t, g, unknown or other
  misc_feature (263)..(263): n is a, c, g, or t
tcagtacgctgtctcacgaccggtgctcgatttagtacacgtgattagggagttgggggggggtctcaggaggcagcgctctcaggacatctccaccatggcctgggctctgctgctcctcaccctcctcactcagggcacgagggtcctcggggacccagtctggcctgacacagcctgcctccggtgtccngacgctccnggacagtcgatcacctatcctacgctaccgacgtcgaaccngtacaggttcgtacggttgngtacttataattactgtacctcgttacgtccaagagtcgtattcgacgcacggtacccgaccccgttaaactacttttaatttagtacggttacggttcctttcggtacccggtccggttacgggttaaccgggttttccacgttcccggttctttacgttcccgtacgttacccggtaagtccggttacgacctaaaccgtcccggtccctccgtacgacctacgtaccgttgtaaccgtaacctcggtaccgtacggtcggaacggtaacggcggttatacggttacttgttatacgcctaagtctacattacggtacgtagttacgatacgttgacctacggtgtacggtcggttaggtcggtaacggagtaaccgtacggtacgtcgttacggacgtacacggtacgtccgacccggg

SEQ ID NO: 84408 - DNA, 773 bp, Homo sapiens
  misc_feature: GYAE6OF02JJEWU.36.23.C01.1.454.CMB.1.raw
  modified_base (139)..(139): a, c, t, g, unknown or other
  misc_feature (139)..(139): n is a, c, g, or t
  modified_base (219)..(219): a, c, t, g, unknown or other
  misc_feature (219)..(219): n is a, c, g, or t
  modified_base (539)..(539): a, c, t, g, unknown or other
  misc_feature (539)..(539): n is a, c, g, or t
  modified_base (632)..(632): a, c, t, g, unknown or other
  misc_feature (632)..(632): n is a, c, g, or t
tcagtacgctgtctcacgaccggtgctcgatttagtacacgtgattagggattggggggggtctcaggaggcagcgctctcaggacatctccaccatggcctgggctctgctgctcctcaccctctcactcgaggcacngggtcctgggcccagtctggtcctgacacagcctgcctccgtgtctagagcctccgtggactaggtacgatccgaacctnttccgtccgtaggccctaaccgtacggaaacccaggtacgtaagtcggtacggtttgggtcttactttaagtaattacgtcgttcccttcttacggttaccaacgtcgtatacgttcgaagggtacaccggtacccgtaacccctaattaccgttaaagtttcgtacgggttaccggtttccgttttccggacccgtccccgtttagggttacgggtttacctaggttccggttacctttcccgtaccggtacccgtttacgtaaggttcccgtgggtaacctaaccccggccggttcccctaccgttacgtaacccgtnttacccgtacgttaccgtacctccggtaggtccgagggtaccgcgtaaggtccttagtaccgtttattacggtcgaccgtacgtcccgttaanacggtttactaccgttaggaaacctttcgtaaaggtccgtacgtcacggtttcgtacggtgggtacccgggtaacgggaacggttacccgtaacgttcggtaccccgttagtaccgtaccgaggtacccgtacggtccccg

SEQ ID NO: 84409 - DNA, 717 bp, Homo sapiens
  misc_feature: GYAE6OF02I1A6H.36.23.C01.1.454.CMB.1.raw
tcagtacgctgtctcacgaccggtgctcgatttagtacacgtgattagggagttgggggggtctcagggaggcagcgctctcaggacatctccaccatggcctgggctctgctgctcctcaccctctcactcagggcacgagggtcctgggcccagtctcggcctgacacagcctgtccttcgtgtcagagacctccgtggacacggtcactccaccatcctcctgaccacgtaggaaccagccgagtcgtacgtttggtgtacttataacttagttcgttacttccgttcggttaccaacgtacgtctacgttacgagggctaacgccgtaccccgtaaattcgtttaaactttgtacgttacggttccgttaccggtccgtacccgttacggttacgggttactacggttcgtccgtttaccgtccggtacctaccgtacgtcgtacggactaaaccgtcccggtacccttacccgtcgtaacctacgtaccgtactaacgtacctaccggtagtcgtaagtacgggaccgtacgactttaacgtaaacgtttcgttaaacgttcgaacctagtacctacgtaagttaccgtaacgtcgtaaacgttcgtaaagtcgtaaccttacgtacgttcgtaagtttccgggtaacggcggtaacggtaaccttacggttctaacccggtacgtacgacgtaaccgaccgttacgtcccg

SEQ ID NO: 84410 - DNA, 818 bp, Homo sapiens
  misc_feature: GYAE6OF02IXYRI.36.23.C01.1.454.CMB.1.raw
  modified_base (189)..(189): a, c, t, g, unknown or other
  misc_feature (189)..(189): n is a, c, g, or t
tcagtacgctgtctcacgaccggtgctcgatttagtacacgtgattagggattgggggggggtctcaggaggcagcgctctcaggacatctccaccatggcctgggctctgctgctcctcacctcctcactcaggcacagggtcctagggcccagtctcggcctgacacagcctgcctccgtgtctganactcctggacagtcgatcaccatcctctgacactacggaaccagcagtgtacggttggtactactttaataacgttatcgtaccttcgttaccggtaccaaacgagtacctaagtttccgaaggggtacctaacggtccccggtaacccccgaaaaactttcgttttaaaacgtttacgtacggtaacgggttttccttttaccggtccggtaccccgttaggttaacggggttttacctacggttccgtaccttttaccgtcccgggtaaccttaccgaaacggtttcgtacgggtaacctaaacccgtaccgggtccctttccccgtaaaacggtccctaaacgtttcccgtaaccgttaacgaccccgttaccggaacggttcctaaaggggacggtaacggtacggtccgttaggtaaaccttattaacggttcgaccgttaggaccttacgtaactttacgaacgttaggtaaaccgttaccgtaaagttaccgttacgtaccctagggttacgtccgtttaagggggttcccggcgggttaaacggtaaacccttaaggggttcccgaaacccggtttcggttaagggtaaccccaaacgggtaccccgttaacgggtccccg

SEQ ID NO: 84411 - DNA, 698 bp, Homo sapiens
  misc_feature: GYAE6OF02I5YZV.36.23.C01.1.454.CMB.1.raw
tcagtacgctgtctcacgaccggtgctcgatttagtacacgtgattagggattggggggaagaggaagactgacggtcctgtctcaggtgcagctgcagcagtcgggcccaggagtggtgaagccttcggagaccctgtccctcacctgcgctgtgtctggagcctccctcggcggagattgaatggtggtagttgggtccgccacgcccccgagggaaggggctggagttggattggtgaaataagtggacggaccgggggccaaccaactacaatcgcgtccctcgaggggtcgagtcaccatactctgacagacaagtccaacgaacctacttcctacccgtgacggctagacctcgtcgtcgaccgccgcggtactcggacctatacttatttagttcgtacgacgtagttacgtttttcggacgtacggtacgttcggttaggggtacggttacgtcggtaccggttcggtacggggttaacgaacgggtacgtaccgtaccgggtactacgttcccgtaccgttcccgtctacgtacccgtacccgaccgtaaccgggtcccctacggttcccgttacccgtttaccccgcgggtccctcccgtcgtccctaccgaacggtccgtaccgacccgtaccggtacgacgtacgaccgacggcccggtaccggtccgggtacgtccggtacccgg

SEQ ID NO: 84412 - DNA, 880 bp, Homo sapiens
  misc_feature: GYAE6OF02I3LSW.36.23.C01.1.454.CMB.1.raw
  modified_base (284)..(284): a, c, t, g, unknown or other
  misc_feature (284)..(284): n is a, c, g, or t
  modified_base (301)..(301): a, c, t, g, unknown or other
  misc_feature (301)..(301): n is a, c, g, or t
  modified_base (405)..(405): a, c, t, g, unknown or other
  misc_feature (405)..(405): n is a, c, g, or t
tcagtacgctgtctcacgaccggtgctcgatttagtacacgtgattagggagttggggggggtctcaggaggcagcgcgtctcgaggacatcgccaccatggcctgggcttctgcgtgcgtaccttcacccgtcctactacctcgagggctacgtacgggttcctgggcccctaggtccgttgggccgtacgacgtacctaggtcctgcccttccgtgtaccgttgaacgacgttccgtagggtaccgacgttaccgaatccctaaccgtattcccgtccgttncctacgtacggaaaccnggtacgtcgttaggtaccggtttggtattactttaagtaaattcggttattcccgtccgtttaccgttaacaacgtaacgcgttaacctttaagcgggtaaccnccggttacccgaaccccgtaaaacttccgttttaattagtaccgggtactttctttccgggcctaccggtacgtcgggtttaacctgttacgttccttcgtcccgtagttaccgtacggttccgtagaacctaacccgccccggtacctaccgtagttaccgtacttccggtaactccggtaaccggtccgtacgggttagtaccgggtacgtaacgacggttacggtacggttaaccctttaagttacggtacgtacggtaccttacgttacccttattaacggttacctaacggtaacgttacgttaaggtaccggtttacctcccgtaaacggggtttctttaacccgggtacggtttaaacccggggggcggtttaaacccgggtaccgtttaaaccgggttcgggtttacccgtaacggggtttaccgaaacccgggttacccggttacccggaacgttttccccccggg

SEQ ID NO: 84413 - DNA, 859 bp, Homo sapiens
  misc_feature: GYAE6OF02JNOUL.36.23.C01.1.454.CMB.1.raw
tcagtacgctgtctcacgaccggtgctcgatttagtacacgtgattagggattgggggggggtctcaggaggcagcgctctcaggacatctccaccatggcctgggctctgctgctcctcaccctcctcactcgagggcacgacgggtccgtcgggcccagtcgtcggccgtggaacacgacgccgtcggtcccttccggtgttcgtcgacgtccgttccgtcgggactacggtcgtaactccgaaccctacttcctcctcgtaccctacgtacgggaaaccaggacctacgggttcggtacggttgggtactttactttaaattaacgtttacgttcgttccggtttccttccgggtttaacccaacgtacgtaccgttacggttaccgacgggtaccggtaccggaaccccggttaccccgttaaaacctttacgtttttaaagttacggtacgttttacggttcccggtttaccggttccccggtaccccggtttaacggtttcggggttttaccgtacgtttcccgttcccgtttccggtcccggttaccgtttaaacggtacgttaccgtaccggtaaccgtaaccggtccccggtccccttaccgggttaactacccgttaccgttccgttaccgtaccggtaaccgtccggtaccggttacggttacggggaccgggtaacgtacgggtcgttacgttacgttacgtttacggctacggtacctacgtactacgtagtacgtaacggtacttcgtaacgtacgtacctagtcgttcgtcgttcgggtacggtacggtacgtacggtacgttacggtcgtaccgtacggtaccacgggtcgtaccggtcccgg

SEQ ID NO: 84414 - DNA, 754 bp, Homo sapiens
  misc_feature: GYAE6OF02IKVS8.36.23.C01.1.454.CMB.1.raw
  modified_base (176)..(176): a, c, t, g, unknown or other
  misc_feature (176)..(176): n is a, c, g, or t
  modified_base (195)..(195): a, c, t, g, unknown or other
  misc_feature (195)..(195): n is a, c, g, or t
  modified_base (208)..(208): a, c, t, g, unknown or other
  misc_feature (208)..(208): n is a, c, g, or t
  modified_base (213)..(213): a, c, t, g, unknown or other
  misc_feature (213)..(213): n is a, c, g, or t
  modified_base (230)..(230): a, c, t, g, unknown or other
  misc_feature (230)..(230): n is a, c, g, or t
  modified_base (255)..(255): a, c, t, g, unknown or other
  misc_feature (255)..(255): n is a, c, g, or t
  modified_base (290)..(290): a, c, t, g, unknown or other
  misc_feature (290)..(290): n is a, c, g, or t
  modified_base (313)..(313): a, c, t, g, unknown or other
  misc_feature (313)..(313): n is a, c, g, or t
tcagtacgctgtctcacgaccggtgctcgatttagtacacgtgattagggagttgggggggggtctcaggaggcagcgctctcaggacatctccaccatggctggctctgctgcctcctccaccctcctcactcgagggcacgagggtcctcgggcccagtcgtggcctagacacngccctcgcctccgtgtcgngagtaccttccgnggacngtaccgaatccaacgtntcctcctcgactacgtacggaaccngcgtagtcggtacggttgtcgtacttaattaattntcgttccgttcgtcgttacaacngtctacgtcggacgccgtaccgaccgtaaccctaaagtttactttaatcgtagggttccgtttcgttcccggtccgtccgttacggttaggggtttcctacggtcccgttcttcccggtacgtcccttaacgtacggtaccgtcggaaaccttacccgtacccgtcccccttaaaccggtccctaaactaccgtttacctaacggtacgtacccgaccggtaaggttaccggtaccgggaaggaacccggttaggttctaaccgtttagtttaacgtcttaaggcgtaacctacttacttaagttactaaccggtaagtaacgtattaagggtctaccgtacgtcggtacggtccgtacggggtaaccggtacggaacggttcgtaaccggttacccgtaccggtacggtaccggtacgtccgtaccggtacgtcccccgg

SEQ ID NO: 84415 - DNA, 860 bp, Homo sapiens
  misc_feature: GYAE6OF02FYADU.36.23.C01.1.454.CMB.1.raw
  modified_base (331)..(331): a, c, t, g, unknown or other
  misc_feature (331)..(331): n is a, c, g, or t
  modified_base (461)..(461): a, c, t, g, unknown or other
  misc_feature (461)..(461): n is a, c, g, or t
tcagtacgctgtctcacgaccggtgctcgatttagtacacgtgattagggattggggggaaatactttctgagactcatggacctcctgcacaagaacatgaaacacctgtggttcttcctcctcctggtggcagctcccagagtgggtcctgtctcaggtgcagcgtgcagcgagtccgggaccctaggagtggtagaagtccgttcggacgtaccctcgtccctacacctcgcgctcgtgtcgtgcgtccctcccgtcggacggagtgtagaagtggtcggtaggttcgggtcccgaccgaccgacccccggaggggacgggcgttggngttacggtagttaggagtaaaagtaagtggaaccgggacggggtaccaacctaaacgtacgtaacgtccggtacccgtaccccgtacggtacgggggtacctacgtaccctaacccgattaaccgttccncgtaacctaaacggtaacgtaaccggtaacccgaaacgtaacccgttaaccctttcccgtacccgggtaggtaacccgggtacccgttaacgtaccccgttcggtttaccggtacccggtaaaccccggccccggtacccgggtaaccccttacgggtacccttaacgttttaacctaaccgttttaggttccggttacggttacccggtttaagttttacggttttcgaacggttacgggttaccgtttaggggtcccgggttaacgggttacttacccgggtccggtttacgggtccgggttaaacgggacgggttaaccgtccccgggttaacggtccgttaaccgtttccggttaaccccgtccgtacccggttacccgtacccctaaccccggg

SEQ ID NO: 84416 - DNA, 783 bp, Homo sapiens
  misc_feature: GYAE6OF02HCI6F.36.23.C01.1.454.CMB.1.raw
  modified_base (189)..(189): a, c, t, g, unknown or other
  misc_feature (189)..(189): n is a, c, g, or t
tcagtacgctgtctcacgaccggtgctcgatttagtacacgtgattagggagttgggggggggtctcaggaggcagcgctctcaggacatctccaccatggcctgggctctgctgcctcctccacccttcctcactcgagggccaacgcggggtcctcggggaccccaggttcctgggccctgaccacngtccctcgcccgttcgtgtacctggacgtacctccgtagggaacctggtccgactacaaccgtatccgttccgaggaccacggtacggaaacctgccgtaaggtcgtacgggttggtactacttaattaagttgtcggttcctaccgttcggtaaccaacgtagtctacgttacgaacgggctacggaccccggtaaccctaaatttcttttaaagttacgtcggttaacgtttccgtttccggtcccggtacccgttaaggggttacgggtttctaccgttccggtcctttacccggccggtactacctaaggtcgtacggacctaaaccgcccggttccctaaccttacgacctacttaccgtacttacgaaccgttccgagggtacgagggaaccgggtacgtacgtaacgtacgtttaacttacggtttaccgtgaacggacctttacgtacttaaacggtttactacgggttaaccaagggtttaccagggttttaccaccgtttcgaacgttttggacgttcgggtaacggcggttaacgaacggttaacgttcgaccggttcgacgacgtaacgcccggtagtcccg

SEQ ID NO: 84417 - DNA, 690 bp, Homo sapiens
  misc_feature: GYAE6OF02JPQML.36.23.C01.1.454.CMB.1.raw
  modified_base (88)..(88): a, c, t, g, unknown or other
  misc_feature (88)..(88): n is a, c, g, or t
  modified_base (170)..(170): a, c, t, g, unknown or other
  misc_feature (170)..(170): n is a, c, g, or t
  modified_base (172)..(172): a, c, t, g, unknown or other
  misc_feature (172)..(172): n is a, c, g, or t
  modified_base (219)..(219): a, c, t, g, unknown or other
  misc_feature (219)..(219): n is a, c, g, or t
  modified_base (226)..(226): a, c, t, g, unknown or other
  misc_feature (226)..(226): n is a, c, g, or t
  modified_base (298)..(298): a, c, t, g, unknown or other
  misc_feature (298)..(298): n is a, c, g, or t
  modified_base (302)..(302): a, c, t, g, unknown or other
  misc_feature (302)..(302): n is a, c, g, or t
  modified_base (313)..(313): a, c, t, g, unknown or other
  misc_feature (313)..(313): n is a, c, g, or t
  modified_base (462)..(462): a, c, t, g, unknown or other
  misc_feature (462)..(462): n is a, c, g, or t
tcagtacgctgtctcacgaccggtgctcgatttagtacacgtgattagggagttggggggggtctcaggaggcaccgctctcaggacntctccaccatggcctgggctctggctgctcctcaccctctcactcagggcacagggtccctgggcccagtctcggactgacncngcctggcctcgtgtctgacgtctccgtggaccaggtccgatccaccngtctccnggccacgtcggaccagcacggtgtaccggttggtactcgttaattactagttcgtctccgtggttaccactncgtntcggagcgacncccggtacccgaactttcgttaagtactcgggtacggtttcgttccggtaccgtcctaggttagggtttccgtacggttctaccgttccgtccggtaccctacggtagtccgtagtcccaaacgtcccgtccttaccacgtaacccgtntacgttcctacgtaccgtaccgtcggagttacgggacggcggaacgggtccttaggaacccgttttagttaaccggttgcccgttaacgcgttacctaagtacgtacgtaacgtacgttaacgtcgtacggttacctacgttcgtcgtccgtaggtccgggtaacggaacggtaccggtaacgttcgtaaccgttcggtacgtcgaacggcccgacggtcctcccggg

SEQ ID NO: 84418 - DNA, 691 bp, Homo sapiens
  misc_feature: GYAE6OF02GF7QD.36.23.C01.1.454.CMB.1.raw
  modified_base (218)..(218): a, c, t, g, unknown or other
  misc_feature (218)..(218): n is a, c, g, or t
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
  modified_base (303)..(303): a, c, t, g, unknown or other
  misc_feature (303)..(303): n is a, c, g, or t
  modified_base (514)..(514): a, c, t, g, unknown or other
  misc_feature (514)..(514): n is a, c, g, or t
tcagtacgctgtctcacgaccggtgctcgatttagtacacgtgattagggattggggggggtctcaggaggcagcgctctcaggacatcgtccacatggcctggctctgctgctctcaccctctcactcaggctacgacgggtcctgggcccagtctcggtcctgacacgatcctgccctcgtgtctgagcctcgtaggactgtacgatccgaacctnttcctacgngtacctacgtacggaaccngcgtagtggtaacgttggtactacttaagtattagtcgtcctacgttcgttaccaancgtctattcgagtccaacgccgaacccgtaattacttaaagttcgtacggtaggtttccgttacggccgtcccttacggttacgggtttactacggtccttcgttacccgtccgtaacttcgtaacgttccgacggttaccaacggtccgtccctacccgtagacctcgtacctcgtacgtaccgtacgcgtacgacggtacgacgtacgntaacgtacgttatacgtgactacgtctaacgtacttacgtactacgaacgttacgtaacgtacgttacctacgttacggttacgtacgttacgggtaccggtacgggttaacgtaaccgttacggttaccgtacggttaccggttaccgtacggacccggttacgtacggttccccg

SEQ ID NO: 84419 - DNA, 847 bp, Homo sapiens
  misc_feature: GYAE6OF02GN3NR.36.23.C01.1.454.CMB.1.raw
tcagtacgctgtctcacgaccggtgctcgatttagtacacgtgattagggagttgggggggggtctcaggaggcagcgctctcaggacatctccaccatggcctgggctctgctgctcctcaccctcctcactcgagggcacgagggtcctgggcccagtctggcctgacacagcctgccctccgtgtctgacgtactccgtggacagtccgatccaccattcctcctgccactcggaaacctgctaggtcggtacggttcggtgtacttattaattatcgttccttccgttcggttacccaacgtacgtactacgtttccgagggccgtaccggaccccgtaacccccggtaaaacttttccttttaaacgtttaggtacggttacggttttcccgttttccgggtacccggtccccgttacggttacgggggttttcttaaccggttccgttccgtttcccgtcccggtactttaacccgtacggttccgtacggaccctaaccggtacccggtccccttacccgtacgacccttacgtcccttacgtaaccgtacccgtccggtacgggtcgtacggggtaacgggaccggtacggtacgttacgttaacgtttacgttaacttcgaccgtacgttaccgtaacttacgttaacgttacgtaacggttaacgttaaccgtaaaggtttccggttaaaccttccggtaacggtttaccggttcgtttaccgggggtttaccggggacggggtttaacccggggtaaacgttaccggggtttaccggaccccggtttaacggttaccgggtacccgaaccgggtacccccgtagggttacccccgg

SEQ ID NO: 84420 - DNA, 713 bp, Homo sapiens
  misc_feature: GYAE6OF02FQ2AE.36.23.C01.1.454.CMB.1.raw
  modified_base (146)..(146): a, c, t, g, unknown or other
  misc_feature (146)..(146): n is a, c, g, or t
tcagtacgctgtctcacgaccggtgctcgattagtacacgtgattagggagttgggggggggtctcaggaggcagcgctctcaggacatctccaccatcggcctgggctctgctgcctcctccaccctcctcactcgagggcacgngggtccgtcgggcccaggttcgtcggcctagacacacggcctcgcctccgtgtcgtagacgtacctccgtaggacctacggtcgactacctaacctcgttcctaccgtcgacctacgtacggaacctacggctaggtcggtcggttcggtcgttacttaacttaagttacgtcgttccttaccgttacggttaaccaacgtagtcctacgtcgaggacctacgaccccgtacccctaacttctttaattacgtggtaccgtttctttccggtccgtccgttaggttacggttctacgtccgtaccgtttccgccgtactacggtacgttcgacgaccaaccgtcccgtccttacccataccgtctaccgtcgtacgaccgtcgtaggccgtaggaccggtcggacggtattacggtactttacgtacggcgtacgtacgtctacgtacttacgtagacgtagtacgtacttacgtacctcgttacgtcgtacgttacgggtcgggaaccgtaccgggtaattaccggtcggtaaccgttcgtacggccaccggtacgtaccggtccc

SEQ ID NO: 84421 - DNA, 760 bp, Homo sapiens
  misc_feature: GYAE6OF02GB7AD.36.23.C01.1.454.CMB.1.raw
  modified_base (169)..(169): a, c, t, g, unknown or other
  misc_feature (169)..(169): n is a, c, g, or t
  modified_base (234)..(234): a, c, t, g, unknown or other
  misc_feature (234)..(234): n is a, c, g, or t
  modified_base (252)..(252): a, c, t, g, unknown or other
  misc_feature (252)..(252): n is a, c, g, or t
tcagtacgctgtctcacgaccggtgctcgattagtacacgtgattagggattgggggggggtctcaggaggcaccgctctcaggacatctccaccatggcctgggctctgctgctcctcaccctcctcactcagggcacagggtcctgggcccagtctggcctgacacngcctgcctcgtgtctgagactccgtggacagtcgatcacctatcctcctgactactacggaaccngcagtcggtacgttggtnctttataatttatcgttctccgttcggttaccaacgagtctattcgaggacgtaccggccggacccccgtaaacttactttaatttagtacggtacggtttccgtttccggtccggtccccgttcggttacggggtttcgtacggttccgtccgttccgtacccggtcccttaccgtaacggttccgtacggtaccgtaaccgacccggtcccttacccgttcgaaccctacgttccgttaccgtaccgtacctaccgtagggtacgttacgggacgggtaacggacgggtaccgttaagttaccgttaagtttacgttcgtacgtcgttaccttaacgttacttaaccggttactacggtaacgttaactaagggttacgttacccgtaccgtacggtttaccggtcgtttcggggttaccggggacgggtaacccggtaacgttacgggttaccgtaccgttaccggacggttaccgaccgtacccggtacgtcccgtacccccgg

SEQ ID NO: 84422 - DNA, 769 bp, Homo sapiens
  misc_feature: GYAE6OF02JQBLX.36.23.C01.1.454.CMB.1.raw
  modified_base (155)..(155): a, c, t, g, unknown or other
  misc_feature (155)..(155): n is a, c, g, or t
  modified_base (201)..(201): a, c, t, g, unknown or other
  misc_feature (201)..(201): n is a, c, g, or t
  modified_base (225)..(225): a, c, t, g, unknown or other
  misc_feature (225)..(225): n is a, c, g, or t
  modified_base (237)..(237): a, c, t, g, unknown or other
  misc_feature (237)..(237): n is a, c, g, or t
  modified_base (251)..(251): a, c, t, g, unknown or other
  misc_feature (251)..(251): n is a, c, g, or t
tcagtacgctgtctcacgaccggtgctcgatttagtacacgtgattaggggagttgggggggggtctcaggaggcagcgctctcaggacactctccaccagtcggtcctcgggcctctgcttgcctcctcaccctcctacacctcagggcaacgngggtcctcgggcccagtcttcgccctgacctcacgcctgcgtcgtntcgtggtctcctgacctggtcacncgccatctccgnctacgtcggaaccncgctaggtcgtacggtttcggtaacgtaacgaactcgatccgtctccgttggaacccaacgtctaacccgaggacctaaacccgaaccccgtaataccacttaacttaccgtttcgggaacttccgggacggttaaccgccccgttaagtacgttaatttaccgtaacgtcgtcttcgtacggtcgtcttaaccgtagtccgttccgaaccgtacgacccgtcctccttaccggactttcgtacgtccgtcggacccgttaaccgtcgtacggacggttacgtaccggtaggttccaacggttactttaacttccggttaccttacccgctaaccgttacttaacgttaaccgtaccggtaccggtttaccggtttccgggtttacgggttccgggtacggtacccggtacccgtaccggtacgttaccgtacccgggtcgtaaccggtcggtcccgtaaccggttggtaccccgttccggttaccctccggttacgtacccgttccccgttaccccg

SEQ ID NO: 84423 - DNA, 431 bp, Homo sapiens
  misc_feature: GYAE6OF01A8UNP.47.46.E02.1.454.CMB.1.raw
  modified_base (426)..(431): a, c, t, g, unknown or other
  misc_feature (426)..(431): n is a, c, g, or t
tcagagctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctagcgcacttctttgacttctggggccagggaatcctggtcaccgtctccacagcctccaccaagggcccatcggtcttcccctggccgccctgctccaggacgccacctccgagagcacagcggccctgggctgcctggtcaaggctacttcctatgtatactctgagcgggctggcaaggcgcatagnnnnnn

SEQ ID NO: 84424 - DNA, 609 bp, Homo sapiens
  misc_feature: GYAE6OF01ARNX2.47.46.E02.1.454.CMB.1.raw
  modified_base (174)..(174): a, c, t, g, unknown or other
  misc_feature (174)..(174): n is a, c, g, or t
  modified_base (210)..(210): a, c, t, g, unknown or other
  misc_feature (210)..(210): n is a, c, g, or t
  modified_base (256)..(256): a, c, t, g, unknown or other
  misc_feature (256)..(256): n is a, c, g, or t
  modified_base (293)..(293): a, c, t, g, unknown or other
  misc_feature (293)..(293): n is a, c, g, or t
tcagagctcacgtacacgaccggtgctcgatttagactcatctacagggaaaggggtctgagagaggagcccagccctgggattttcaggtgtttcattggtgatcaggactgaaccgagagaactcaccatggagtttgggctgagcgtgcgtcttagtgtgcttttaaaggngtccagtgtgaggtgcaactgttggagtctgggganacttagtacaccctgggggtccctgagactctcctgtgcaggcctntggactcacctttagcaactctgtcatggctggtccncaggctcgggagctggatgggtctcaagtattgatgagtaatggtgaagcacattcaacgtggactcgtgaaggccgtttcaccgtagtcctaccgagtacgtacgaagtttcgaggtacgtcaacggtctaggtacgtcgtaacgaaagtcgtaacctagtacctggtaacgtacgtaccgtaggaccgtacgggccctagtactttcgagttcgacgtaaacgtcgtaacgtacggactaacggttcgtaccccccgttaggacccggtaccgtaacgtttaccgtttcggtaacccgtttcgttacccggggg

SEQ ID NO: 84425 - DNA, 406 bp, Homo sapiens
  misc_feature: GYAE6OF01D7RU3.47.46.E02.1.454.CMB.1.raw
  modified_base (401)..(406): a, c, t, g, unknown or other
  misc_feature (401)..(406): n is a, c, g, or t
tcagagctcacgtacacgaccggtgctcgatttagactcatctacaggggaaagggccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgctcaccttcggccaagggacacgactggagattaaacgaactgtggctgcaccatctgtcttcatcttccgccatctgatacgtgagctctgagcgggctggcaaggcgcatagnnnnnn

SEQ ID NO: 84426 - DNA, 432 bp, Homo sapiens
  misc_feature: GYAE6OF01CURFA.47.46.E02.1.454.CMB.1.raw
  modified_base (426)..(432): a, c, t, g, unknown or other
  misc_feature (426)..(432): n is a, c, g, or t
tcagagctcacgtacacgaccggtgctcgatttagactcatctacagggaaaggggctggagtgggtctcaagtattgatgagaatggtggaagcacattctacgtgtactccgtgaagggccggttcaccatctccagagacaatttcaggagcacgctgtatctacaaatgaacagcctgagagccgaggacacggccgtatatttctgtgcgaaagtctatagcagtgccccctagcgcacttctttgacttctggggccagggaatcctggtcaccgtctccacagcctccaccaaggcccatcggtcttcccctggccgcccctgctccaggacgcacctccgagacgcacagcggccctgggctgcctggtcaaggactacttcctacgtgagctctgagcgggctggcaaggcgcatgnnnnnnn

SEQ ID NO: 84427 - DNA, 506 bp, Homo sapiens
  misc_feature: GYAE6OF01CZHX8.47.46.E02.1.454.CMB.1.raw
  modified_base (202)..(202): a, c, t, g, unknown or other
  misc_feature (202)..(202): n is a, c, g, or t
  modified_base (440)..(440): a, c, t, g, unknown or other
  misc_feature (440)..(440): n is a, c, g, or t
  modified_base (500)..(500): a, c, t, g, unknown or other
  misc_feature (500)..(500): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaanagccaccatctcctgtagggccgtcagagtattagcatcaacttagcctggtaccagcagagacctgggcaggctcccaggctcctcatctatgatgcgtccacagggccactggttcccagccaggttcagtggcagtgcgtctgggacagtagttcacttctacaccatcaacagcctgcagtctagaagtattttgctagtttattactgtcagtcagtatacataactggaccntcaccttcggaccaacgggacacgacgtggataattaaacgaacgtgtaggctagacacntcgtcg

SEQ ID NO: 84428 - DNA, 501 bp, Homo sapiens
  misc_feature: GYAE6OF01BKE4U.47.46.E02.1.454.CMB.1.raw
  modified_base (202)..(202): a, c, t, g, unknown or other
  misc_feature (202)..(202): n is a, c, g, or t
  modified_base (228)..(228): a, c, t, g, unknown or other
  misc_feature (228)..(228): n is a, c, g, or t
  modified_base (496)..(496): a, c, t, g, unknown or other
  misc_feature (496)..(496): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaanagccaccatctcctgtagggccggtnagagtattagcatcaacttagcctggtaccagcagagacctgggcaggctcccaggctcctcatctatgatgcgtccaccagggccactggttcccagccaggttcagtgcagtgcgtctgggacagagttcactctcaccatcaacagcctgcagtctgaagtatttgctagtttattactgtcagctagtatacataactggcctctccaccttcggccgaagggaccacgacgtggaagataaacgaacgtgtaggtctgacacntctcg

SEQ ID NO: 84429 - DNA, 537 bp, Homo sapiens
  misc_feature: GYAE6OF01C0G10.47.46.E02.1.454.CMB.1.raw
  modified_base (202)..(202): a, c, t, g, unknown or other
  misc_feature (202)..(202): n is a, c, g, or t
  modified_base (308)..(308): a, c, t, g, unknown or other
  misc_feature (308)..(308): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaangccaccctctcctgcagggccagtcagagtgttggcagctacttagcctggtaccaacagaaacctggccaggctcccaggctcctcatctatgatgcatccaacngggccactggcatccccagccaggttcagtggcagtgagtctgggacagacttcactctcaccatcagcacgcctagacgtccgtagaacgttattttacgcttagttttacttactgtacagtactaaacgttaactacgtcggccttccgtacttcgtacgtttcggacgggtacggtaccgagggtacgacagtacgaaacgtagtggtcggactgcacgtgtccg

SEQ ID NO: 84430 - DNA, 523 bp, Homo sapiens
  misc_feature: GYAE6OF01CQSQT.47.46.E02.1.454.CMB.1.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctccagagaccactggagaaatagtgatgacgcagtctccagccacctgtctgtctctcgaggggaaangccacatctctgtagggccgtnagagtatagcatcaacttgcctggtaccagcagagacctgggcaggctccaggctctcatctatgatgcatccaacagggccactggcatcccaagacaggttcaggtggcaggtgggtctgggacaggacttcactctcaccatcagcagcctagacgcctagaagtactttaggtacttttattactgtcagctagcgtgtagttctcggtcctccgtctccgtacgtttcggcgggtacgggaccgtaggggtggaggagtaccgaaacgtacgtacggtggacgtcgccgacgtacg

SEQ ID NO: 84431 - DNA, 510 bp, Homo sapiens
  misc_feature: GYAE6OF01DH7O9.47.46.E02.1.454.CMB.1.raw
  modified_base (152)..(152): a, c, t, g, unknown or other
  misc_feature (152)..(152): n is a, c, g, or t
  modified_base (154)..(154): a, c, t, g, unknown or other
  misc_feature (154)..(154): n is a, c, g, or t
  modified_base (162)..(162): a, c, t, g, unknown or other
  misc_feature (162)..(162): n is a, c, g, or t
  modified_base (164)..(164): a, c, t, g, unknown or other
  misc_feature (164)..(164): n is a, c, g, or t
  modified_base (171)..(171): a, c, t, g, unknown or other
  misc_feature (171)..(171): n is a, c, g, or t
  modified_base (173)..(173): a, c, t, g, unknown or other
  misc_feature (173)..(173): n is a, c, g, or t
  modified_base (175)..(177): a, c, t, g, unknown or other
  misc_feature (175)..(177): n is a, c, g, or t
  modified_base (179)..(179): a, c, t, g, unknown or other
  misc_feature (179)..(179): n is a, c, g, or t
  modified_base (186)..(188): a, c, t, g, unknown or other
  misc_feature (186)..(188): n is a, c, g, or t
  modified_base (191)..(192): a, c, t, g, unknown or other
  misc_feature (191)..(192): n is a, c, g, or t
  modified_base (195)..(195): a, c, t, g, unknown or other
  misc_feature (195)..(195): n is a, c, g, or t
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (204)..(206): a, c, t, g, unknown or other
  misc_feature (204)..(206): n is a, c, g, or t
  modified_base (208)..(210): a, c, t, g, unknown or other
  misc_feature (208)..(210): n is a, c, g, or t
  modified_base (213)..(213): a, c, t, g, unknown or other
  misc_feature (213)..(213): n is a, c, g, or t
  modified_base (216)..(216): a, c, t, g, unknown or other
  misc_feature (216)..(216): n is a, c, g, or t
  modified_base (232)..(232): a, c, t, g, unknown or other
  misc_feature (232)..(232): n is a, c, g, or t
  modified_base (251)..(251): a, c, t, g, unknown or other
  misc_feature (251)..(251): n is a, c, g, or t
  modified_base (262)..(262): a, c, t, g, unknown or other
  misc_feature (262)..(262): n is a, c, g, or t
  modified_base (264)..(264): a, c, t, g, unknown or other
  misc_feature (264)..(264): n is a, c, g, or t
  modified_base (266)..(266): a, c, t, g, unknown or other
  misc_feature (266)..(266): n is a, c, g, or t
tcagagctcacgtacacgaccggtgctcgatttagactcatctacagggaaaggggtctgagagaggagcccagccctgggattttcaggtgttttcattggtgatcaggactgaaccgagagaactcaccatggagtttgggctgagcggngngctagtgngntttaagncngnnngncatgtgnnnggnntgncngggcnannncnnncanctntgatcacttgcaatcngtcatggctggcgccagcnccggaaggggngngngtggtcgtcagtatgatagagagtggtagagacgactagtctacgtacgacgtcgtaggacggtaccggtacgacctactactacacgacgactaacgttacgtagacgacgacgtacgtacgtatactaacaaagtagaactacgtatagagacgacgacggacgacgacgtactacttacgtgtgacgagtatagtagagacgtccgacccgtaccgcgtctacttcttcgtcgttcgtcgg

SEQ ID NO: 84432 - DNA, 510 bp, Homo sapiens
  misc_feature: GYAE6OF01CVBE5.47.46.E02.1.454.CMB.1.raw
  modified_base (202)..(202): a, c, t, g, unknown or other
  misc_feature (202)..(202): n is a, c, g, or t
  modified_base (375)..(375): a, c, t, g, unknown or other
  misc_feature (375)..(375): n is a, c, g, or t
  modified_base (393)..(393): a, c, t, g, unknown or other
  misc_feature (393)..(393): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaangccaccatctcctgtagggccggtcagagtattagcatcaacttgcctggtaccagcagagacctgggcaggctcccaggcctcctcatctatgatgcgtccacagggccactggttcccagccaggttcagtggcagtgcgtctgggacagagttcactctcaccatcaacngcctgcagtctagaagtntttgctagtttattactgtcagtcagtatcaataacgtgcctctccaccttcggaccaagggaccacgacgtggaagaacgttaaacgaactggacggtctacgacaacctgtctcg

SEQ ID NO: 84433 - DNA, 498 bp, Homo sapiens
  misc_feature: GYAE6OF01CZPLF.47.46.E02.1.454.CMB.1.raw
  modified_base (203)..(203): a, c, t, g, unknown or other
  misc_feature (203)..(203): n is a, c, g, or t
  modified_base (493)..(493): a, c, t, g, unknown or other
  misc_feature (493)..(493): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagacccactggagaaatagtgatgacgcagtctccagccaccctgtctgtctctccaggggaaangccaccatctcctgtagggccggtcagagtattagcatcaacttgcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgctagtttattactgtcagctagtatcattaactggccgctcaccttcggccaagggaccacgacgtggagaattaaacgactgtcggctgcaccntctcg

SEQ ID NO: 84434 - DNA, 536 bp, Homo sapiens
  misc_feature: GYAE6OF01DCVHI.47.46.E02.1.454.CMB.1.raw
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcgtggcgtctttacgttgtggctttttaaaaggtgtccagtgtgaggtgcaactgttggagtctgggggagacttagtacaccctggggggtccctgagactctcctgtgcagcctctggactcacctttagcaactctgtcatgggatgggtccgccaggcgtccggggaagggctggagtgggtctcaagtattgatgaagaatggtagaagcacattctacgtgactcgtgagggtccgtcacatctcagagactaattcaggagcacgctgtatctaacaaatgaacagcctagagagccgaggacgacggccgtatatttctgtgacgaaagtctagtagcacgtcgcccctacgccgtctacttctttgcgttcgtcgggg

SEQ ID NO: 84435 - DNA, 405 bp, Homo sapiens
  misc_feature: GYAE6OF01EP0CH.47.46.E02.1.454.CMB.1.raw
  modified_base (386)..(386): a, c, t, g, unknown or other
  misc_feature (386)..(386): n is a, c, g, or t
  modified_base (395)..(395): a, c, t, g, unknown or other
  misc_feature (395)..(395): n is a, c, g, or t
  modified_base (400)..(405): a, c, t, g, unknown or other
  misc_feature (400)..(405): n is a, c, g, or t
tcagagctcacgtacacgaccggtgctcgatttagactcatctacaggggaaagggccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgctagtttattactgtcagcagtatcataactggccgctcaccttcggccaagggacacgactggagattaaacgactgtggctgcaccatctgtcttcactcttcccgcatctgatacgtgagctctgagcgggntggcaggcncatgnnnnnn

SEQ ID NO: 84436 - DNA, 411 bp, Homo sapiens
  misc_feature: GYAE6OF01DNWU5.47.46.E02.1.454.CMB.1.raw
  modified_base (406)..(411): a, c, t, g, unknown or other
  misc_feature (406)..(411): n is a, c, g, or t
tcagagctcacgtacacgaccggtgctcgatttagactcatctacaggggaaagggccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgctcaccttcggaccaagggacacgactggagaattaaacgaactgtgctgcaccatctgtcttcatccttcccgctatctgatacgtgagctctgacgcgggctggcaaggcgacatagnnnnnn

SEQ ID NO: 84437 - DNA, 513 bp, Homo sapiens
  misc_feature: GYAE6OF01B03A8.47.46.E02.1.454.CMB.1.raw
  modified_base (203)..(203): a, c, t, g, unknown or other
  misc_feature (203)..(203): n is a, c, g, or t
  modified_base (228)..(228): a, c, t, g, unknown or other
  misc_feature (228)..(228): n is a, c, g, or t
  modified_base (310)..(310): a, c, t, g, unknown or other
  misc_feature (310)..(310): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagcccaccctgtctgtctctccaggggaaangccaccatctcctggtagggccgtnagagtatagcatcaacttgcctggtaccagcagagacctgggcaggctcccgaggcctcctcatctatgatgcatccaacgngggccacgtggcactcccagcctaggttcagtggcagtgagtctgggacagtaccttcactctcaccatcagcacgcctagacgcctagaacgtattttcgacttacttttattactgtcagcagcgtagctaacgtcggcctctcgtcgttcgggcgggacggaccgagggtggagatcgacgtacgtacgtggcgcgtgac

SEQ ID NO: 84438 - DNA, 497 bp, Homo sapiens
  misc_feature: GYAE6OF01BIRG0.47.46.E02.1.454.CMB.1.raw
  modified_base (202)..(202): a, c, t, g, unknown or other
  misc_feature (202)..(202): n is a, c, g, or t
  modified_base (464)..(464): a, c, t, g, unknown or other
  misc_feature (464)..(464): n is a, c, g, or t
  modified_base (492)..(492): a, c, t, g, unknown or other
  misc_feature (492)..(492): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagtcaccctgtctgtctctccaggggaaanagccaccatctcctgtagggccgtcagagtattagcatcaacttagcctggtaccagcagagacctgggcaggctcccaggctcctcatctatgatgcgtccaccagggccactggttcccagccaggttcagtgcagtgcgtctgggacagagttcactctcaccatcaacagcctgcagtctagaagtatttgctagtttattactgtcagctagtatcataactgcctctcaccttcggccaagggacacgacgtgganattaaacgactggtacgtctagacactntctcg

SEQ ID NO: 84439 - DNA, 509 bp, Homo sapiens
  misc_feature: GYAE6OF01EH61S.47.46.E02.1.454.CMB.1.raw
  modified_base (203)..(203): a, c, t, g, unknown or other
  misc_feature (203)..(203): n is a, c, g, or t
  modified_base (226)..(226): a, c, t, g, unknown or other
  misc_feature (226)..(226): n is a, c, g, or t
  modified_base (502)..(502): a, c, t, g, unknown or other
  misc_feature (502)..(502): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccgaggggaaangccacatctcctgtagggccgtnagagtattagcatcaacttagcctggtaccagcagagacctgggcaggctcccaggctcctcatctatgatgcgtccaccagggccacgtggtttcccagccaggtcagtggcaggtgcgtcgtgggacaggtagtcactctcaccatacaacacgcctagacgcctgaagactttggacttttattactgtcagcagcgtgagttctggcctccgctctacgttccggcggacgggccaggggtcggagacgtagaaacgacgtggtgctgcacntctgttc

SEQ ID NO: 84440 - DNA, 409 bp, Homo sapiens
  misc_feature: GYAE6OF01AEZUW.47.46.E02.1.454.CMB.1.raw
  modified_base (400)..(409): a, c, t, g, unknown or other
  misc_feature (400)..(409): n is a, c, g, or t
tcagagctcacgtacacgaccggtgctcgatttagactcatctacaggggaaagggccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgctcaccttcggccaagggacacgactggagattaaacgactgtggctgcaccatctgtcttcatcttcccgcatctgatacgtgagctctgagcgggctggcaaggcgcatagnnnnnnnnnn

SEQ ID NO: 84441 - DNA, 527 bp, Homo sapiens
  misc_feature: GYAE6OF01ABZ90.47.46.E02.1.454.CMB.1.raw
  modified_base (152)..(152): a, c, t, g, unknown or other
  misc_feature (152)..(152): n is a, c, g, or t
  modified_base (154)..(154): a, c, t, g, unknown or other
  misc_feature (154)..(154): n is a, c, g, or t
  modified_base (176)..(176): a, c, t, g, unknown or other
  misc_feature (176)..(176): n is a, c, g, or t
  modified_base (206)..(206): a, c, t, g, unknown or other
  misc_feature (206)..(206): n is a, c, g, or t
  modified_base (251)..(251): a, c, t, g, unknown or other
  misc_feature (251)..(251): n is a, c, g, or t
  modified_base (288)..(288): a, c, t, g, unknown or other
  misc_feature (288)..(288): n is a, c, g, or t
  modified_base (317)..(317): a, c, t, g, unknown or other
  misc_feature (317)..(317): n is a, c, g, or t
  modified_base (323)..(323): a, c, t, g, unknown or other
  misc_feature (323)..(323): n is a, c, g, or t
  modified_base (345)..(345): a, c, t, g, unknown or other
  misc_feature (345)..(345): n is a, c, g, or t
  modified_base (360)..(360): a, c, t, g, unknown or other
  misc_feature (360)..(360): n is a, c, g, or t
  modified_base (375)..(375): a, c, t, g, unknown or other
  misc_feature (375)..(375): n is a, c, g, or t
  modified_base (379)..(379): a, c, t, g, unknown or other
  misc_feature (379)..(379): n is a, c, g, or t
  modified_base (390)..(390): a, c, t, g, unknown or other
  misc_feature (390)..(390): n is a, c, g, or t
  modified_base (395)..(395): a, c, t, g, unknown or other
  misc_feature (395)..(395): n is a, c, g, or t
  modified_base (397)..(397): a, c, t, g, unknown or other
  misc_feature (397)..(397): n is a, c, g, or t
  modified_base (409)..(409): a, c, t, g, unknown or other
  misc_feature (409)..(409): n is a, c, g, or t
  modified_base (413)..(413): a, c, t, g, unknown or other
  misc_feature (413)..(413): n is a, c, g, or t
  modified_base (416)..(416): a, c, t, g, unknown or other
  misc_feature (416)..(416): n is a, c, g, or t
  modified_base (445)..(445): a, c, t, g, unknown or other
  misc_feature (445)..(445): n is a, c, g, or t
tcagagctcacgtacacgaccggtgctcgatttagactcatctacagggaaagggtctgagagaggagcccagccctgggattttcaggtgttttcatttggtgatcaggactgaaccgagagaactcaccatggagtttgggctgagcggngngcttagtgtgacttttaaaggntcagtgtgagtgcaatgtgagtcagggganacttagtacaccctgggggtccctgagactctcctgtgcagcctntaggactcacctttagcaactctgcatggctggtccnccaggctccggggaggctggagtgggtcncaagtntgatgagaagtggtgaagcaangttccagtgactcgngaaggcgtcacatcncagnacattcagagnacgtntntatactacaatnaacngcngacgcgacgagacacgactagtacttcgngtcgacgtaaactcgtagtacgactacggtcccgtaccccgtacgaccgtacctacctttcgttacgtaccgttcggtcggg

SEQ ID NO: 84442 - DNA, 540 bp, Homo sapiens
  misc_feature: GYAE6OF01CRICQ.47.46.E02.1.454.CMB.1.raw
  modified_base (203)..(203): a, c, t, g, unknown or other
  misc_feature (203)..(203): n is a, c, g, or t
  modified_base (228)..(228): a, c, t, g, unknown or other
  misc_feature (228)..(228): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccgaggggaaangccaccatctcctgtacgggccgtnagagtattagcatcaaacttgcctaggtaccagcagagacctgggcaggctccaggctctcatctatgatgccgtccaccagggcctacgtcggttccagccaggttcagtgctaggtcgcgtctggggacaggtacgttcactctacaccatacaacagcctgctagtctagaagttattttgactagtttatacttgtcagtctagtatactataacgtggacctctaccgtaccgttcggaccaacggaccacgtacgtacggtaagaacttaaacgaacgtgtacggtacgtacgacactgttcttcg

SEQ ID NO: 84443 - DNA, 488 bp, Homo sapiens
  misc_feature: GYAE6OF01AUWJO.47.46.E02.1.454.CMB.1.raw
  modified_base (202)..(202): a, c, t, g, unknown or other
  misc_feature (202)..(202): n is a, c, g, or t
  modified_base (366)..(366): a, c, t, g, unknown or other
  misc_feature (366)..(366): n is a, c, g, or t
  modified_base (435)..(435): a, c, t, g, unknown or other
  misc_feature (435)..(435): n is a, c, g, or t
  modified_base (475)..(475): a, c, t, g, unknown or other
  misc_feature (475)..(475): n is a, c, g, or t
  modified_base (483)..(483): a, c, t, g, unknown or other
  misc_feature (483)..(483): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaangccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactcncaccatcaacagcctgcagtctgaagtatttgctagtttattactgtcagctagtatcataactggccnctcaccttcggccagggacacgactggagattaacgatgngctgcacntctcg

SEQ ID NO: 84444 - DNA, 548 bp, Homo sapiens
  misc_feature: GYAE6OF01BQI05.47.46.E02.1.454.CMB.1.raw
  modified_base (201)..(201): a, c, t, g, unknown or other
  misc_feature (201)..(201): n is a, c, g, or t
  modified_base (225)..(225): a, c, t, g, unknown or other
  misc_feature (225)..(225): n is a, c, g, or t
tcagagctcacgtacacgaccggtgctcgatttagactcatctacagggaaaggggaggaactgctcagttaggacccagacggaaccatggaagccccagcgcagcttctcttcctcctgctactctggctcccagagaccactggagaaatagtgatgacgcagtctccagccaccctgtctgtctctccaggggaaangccaccatctcctgtagggccgtnagagtattagcatcaaacttagcctggtaccagcagagacctgggcaggctccaggctctcatctatgatgcgtcacagggccactggttcccagccaggttcagtggcagtgcgtctgggacagtagttcactctcaccatcaacagcctgcagtctagaacgtattttgactagtttattactgtcagtcagtatacataactggacccgtctccaccttcggaccaaagggtaccaacggtaacgttgggaacgtaacgtttaaaacccggaacgttacggtacgggtacttacggacctaacccgtagttccgttacgg

SEQ ID NO: 84445 - DNA, 644 bp, Homo sapiens
  misc_feature: GYAE6OF01BKWN6.47.46.E02.1.454.CMB.1.raw
  modified_base (224)..(224): a, c, t, g, unknown or other
  misc_feature (224)..(224): n is a, c, g, or t
tcagagctcacgtacacgaccggtgctcgatttagactcatctacagggaaagggggctctgagagaggagcccagccctgggattttcaggtgttttcatttggtgatcaggactgaaccgagagaactcaccatggagtttgggctgagcgtggctctttcgttgtggtacttttttaaaaggtgtccagtgtgaggtgcaactgttggagtcgtggggganacttagtacacccgtgggggtccctgagactctcctgtgcagcctctggactctacctttagcaactctgtcagtggctgggtccgccgaggcgtccggggaagggcgtgggagtgggtcacgtaagtattgatgaagaagttggacggaagcaatagttacgtacggtggaccgttccggtaggaacgggtcccggttacaccgtacgtcctcccgaagacgtaactaagtttccgaagggacactaaccgtctagtaatacgtaaacaaatagaaactgaccctagaacgacggccgaaggtaaccgacggtccgttaatacgtttcgaggtacgaacgtaaagttcgtaagttacggacctacggtcccgacccccgtacgccgtacccttacttttccgttcgacgtttcccgggg

SEQ ID NO: 84446 - DNA, 544 bp, Homo sapiens
  misc_feature: GYAE6OF01C2TOW.47.46.E02.1.454.CMB.1.raw
  modified_base (203)..(203): a, c, t, g, unknown or other
  misc_feature (203)..(203): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccgaggggaaangccaccatctcctgtagggccggtcagagtattagcatcaacttagcctggtaccagcagagacctgggcaggctccaggctcctcatctatgatgcgtcaccgagggccactggttcccagcaggttcagtgcagtgcgtcgtagggacagagttcacgtctcaccatcaacagcctgcagtctagaagtatttgctagtttattactgtcagtcagtatactataacgtcggccgtctacccgtacgttccggaccgtaaagggaccacggtaacgtgggtaagtaacgtttaaaacggaacgttggtacggtacgttacgacctacctagttcgttcg

SEQ ID NO: 84447 - DNA, 596 bp, Homo sapiens
  misc_feature: GYAE6OF01C1RLU.47.46.E02.1.454.CMB.1.raw
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggtcttttttaaaaggtgtccagtgtgaggtgcaactgttggagtcgtgggggagacttagtacacccgtggggggtccctgagactctcctgtgcagcctctggactcacctttagcaactctgtcatgggctcgggccgcgaggcgtccgggggaaggggtcgtgggagtggggtctcgacggctagttgggtggtagtgggtcgccgaggacactacttacgtaaacgtcccctgcgaaggggccctagttcctttaatcctacagacgactaattccgaaggaaccatactgaattctgctagttcacagactgagagtcgagacgaggtactatattattgtagttaaagtgggaatggtgtcgtacgacggtcggtttacggggacccggggttaaccctgggtacctaccggtctcgtcgtaccg

SEQ ID NO: 84448 - DNA, 413 bp, Homo sapiens
  misc_feature: GYAE6OF01DFPC5.47.46.E02.1.454.CMB.1.raw
  modified_base (246)..(246): a, c, t, g, unknown or other
  misc_feature (246)..(246): n is a, c, g, or t
  modified_base (317)..(317): a, c, t, g, unknown or other
  misc_feature (317)..(317): n is a, c, g, or t
  modified_base (401)..(413): a, c, t, g, unknown or other
  misc_feature (401)..(413): n is a, c, g, or t
tcagagctcacgtacacgaccggtgctcgatttagactcatctacaggggaaagggccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagnttttgctagtttattactgtcagcagtatcataactggccgctcaccttcggccaagggacacgactgganaattaaacgaactgtggctgcaccatctgtctcatctccgcatctgatacgtgagctctgacgcgggctggcaaggcgcatagnnnnnnnnnnnnn

SEQ ID NO: 84449 - DNA, 654 bp, Homo sapiens
  misc_feature: GYAE6OF01A7UY2.47.46.E02.1.454.CMB.1.raw
  modified_base (154)..(154): a, c, t, g, unknown or other
  misc_feature (154)..(154): n is a, c, g, or t
  modified_base (177)..(177): a, c, t, g, unknown or other
  misc_feature (177)..(177): n is a, c, g, or t
  modified_base (212)..(212): a, c, t, g, unknown or other
  misc_feature (212)..(212): n is a, c, g, or t
  modified_base (258)..(258): a, c, t, g, unknown or other
  misc_feature (258)..(258): n is a, c, g, or t
  modified_base (300)..(300): a, c, t, g, unknown or other
  misc_feature (300)..(300): n is a, c, g, or t
  modified_base (462)..(462): a, c, t, g, unknown or other
  misc_feature (462)..(462): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcgtgngtcttagtgtgtattttaaaggngtcagtgtgaggtgcaatgttggagtcgtgggganacttagtacacccgtgggggtccctgagctctcctgtcgcagcctntggactctacctttagctaactcgtgtcagtcggctgggccncgaggtccgtaccgggggaaggcgtgggagtgggtcctggaggctagttgggtgtaggtggcgccgaggacactagttaacgtaagtcccgagcgacgggacctatttctttacgctaccaaggtacgtactaacgttccgaaggtaaacctagtaacgttntacttcgacgtacgtacggtcgaacgtagtacgtaggacggtaggtacggaacggtaccggtaacgttacgttaatttacgtttaggttagttaaggttaaggtgggtacgtcgggtacgtacgttaggtcggttccggggtaccgggaaccccggttacgttcggtaccctacggttcttccgtacgtccg

SEQ ID NO: 84450 - DNA, 565 bp, Homo sapiens
  misc_feature: GYAE6OF01EAM5R.47.46.E02.1.454.CMB.1.raw
  modified_base (153)..(153): a, c, t, g, unknown or other
  misc_feature (153)..(153): n is a, c, g, or t
  modified_base (176)..(176): a, c, t, g, unknown or other
  misc_feature (176)..(176): n is a, c, g, or t
  modified_base (212)..(212): a, c, t, g, unknown or other
  misc_feature (212)..(212): n is a, c, g, or t
  modified_base (297)..(297): a, c, t, g, unknown or other
  misc_feature (297)..(297): n is a, c, g, or t
  modified_base (336)..(336): a, c, t, g, unknown or other
  misc_feature (336)..(336): n is a, c, g, or t
  modified_base (355)..(355): a, c, t, g, unknown or other
  misc_feature (355)..(355): n is a, c, g, or t
  modified_base (371)..(371): a, c, t, g, unknown or other
  misc_feature (371)..(371): n is a, c, g, or t
  modified_base (385)..(385): a, c, t, g, unknown or other
  misc_feature (385)..(385): n is a, c, g, or t
  modified_base (388)..(388): a, c, t, g, unknown or other
  misc_feature (388)..(388): n is a, c, g, or t
  modified_base (394)..(394): a, c, t, g, unknown or other
  misc_feature (394)..(394): n is a, c, g, or t
  modified_base (412)..(412): a, c, t, g, unknown or other
  misc_feature (412)..(412): n is a, c, g, or t
  modified_base (424)..(424): a, c, t, g, unknown or other
  misc_feature (424)..(424): n is a, c, g, or t
  modified_base (434)..(434): a, c, t, g, unknown or other
  misc_feature (434)..(434): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcggngtgcttagtgtgattttaaaggngtcagtgtgaggtgcaatgttggagtcgtggggganacttagtacacccgtggggggtccctgagctctcctgtgcagcctcgtggactcacctttagcaactctgtcagtggctggtccnccgaggcgtccggggaagggctggagtggtctcgaagtntgatgagatggcgaagcanattcgagtggactcgngacgggcgttcacntcncagganactattcgagagcacgtntgtactactaanaagtcgaacncgctagacgacgacgaggtaccgacggtacttagttacgttcgagtacgtaacgtaagtctaacgtacgtacgtacggtcccgaccccgtagtcccgtacttaccgtttgttacgtccgttcgggtacggg

SEQ ID NO: 84451 - DNA, 625 bp, Homo sapiens
  misc_feature: GYAE6OF01DG162.47.46.E02.1.454.CMB.1.raw
  modified_base (182)..(182): a, c, t, g, unknown or other
  misc_feature (182)..(182): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcgtgtcgtcttacgtgtgtactttttaaaaggngtcagtgtgaggtgcaactgttggagtcgtgggggagacttagtaccacccgtgggggtccctgagctctcctgtgcagcatctgactctacctttgctaactctgtcagtgggctgggtccgccgagggccgtccgggggaaggggctgggaggtgggtctcgaagttattgatgagaatggagaacgctacattcgtacgtcggactcgtaggaacgggccgttacacctattcctacccgagagtacctaatttacgaggtagcacgctagtatacctaacaatagaacagtccgaggacgacgaccggagaccgacggtaccgttattacgtttcgtaggtacgtcggtaaaacggttctaaagttacgaccgtacggtccccgccccccgttaacgtcccgtacttaacccgttttctttcggtaacccgtttccggg

SEQ ID NO: 84452 - DNA, 504 bp, Homo sapiens
  misc_feature: GYAE6OF01DHLGL.47.46.E02.1.454.CMB.1.raw
  modified_base (203)..(203): a, c, t, g, unknown or other
  misc_feature (203)..(203): n is a, c, g, or t
  modified_base (393)..(393): a, c, t, g, unknown or other
  misc_feature (393)..(393): n is a, c, g, or t
  modified_base (498)..(498): a, c, t, g, unknown or other
  misc_feature (498)..(498): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaaangccaccatctcctgtagggccgtcagagtattagcatcaacttgcctggtaccagcagagacctgggcaggctcccaggctcctcatctatgatgcgtccaccagggccactcggttcccagccaggttcagtgcagtgcgtctgggacagagttcactctcaccatcaacagcctgcagtctagaagtntttgctagtttatactgtcagtctagtatcataactgccgtctctaccttcggaccaagggacacgacgtaggaataagttaaacgaactgtagtcctagacacngtctcg

SEQ ID NO: 84453 - DNA, 694 bp, Homo sapiens
  misc_feature: GYAE6OF01CV0HB.47.46.E02.1.454.CMB.1.raw
  modified_base (155)..(155): a, c, t, g, unknown or other
  misc_feature (155)..(155): n is a, c, g, or t
  modified_base (179)..(179): a, c, t, g, unknown or other
  misc_feature (179)..(179): n is a, c, g, or t
  modified_base (181)..(181): a, c, t, g, unknown or other
  misc_feature (181)..(181): n is a, c, g, or t
  modified_base (185)..(185): a, c, t, g, unknown or other
  misc_feature (185)..(185): n is a, c, g, or t
  modified_base (202)..(202): a, c, t, g, unknown or other
  misc_feature (202)..(202): n is a, c, g, or t
tcagagctcacgtacacgaccggtgctcgatttagactcatctacagggaaaggggagctctgagagaggagcccagccctgggattttcaggtgtttcatttggtgatcaggactgaaccgagagaactcaccatggagtttgggctgagcggngtggctaggtcgcgattttaaggncngtgngagtgcatgtgagtcgnggagtacgtagtacgtaccgtcgggtccgtgagacgtctctcgtgcacgcctcgtcgtactactacttacgtactactactcgtcgtacgtcggtcgtcggtccgccgtacggtcggtaccgggacggtcgtggtaggtggtacgtacgtaagtagtagtagtagtagtaagtaggtaggagacgtacgtacgtacgtacgtacggtaccgtaccggtacggtaacgggtaccggtaccgtaccgtactaccgtaccgtacgaacgtaacgtaacgttacgtacggacgacgtaccgtacgtacgtaacgtactaacgtaacgtaacgaacgtacgtacgtaacggaacgacggaccggaacggaaccgtaaccggtaccgttacgttacgttacgttacggtacgtacggtaacgtaacgttaagttacgtaccgtaccgtacccgtaccccgtacccgtacccgtaccgttaccgtttcgttcgttaccg

SEQ ID NO: 84454 - DNA, 622 bp, Homo sapiens
  misc_feature: GYAE6OF01AM6P8.47.46.E02.1.454.CMB.1.raw
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcgtggcgtctttcgttgtggcttttttaaaaagtgtccagtgtgaggtgcagctggtggagtctgggggaggcttagtacagcctggggggtccctgagactctcctgcgcagcctctggattctcctttagtagttatgccatgacttgggtccgccaggctccgaggggaaggggctgggagtgggtctcgaggcagttggtggtagtggtgccgaggacacgattaacgtaaagtccctggcagggccatttcctttatcctaccagacgacaattccaaggtaacatacctgatttcgtgctagttcgaccctagactaggacgaggtacggaggacctacgggtccgtaattacgttatttaggtaggtttaaaagtggggtaactggggttagacgttaaccggacgttcggttacggggggtccccggggtaaccccttgggtcccgtaacccggttcgttacccg

SEQ ID NO: 84455 - DNA, 537 bp, Homo sapiens
  misc_feature: GYAE6OF01DONJL.47.46.E02.1.454.CMB.1.raw
  modified_base (203)..(203): a, c, t, g, unknown or other
  misc_feature (203)..(203): n is a, c, g, or t
  modified_base (290)..(290): a, c, t, g, unknown or other
  misc_feature (290)..(290): n is a, c, g, or t
  modified_base (454)..(454): a, c, t, g, unknown or other
  misc_feature (454)..(454): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagcccaccctgtctgtctctccaggggaaangccaccatctcctgtagggccggtcagagtattagcatcaacttgcctggtaccagcagagacctgggcaggctcccaggcctcctnatctatgatgctccacgagggcctactggttcccagccaggttcagtggcagtgcgtcgtgggacaggagttcactctcaacctataccaacacgcctgcagtctagtaatattttgcttagtttactttacttgtcagtctagtatctaagtaacgtcggccncttcctaccgttccggaccaagggaccacggacgtggaagtaagttaaaaccgacgtggtacggtctacgacactatcgtacg

SEQ ID NO: 84456 - DNA, 412 bp, Homo sapiens
  misc_feature: GYAE6OF01CL6TI.47.46.E02.1.454.CMB.1.raw
  modified_base (395)..(395): a, c, t, g, unknown or other
  misc_feature (395)..(395): n is a, c, g, or t
  modified_base (402)..(412): a, c, t, g, unknown or other
  misc_feature (402)..(412): n is a, c, g, or t
tcagagctcacgtacacgaccggtgctcgatttagactcatctacaggggaaagggccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgagattttgcagtttatactgtcagcagtatcataaatggccgctcaccttcggccaagggcacgactggagattaaacgaactgtggctgcacatctgtcttcatcttcccgccatctgactacgtgacgctctgacgcgggctggcaaggcncagtagnnnnnnnnnnn

SEQ ID NO: 84457 - DNA, 654 bp, Homo sapiens
  misc_feature: GYAE6OF01CNBQ2.47.46.E02.1.454.CMB.1.raw
  modified_base (186)..(186): a, c, t, g, unknown or other
  misc_feature (186)..(186): n is a, c, g, or t
  modified_base (264)..(264): a, c, t, g, unknown or other
  misc_feature (264)..(264): n is a, c, g, or t
  modified_base (308)..(308): a, c, t, g, unknown or other
  misc_feature (308)..(308): n is a, c, g, or t
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
  modified_base (427)..(427): a, c, t, g, unknown or other
  misc_feature (427)..(427): n is a, c, g, or t
tcagagctcacgtacacgaccggtgctcgatttagactcatctacagggaaagggggctctgagagaggagcccagccctgggattttcaggtgttttcatttggtgatcaggactgaaccgagagaactcaccatggagtttgggctgagcgtgtcgtcttacgtcgtcggactttttaaaaggngtccagtgtgaggtgcaactgttggagtcgtgggggagacttagtacacccgtgggggtccctgagctctcctgtgcngcctcgtagctcaccttagctaactctgtcagtggctgggtccncgaggcgtccggggaaggcgtggagtcggtctagaagtattgatgagtagnggtaggacncacattcgtacgtggacttccgaggaacgggtccgttacaccatcctacccgaaggtanacctaaagtttcgagggaaccgcgtacgtcgttagtacctaactaaacgaagtacgaacgcgtacgtaggaacggaccggaccggtaaacggtaccgtaaccggtacgtttaagttcgtttacggtacggtacgtaaacggttaaacgttacgtacggtacgaccggtacggtccccgtacccccgtaccgtccgttaccttaccgtttccgttaccgtcggtcggg

SEQ ID NO: 84458 - DNA, 620 bp, Homo sapiens
  misc_feature: GYAE6OF01CGSEW.47.46.E02.1.454.CMB.1.raw
  modified_base (203)..(203): a, c, t, g, unknown or other
  misc_feature (203)..(203): n is a, c, g, or t
  modified_base (290)..(290): a, c, t, g, unknown or other
  misc_feature (290)..(290): n is a, c, g, or t
  modified_base (297)..(297): a, c, t, g, unknown or other
  misc_feature (297)..(297): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccgaggggaaanaggccaccatctcctgtacgggccggtcagagtgttggcagctacttagcctggtaccaacagaacctggccaggctccaggctccnatctatnatgcatccaacgacggcactggcactcccaagcctaggttcagtggcagtgagtcgtaggggactagtaccttacaccgtctacaccaatccaagcaagcccgtaagaacgtccctaagtaagtacttttacgaccttaacttttactttaacgtacgtacaacggtctaacgtcgtaacgtacgtaacgttcggtccttacgtacctaccgtttacgggacgggtaacgggtaaccggtacggggttacggaacgtaaggttaaccggaaaacgtaacgttagggtaccgggtacgtacggaccgtaaccgtacgtttaccg

SEQ ID NO: 84459 - DNA, 742 bp, Homo sapiens
  misc_feature: GYAE6OF01D0VHE.47.46.E02.1.454.CMB.1.raw
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggcttctttcttgtggtactttttaaaaggtgtccagtgtgaggtgcaactgttggagtcgtgggggatacgttagtaccgacccgtgggggtcccgtgacgtactcctccgtgtgcacgcctcgtggacctcctacctttacgcaactctgtcacgtggtcgtcgggtcccgccgacggccggtaccggggagggcgtggaggtcgggtactacgaagttatgtagtagtaaggaagtggtaggaagcaacgtagttcgtacggtcggacgtaccggtaggtaacgggtcccggttacaacctcgtaccctacgaacgaacgtaacttaacgttacgacggacgtccaacgtcgttaagtaactacctaaagaaaacgttacgaaacgtaccgtaccgtaggaaacggccggaacccgggaacggaaccggtaccccgggtacgtttaactttagttaccgttcggaaaggtaaccggtaaaacgttcgttaacggtacgaccgttaacgtccccccggaacccccgttaccgaccggttaccctttaacccgttttaccggtttcgtaacccgttcgggggtacccggg

SEQ ID NO: 84460 - DNA, 730 bp, Homo sapiens
  misc_feature: GYAE6OF01CPAUO.47.46.E02.1.454.CMB.1.raw
  modified_base (267)..(267): a, c, t, g, unknown or other
  misc_feature (267)..(267): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcgtggctctttcgttgtggtcttttttaaaaggtgtccagtgtgaggtgcaactgttggagtcgtgggggagacttagtacaccctggggggtccctgagactctcctgtgcagcctntggactcacctttagcaactctgtcatgggctggggtccgaccagggcgtaccggggaaggggccgtgggagtggggtcctgaaggtattggatggagaagtgggtaggaagcaactattctacggtggaccttccggtaggtaacgggccgggtttaccacgtaacgttcctacccgaagacgtaactaagttttaccgaagggtaacgacctaacggtccgttaggttaacgttaccgttaaaccaaaagttacgtaaaaccgaacggttacccgtagggaacggaaccggacccgggaacgggaacccgaaccgggtacccgttaagtttaacgtttccgtaggttacggtaacggaaacgtttacgtaacgttacggaaccgtacggtcccgtaccccccgtagcccgtaccttacccgtttaccgtttacggttaccgtttccgggttacccgggggg

SEQ ID NO: 84461 - DNA, 538 bp, Homo sapiens
  misc_feature: GYAE6OF01BF12H.47.46.E02.1.454.CMB.1.raw
  modified_base (202)..(202): a, c, t, g, unknown or other
  misc_feature (202)..(202): n is a, c, g, or t
  modified_base (226)..(226): a, c, t, g, unknown or other
  misc_feature (226)..(226): n is a, c, g, or t
  modified_base (357)..(357): a, c, t, g, unknown or other
  misc_feature (357)..(357): n is a, c, g, or t
  modified_base (382)..(382): a, c, t, g, unknown or other
  misc_feature (382)..(382): n is a, c, g, or t
  modified_base (400)..(400): a, c, t, g, unknown or other
  misc_feature (400)..(400): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaangccaccatctcctgtagggccgtnagagtattagcatcaacttagcctggtaccagcagagacctgggcaggctcccaggcctcctcatctatgatgcgtccaccagggccactcggtttcccagccaggttcagtggcaggtgcgtctgggacngagttcactctccaccataccaacngcctgcagtctagaagtnttttgcttagtttacttactgtcagctagtactcaataacgtggccctctcctaccgttcgggaccaagggtaccacggacgtagggaagtaacgttaaacggaacgttggtacggtctcgacaccctagtcgttacg

SEQ ID NO: 84462 - DNA, 521 bp, Homo sapiens
  misc_feature: GYAE6OF01EKZ7O.47.46.E02.1.454.CMB.1.raw
  modified_base (202)..(202): a, c, t, g, unknown or other
  misc_feature (202)..(202): n is a, c, g, or t
  modified_base (495)..(495): a, c, t, g, unknown or other
  misc_feature (495)..(495): n is a, c, g, or t
  modified_base (515)..(515): a, c, t, g, unknown or other
  misc_feature (515)..(515): n is a, c, g, or t
  modified_base (518)..(518): a, c, t, g, unknown or other
  misc_feature (518)..(518): n is a, c, g, or t
tcagagctcacgtacacgaccggtgctcgatttagactcatctacaggggaaagggggaggaactgctcagttaggacccagacggaaccatggaagccccagcgcagcttctcttcctcctgctactctggctcccagagaccactggagaaatagtgttgacacagtctccagccaccctgtctttgtctccaggggaanagccaccctctcctgcagggccagtcagagtgttggcagctacttagcctggtaccaacagaaacctggccaggcctcccaggctcctcatctatgatgcatccaacgacgggccacgtggcactcccagccaggttcaggtggcagtgagtcgtagggacaggtacttcgactctaccaccatcagcacgcctagacgcctagaagtattttcgacttactttattactgtacagcagtcgtagactacgtcggcctctctacgttcggcggtaggaccgagggtggacgancgagacgacgtgtggctgcncgntcg

SEQ ID NO: 84463 - DNA, 526 bp, Homo sapiens
  misc_feature: GYAE6OF01EKUV0.47.46.E02.1.454.CMB.1.raw
tcagagctcacgtacacgaccggtgctcgatttagactcatctacagggaaagggggctctgagagaggagcccagccctgggattcccagctgtttctgcttgctgatcaggactgcacacagagaactcaccatggagtttgggctgagctgggttttccttgttgctattttaaaaggtgtccagtgtgaggtgcaactgttggagtctgggggagacttagtacaccctggggggtccctgagactctcctgtgcagcctctggactcacctttagcaactctgtcatgggctgggtccgccagggctccggggaaggggctggagtgggtctcaagtatgatgagaatggtggaagcacattctacgtggactccgtgaagggccggttcaccatctccagagacaatttcaggagcacgctgtatctacaaatgaacagcctgagagccgaggacgacggccgtatactttctgtcgacgaaagtctaatagcgtacgtcgaccccctacgccgctaccg

SEQ ID NO: 84464 - DNA, 600 bp, Homo sapiens
  misc_feature: GYAE6OF01A1YIL.47.46.E02.1.454.CMB.1.raw
  modified_base (203)..(203): a, c, t, g, unknown or other
  misc_feature (203)..(203): n is a, c, g, or t
  modified_base (231)..(231): a, c, t, g, unknown or other
  misc_feature (231)..(231): n is a, c, g, or t
  modified_base (588)..(588): a, c, t, g, unknown or other
  misc_feature (588)..(588): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccgaggggaaanacgccaccatctcctggtacgggccgtnagagtattagcatcaacttagcctggtaccagcagagacctgggcaggctccccgaggcctcctcatcgtatcggatgcataccgaagcgggccaactgaaccactccccagtccaggttcaggtggactaggtgaggtctaggggacctagtaccttcaaccgtctacaccgatcacgtaccagtcccgtaagacgaccgttagaacgttagttttcgacttacgttttaattactcgtacagaccgtaggtcgtacgactaacgtcggtccctcgttaccgtacgttcgggacgggacgggtacggtagggtaggacggtacgtaccggaaggtaaccggtaacgttgggtacgngttccggaaccg

SEQ ID NO: 84465 - DNA, 653 bp, Homo sapiens
  misc_feature: GYAE6OF01AHTIF.47.46.E02.1.454.CMB.1.raw
  modified_base (203)..(203): a, c, t, g, unknown or other
  misc_feature (203)..(203): n is a, c, g, or t
  modified_base (227)..(227): a, c, t, g, unknown or other
  misc_feature (227)..(227): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccgaggggaaanagccacatctcctgtagggccgtnagagtattagcatcaacttagcctggtaccagcagagacctgggcaggctcccgaggcctcctcatctatgatgcgtccacgacgggccacgtcggtttccccagccgtagggttcgaggtcggacgtaggtcggtcgttacggtacgggtaacgtaggttacgttccgtaccgttcctacctaacctaactaaccgaaccgaccgtccgtacgacgtacgttacgtaaggtaacgtttacgtttacggtttaacttttacgttacgtacgtacgacggtacgtacggtcggttaggttacgtttcggtccggttcccgtcccgtccttaccgttcggttccggggacgggtaccgggtaccgggtagggtcggaacgtacgtaaacgaacgtacggtgtcggacgtcgacctactgttcgttacg

SEQ ID NO: 84466 - DNA, 494 bp, Homo sapiens
  misc_feature: GYAE6OF01BKA61.47.46.E02.1.454.CMB.1.raw
  modified_base (451)..(451): a, c, t, g, unknown or other
  misc_feature (451)..(451): n is a, c, g, or t
  modified_base (475)..(494): a, c, t, g, unknown or other
  misc_feature (475)..(494): n is a, c, g, or t
tcagagctcacgtacacgaccggtgctcgatttagactcatctacaggggaaagggccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtgtgggacagagttcactctcaccatcaacacgcctgcagtctagaagtattttgacttagtttattactgtcagcagtatacaataacgtcggcccgtctacctaccgttccggaccgaacgggacacgacgtagggagtaacgttaaaacgaactggtcggtcctggaccaccattccgttgttccttactacttcccttaccccgacctattcgtgtaacttacggtgacgtcctcgtggacgtcgggntacggacgtagggccgacagtcgnnnnnnnnnnnnnnnnnnnn

SEQ ID NO: 84467 - DNA, 686 bp, Homo sapiens
  misc_feature: GYAE6OF01DG1BY.47.46.E02.1.454.CMB.1.raw
  modified_base (204)..(204): a, c, t, g, unknown or other
  misc_feature (204)..(204): n is a, c, g, or t
  modified_base (231)..(231): a, c, t, g, unknown or other
  misc_feature (231)..(231): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagcccaccctgtctgtctctccgaggggaaancgccacatcctcctggtacgggccgtnagagtatagcatacaacttagcctaggtaccagcagacgaccgtgggcacggcctcccgaggcctcctcatcgtagggatcgacactacccgaacgacgggcccacgtcggacctacgtacccgaagtaccgtacggttacagggtcggacgtagggttcgggtcgtacggggaactacggtacctttcgaccgttccgtaccaacctacgtaccgacggtaccgaacgtacccgtaacgacgtacccgtaagtaacgttacgtttaggttaaccttttagttacgtcgtacgagtacgtaggtcggttagtaccggttccgttcggtcccttaccgtccgttaccgttccgggtttaccgggacgggtacgggtaaccggtaggggtacggaacggtaaccgtaacgaaaccggtacggttacggtacggtccgtacgacctaccgtagttccg

SEQ ID NO: 84468 - DNA, 531 bp, Homo sapiens
  misc_feature: GYAE6OF01A5CER.47.46.E02.1.454.CMB.1.raw
  modified_base (202)..(202): a, c, t, g, unknown or other
  misc_feature (202)..(202): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaangccaccatctcctgtagggccgtcagagtattagcatcaacttagcctggtaccagcagagacctgggcaggctcccaggctcctcatctatgatgcgtccaccagggccactggtttcccagccaggttcagtggcagtgcgtcgtgggacagagttcactctcaccatcagcagactggagcctgaagtattttgctagtgtattactgtcagcagtatggaacgtcctaccctattcctaccgtttccggcccgttagggaccctaagggtcggtacgtagtacgaaacgtacgtggtacggtctacggaccacctagtcgttacg

SEQ ID NO: 84469 - DNA, 420 bp, Homo sapiens
  misc_feature: GYAE6OF01BLHZG.47.46.E02.1.454.CMB.1.raw
  modified_base (409)..(420): a, c, t, g, unknown or other
  misc_feature (409)..(420): n is a, c, g, or t
tcagagctcacgtacacgaccggtgctcgatttagactcatctacaggggaaagggccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgctagtttattactgtcagcagtatcataactggccgctcaccttcggccaagggacacgactggagattaaacgaactgtggctgcaccatctgtcttcatcttcccgcctatctgactacgtgacgtctctgacggcgggctggcaaggcgcatagnnnnnnnnnnnn

SEQ ID NO: 84470 - DNA, 546 bp, Homo sapiens
  misc_feature: GYAE6OF01CC3YJ.47.46.E02.1.454.CMB.1.raw
  modified_base (182)..(182): a, c, t, g, unknown or other
  misc_feature (182)..(182): n is a, c, g, or t
  modified_base (218)..(218): a, c, t, g, unknown or other
  misc_feature (218)..(218): n is a, c, g, or t
  modified_base (247)..(247): a, c, t, g, unknown or other
  misc_feature (247)..(247): n is a, c, g, or t
  modified_base (265)..(265): a, c, t, g, unknown or other
  misc_feature (265)..(265): n is a, c, g, or t
  modified_base (300)..(300): a, c, t, g, unknown or other
  misc_feature (300)..(300): n is a, c, g, or t
  modified_base (329)..(329): a, c, t, g, unknown or other
  misc_feature (329)..(329): n is a, c, g, or t
  modified_base (334)..(334): a, c, t, g, unknown or other
  misc_feature (334)..(334): n is a, c, g, or t
  modified_base (388)..(388): a, c, t, g, unknown or other
  misc_feature (388)..(388): n is a, c, g, or t
  modified_base (408)..(408): a, c, t, g, unknown or other
  misc_feature (408)..(408): n is a, c, g, or t
  modified_base (416)..(416): a, c, t, g, unknown or other
  misc_feature (416)..(416): n is a, c, g, or t
  modified_base (418)..(418): a, c, t, g, unknown or other
  misc_feature (418)..(418): n is a, c, g, or t
  modified_base (425)..(425): a, c, t, g, unknown or other
  misc_feature (425)..(425): n is a, c, g, or t
  modified_base (437)..(437): a, c, t, g, unknown or other
  misc_feature (437)..(437): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatgggagtttgggctgagcggtgtgtcttagtcgtcgtatttttaaaggngtcagtgtgaggtgcaatgttggagtcgtggggganacttagtacacccgtgggggtccctgganactctcctgtgcagcctnggctcactttagcaactcgtgtcatggctcggccncgaggcgccggggaggctggagtggtctnaagtnttgatgagtagtggagaagcatatctagtgacttcggaggacggtccgtcactntcacagacatagttcaggancacgctananactaaanagtacatagtanagacgcgacgacgacgtacgtattattcgtgagtacgtacgtagtagtagtacgtacgtcccgtcccgtacccgtacgtccgtacttacgttcgtacgtcgtcgggacg

SEQ ID NO: 84471 - DNA, 672 bp, Homo sapiens
  misc_feature: GYAE6OF01E5N5M.47.46.E02.1.454.CMB.1.raw
  modified_base (208)..(208): a, c, t, g, unknown or other
  misc_feature (208)..(208): n is a, c, g, or t
  modified_base (236)..(236): a, c, t, g, unknown or other
  misc_feature (236)..(236): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtcctccagccaccctgtctgtctcgtaccgaaggggaaacncgccaccatcctcgtggtacgggccgtnagtagtattagcatccaacttgcctaggtaccagcagacgaccgtgggcacggcctcccgaggtcctcctcatctatcgatcgaccaacgtaccgaacggacggccacgtcggacctactacccgagtacgtaggtacgaggtcggacgtagggtcggtcgtagggaccacgtactcctactcctacaccgtactacgacgacgacgtacccgtagacgtccgttaagtaacgtttacgtttacggttaacttttacgtacgtacgtacgtagcgtacggtcggtacggttacgttccggtccggtcccgttccgtaccgtaccgttacgggttccggggaacgggtaccggggaccggtaggggtaacgacggtaaacggtaaccggtaaaaccggtcgtacggtacggtaccaccgtaccgtaccgtttaccgg

SEQ ID NO: 84472 - DNA, 589 bp, Homo sapiens
  misc_feature: GYAE6OF01BWYM1.47.46.E02.1.454.CMB.1.raw
  modified_base (442)..(442): a, c, t, g, unknown or other
  misc_feature (442)..(442): n is a, c, g, or t
  modified_base (467)..(467): a, c, t, g, unknown or other
  misc_feature (467)..(467): n is a, c, g, or t
tcagagctcacgtacacgaccggtgctcgatttagactcatctacagggaaagggggctctgagagaggagcccagccctgggattttcaggtgttttcatttggtgatcaggactgaaccgagagaactcaccatggagtttgggctgagctggctctttcttgtggtcttttttaaaaggtgtccagtgtgaggtgcaactgttggagtcgtggggagacttagtacacccgtgggggtccctgagactctcctgtgcagcctcgtggactcacctttagctaactctgtcagtgggctgggtcccgccaggcgtccgggggaagggctgggaggtgggtctcgaagttagttgatgagaagtgggtagaagcatattcgtaggtggactccgtggaacgggtccggttcaccatcctaccagagaactatttcgaggancacgctagtatactaacaatgaacncgacctgaagacgaccggaggaccgacgggtaccgtaagttagtttcgtggtacggtacgtaaagttctaagtagactacgtccgacccccgtagtccactactttccttgtcgtttccggg

SEQ ID NO: 84473 - DNA, 417 bp, Homo sapiens
  misc_feature: GYAE6OF01AE2ZR.47.46.E02.1.454.CMB.1.raw
  modified_base (407)..(417): a, c, t, g, unknown or other
  misc_feature (407)..(417): n is a, c, g, or t
tcagagctcacgtacacgaccggtgctcgatttagactcatctacaggggaaagggccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgctagttttattactgtcagcagtatcataactggccgctcaccttcggccaagggacacgggactggagattaaacgactgtggctgcaccatctgtcttcatccttcccgcctatctgatacgtgatctctgagcgggctggcaaggcgcatagnnnnnnnnnnn

SEQ ID NO: 84474 - DNA, 619 bp, Homo sapiens
  misc_feature: GYAE6OF01BYIF0.47.46.E02.1.454.CMB.1.raw
  modified_base (221)..(221): a, c, t, g, unknown or other
  misc_feature (221)..(221): n is a, c, g, or t
  modified_base (308)..(308): a, c, t, g, unknown or other
  misc_feature (308)..(308): n is a, c, g, or t
  modified_base (420)..(420): a, c, t, g, unknown or other
  misc_feature (420)..(420): n is a, c, g, or t
  modified_base (439)..(439): a, c, t, g, unknown or other
  misc_feature (439)..(439): n is a, c, g, or t
  modified_base (457)..(457): a, c, t, g, unknown or other
  misc_feature (457)..(457): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcgtggctctttcgttgtggtactttttaaaaggtgtccagtgtgaggtgcaactgttggagtcgtggggganacttagtacacccgtgggggtccctggagactctcctgtgcagcctctggactcacctttagcaactctgtcagtgggatgggtccncgaggccgtccggggaagggctggagtgggtctcaagttattgatgagaagtggtaggaagccaatagttcgtacgtggactccggtaggaacgggtccgttacaccatccnccagagactattcgaggancacgctagtatcctaaanaagtacgaacacgacgaggacgacgaccggacggaaccgtaccggtaccgttaattacgtttacgtggtagtaacgtaaacgttacgtaagtacgacgtaccggtcccgacccccgtacgccgtacccttacgtttcgtttacgtccgttccgggtacgggg

SEQ ID NO: 84475 - DNA, 710 bp, Homo sapiens
  misc_feature: GYAE6OF01BGP4M.47.46.E02.1.454.CMB.1.raw
  modified_base (202)..(202): a, c, t, g, unknown or other
  misc_feature (202)..(202): n is a, c, g, or t
  modified_base (227)..(227): a, c, t, g, unknown or other
  misc_feature (227)..(227): n is a, c, g, or t
  modified_base (314)..(314): a, c, t, g, unknown or other
  misc_feature (314)..(314): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccgaggggaanacgccacatctcctggagggccgtnagagtattagcatcaacttagcctggtaccagcagagaccgtgggcaggcctccgaggctcctcatctatgatgacataccaaacgngggcccagtcggctactcccgaggccgtaggttcagggtcggactaggttgaggttcgtaggggaacctaggtaccttccgaccttcctaccaacctacttaccgacgtcgaccgtaccgttacggaacgtcccgttaagtaaacgtttacgtttttacgacctttaaccgtttttaacgtttaaccgtttcgtaaccgtaacggtaccgtaaggttacccgggttaacggaccttaaaccggttccgggtacccctttaccgttacccgttaaccggttttccgggggaccgggtaaacgggggttaacccggtaaggggggttcgggaaacggtacgttaccgaaacggggtaaccgtaaccggttagggttcggtacccggttcggaaccccg

SEQ ID NO: 84476 - DNA, 574 bp, Homo sapiens
  misc_feature: GYAE6OF01A25G5.47.46.E02.1.454.CMB.1.raw
  modified_base (291)..(291): a, c, t, g, unknown or other
  misc_feature (291)..(291): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatcctcctggtagggccggtcagagtattagcatcaacttagcctggtaccagcagagacctgggcaggctcccaggctccncatctatgatgcgtccaccgagggccacgtcggttcccagccaggttcagtggcaggtcgcgtcgtgggacagtagttcactcctcacctataccaacacgcctgcagtctagaagtattttgacgtttagtttattacgtgtactagtcctagtatacgtaactaacgtcggcccgtcttacccgaccgttccggaccgtaacgggtaccacggtacgtagggtaagtaaacgttaaaccggacgttaggtacggtctacggacctacctacgttcgttacg

SEQ ID NO: 84477 - DNA, 868 bp, Homo sapiens
  misc_feature: GYAE6OF01CQ2RT.47.46.E02.1.454.CMB.1.raw
  modified_base (183)..(183): a, c, t, g, unknown or other
  misc_feature (183)..(183): n is a, c, g, or t
  modified_base (355)..(355): a, c, t, g, unknown or other
  misc_feature (355)..(355): n is a, c, g, or t
tcagagctcacgtacacgaccggtgctcgatttagactcatctacagggaaagggggctctgagagaggagcccagccctgggattttcaggtgttttcatttggtgatcaggactgaaccgagagaactcaccatggagtttgggctgagcgtgtcgtcttacgtgtgtactttttaaaggngtcagtgtgaggtgcaatgttggagtcgtggggagacttagtacaccgtgggggtcctgagctctcctgcgcagctctgactcaccttagctaactctgtcagtgggtcctgggtcccgccgagggccgtaccggggaaggggccgttggaggttcgggtctcgtaaagttnttgatggaaggaagttgggtaggaaacgcgtaactaacgtttccgtaaaccggttcggaaccgtttaccccgggtaggaaaccgggggttccccggtttaccaaacccgtaacgtttcccctaacccgaagggaaaccgtaaacctttaaccggttttacgaaagggtaacggtaaccgaaccccgggtttacgtttaacgttaaaccgttaacccgttaaaacgtaaacgttaaccggtaaacccgttaacggtaacccggtaacgggtaaaccgggaaccgggtaacccgggaaacggggtaaacccggtaaccgggttaacccgtttaacgttttaccgtttaccggttaacgggttaaccggtaaaccggttaaaacggtttaccgttaaaacggttaccggtaacccggttaaaccccgggttacccccgtaacccccccggtaccggtacccgttacccgtttaacccgtttttacccggtttaacccggttacccggtttccgggg

SEQ ID NO: 84478 - DNA, 587 bp, Homo sapiens
  misc_feature: GYAE6OF01AM3II.47.46.E02.1.454.CMB.1.raw
  modified_base (154)..(154): a, c, t, g, unknown or other
  misc_feature (154)..(154): n is a, c, g, or t
  modified_base (176)..(176): a, c, t, g, unknown or other
  misc_feature (176)..(176): n is a, c, g, or t
  modified_base (342)..(342): a, c, t, g, unknown or other
  misc_feature (342)..(342): n is a, c, g, or t
  modified_base (353)..(353): a, c, t, g, unknown or other
  misc_feature (353)..(353): n is a, c, g, or t
  modified_base (396)..(396): a, c, t, g, unknown or other
  misc_feature (396)..(396): n is a, c, g, or t
  modified_base (445)..(445): a, c, t, g, unknown or other
  misc_feature (445)..(445): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcgtgngtcttagtgtgattttaaaggngtcagtgtgagtgcatgtggagtctggggagacttagtacacccgtggggggtccctgagctctcctgtgcagcctctgactcacctttagcaactctgtcagtgggctggtccgcaggcgtccggggaaggctggagtgggtctacgagtattgatgagagtggngaacgcacgtnttcgtacggtgactcggtagacggtcgttcacatcctcagganactagttacaggagctacgcttaggtaactcaaactaaagtagaaaccngaccgtaggaacgacggccgtaagggaccgaccgggaccttattagtttcgtgttggaacgttaagtactaagtacggcctacgttcccgtacccccgtagcccgtacgttacctttcgttaccgtacgttcgtaccggggg

SEQ ID NO: 84479 - DNA, 567 bp, Homo sapiens
  misc_feature: GYAE6OF01DEFSC.47.46.E02.1.454.CMB.1.raw
  modified_base (440)..(440): a, c, t, g, unknown or other
  misc_feature (440)..(440): n is a, c, g, or t
  modified_base (501)..(501): a, c, t, g, unknown or other
  misc_feature (501)..(501): n is a, c, g, or t
  modified_base (514)..(514): a, c, t, g, unknown or other
  misc_feature (514)..(514): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggtcttttttaaaaggtgtccagtgtgaggtgcaactgttggagtcgtgggggagacttagtacacccgtggggggtccctgagactctcctgtgcagcctctggactcacctttagcaactctgtcatggctcgggtccgccgaggccgtaccgggggaagggccgtggagtgggtctacgaagtattgatgaagtaatgggtagaagcaacgtattcgtacgtggacctcggtggaagggtccggttcacctatctcagagactaattcaggancacgctgtatctaacaaagtcgaacagcctagacgagccgaggacacgccgtattcgttcngtgacgtaaagtntagtagctacggtcgccccctagccgtctactttcttcgccttcggtacgggg

SEQ ID NO: 84480 - DNA, 612 bp, Homo sapiens
  misc_feature: GYAE6OF01DLH07.47.46.E02.1.454.CMB.1.raw
  modified_base (206)..(206): a, c, t, g, unknown or other
  misc_feature (206)..(206): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagataccatcggagaagttgtgttgacacagtcctccagcccaccctgtctttgtctccgaaggggaaancgcccacctctcctgcagggccagtcagaatattcacttcctatagcctagtaccaacagaacctggtcaggcctcccaggctctcatctatgatgcatccaagcggccagtgcactcccagacctagggttcaggttggcaggttcgggctgggacagtacttcactctacacctatcagcagtcctaagcgtactggtaaacttacgtttaggtaaccttttaagttactcggttacagtacgagtccggttgtaacggttcctgggaccccttccgtcttaccgtacggtttccggggacgggtacgggtacccgtagggggtacgaacggtaacgtaaccgtaaaaggtacggttggacggtccgtacggtaccaaccggttattcgttcgtcgtttacccg

SEQ ID NO: 84481 - DNA, 783 bp, Homo sapiens
  misc_feature: GYAE6OF01CGESQ.47.46.E02.1.454.CMB.1.raw
  modified_base (370)..(370): a, c, t, g, unknown or other
  misc_feature (370)..(370): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcgtggcgtctttcgttgtggtacttttttaaaaggtgtccagtgtgaggtgcaactgttggagtcgtgggggagacttagtacacccgtggggggtccctgagactctcctgtgcagcctcgtggactcacctttagcaactctgtcagtggctcgggtccgcgaggccgtcgggggaagggctggaggtggtctcaagtattgatgagaagtggtaggancatacgttcgtacgtcggacgtcggtaggaacgggtccgttacgacctagttccctaccgagtaacgaacttaacgtttcgaagggacgtaccgaaccggtctttaggtaacttacccgtaaaacgtaaaagttaccgaaacgtacgggtttaccaaggggaacgaaccgggacccgggtaaacggggaacccgttaacccggggttaacccgttttaagtttaaccgtttttcccgggtaggttaaccggggtaacccgttaaaaaacgggtttccttaaaggttaaaccggtccggtaaacccgggtttccccccggacccccccccgttaaagggtcccggtaacccttttacccgttttttacccggtttacgggttaaaccccgttttccggggtaaccccggggggg

SEQ ID NO: 84482 - DNA, 479 bp, Homo sapiens
  misc_feature: GYAE6OF01AT0PJ.47.46.E02.1.454.CMB.1.raw
  modified_base (462)..(479): a, c, t, g, unknown or other
  misc_feature (462)..(479): n is a, c, g, or t
tcagagctcacgtacacgaccggtgctcgatttagactcatctacagggggaaagggccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagccctgcagtctagaagtattttgctagtttattactgtcagcagtatcataactcggccgctcacccgttcggaccgaagggacacgacgtggagtaattaaacgaacgtggtggctgcacctatcgtgtcttcacttcccttccccgccacttctagtactaccgtgaccgtccttacgtcggacgggtccgggtctagggaccggtaaacgggcgacgacgtaggcgnnnnnnnnnnnnnnnnnn

SEQ ID NO: 84483 - DNA, 599 bp, Homo sapiens
  misc_feature: GYAE6OF01EEMQC.47.46.E02.1.454.CMB.1.raw
  modified_base (380)..(380): a, c, t, g, unknown or other
  misc_feature (380)..(380): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggtcttttttaaaaggtgtccagtgtgatgtgcaactgttggagtcgtgggggagacttagtacacccgtggggggtccctgagactctcctgtgcagcctctggactcacctttagcaactctgtcagtgggctgggtcccgccgaggccgtccgggggaaggggctgggaggtgggtctcgacgtatcaatcctgatggcagtgttaataattnggcgactcgtggaggggccattcagcatctcagagacaaggcaagtagtatacgtgatcgaaggaaatgaaactatacgagaagtacgtaccgaacgtacgtacgcttagttacttatcgtagtttcggttagttttacgagttcggttcccgtttccgggtcccgggtaccgggttactttccgggagggggaccctacgggggtaaccccgttcggg

SEQ ID NO: 84484 - DNA, 575 bp, Homo sapiens
  misc_feature: GYAE6OF01CVWTJ.47.46.E02.1.454.CMB.1.raw
  modified_base (218)..(218): a, c, t, g, unknown or other
  misc_feature (218)..(218): n is a, c, g, or t
  modified_base (523)..(523): a, c, t, g, unknown or other
  misc_feature (523)..(523): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggtctttttaaaaggtgtccagtgtgaggtgcaactgttggagtcgtggggganacttagtacacccgtggggggtccctgagactctcctgtgcagcctctggactcacctttagccaactctgtcatgggctgggtccgccgaggccgtccggggaaggggcgtgggagtggggtctcgaagtattgatgagaagtggtagaagcaactattctacgtggacctccggtgaacgggtccggttcacctatcctccaagacgactaatttcgaggagcacgctgtatctaacaaatgaacagcctagacgagccggaggacgacggccgtattattctgtgacgtaagtctagtacgnacgtccgaccccctacgccgtcctacgttctttcgtccgttcggtaccgggg

SEQ ID NO: 84485 - DNA, 702 bp, Homo sapiens
  misc_feature: GYAE6OF01C5KHK.47.46.E02.1.454.CMB.1.raw
  modified_base (185)..(185): a, c, t, g, unknown or other
  misc_feature (185)..(185): n is a, c, g, or t
tcagagctcacgtacacgaccggtgctcgatttagactcatctacagggaaagggggctctgagagaggagcccagccctgggattttcaggtgttttcatttggtgatcaggactgaaccgagagaactcaccatggagtttgggctgagctggcttctttcttgtggtactttttaaaaggtntccagtgtgaggtgctaactgttggagtcgtggggagacttagtacacccgtggggggtccctgacgactctcctgtgcagcctctgactcacctttagcctaactctgtcagtcgggctgggtcccgccgacgggccgtaccgggggaaggggctggggaggtcggggtctacgtaagttgttagagtggaagtaagtgggtaggaaacgctaaacgtatttaccgtacggtacggtaccgttcccgggtaggaaaccgggggtcccggttacaacccgtagttccgtaccaaggtaacgtaactaacgtttacggaggtacaccgaaacggtccttaggtaacttacctaaactaaatcgaaacacgcccgtaggaacggacgacccgggtaacgaccgtacgggtaccttaatttccgtttcgtagtacgaacgtaaaagttcctaaagtacggtcaacgttccccgaacccccgttcgacccgttacctatttccgttagtcccgtttacggg

SEQ ID NO: 84486 - DNA, 411 bp, Homo sapiens
  misc_feature: GYAE6OF01DMB66.47.46.E02.1.454.CMB.1.raw
  modified_base (248)..(248): a, c, t, g, unknown or other
  misc_feature (248)..(248): n is a, c, g, or t
  modified_base (375)..(375): a, c, t, g, unknown or other
  misc_feature (375)..(375): n is a, c, g, or t
  modified_base (378)..(378): a, c, t, g, unknown or other
  misc_feature (378)..(378): n is a, c, g, or t
  modified_base (390)..(390): a, c, t, g, unknown or other
  misc_feature (390)..(390): n is a, c, g, or t
  modified_base (400)..(400): a, c, t, g, unknown or other
  misc_feature (400)..(400): n is a, c, g, or t
  modified_base (405)..(411): a, c, t, g, unknown or other
  misc_feature (405)..(411): n is a, c, g, or t
tcagagctcacgtacacgaccggtgctcgatttagactcatctacaggggaaagggccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctagaagtnttttgctagttttattactgtcagcagtatcataactggccgctcaccttcggccaagggacacgactggagaattaaacgaactgtggctgcaccatctgtcttcatcctcccgcatctgatacgnganctgtgagcgggntggcaaggcnatagnnnnnnn

SEQ ID NO: 84487 - DNA, 696 bp, Homo sapiens
  misc_feature: GYAE6OF01DQ40L.47.46.E02.1.454.CMB.1.raw
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcgtggctctttacgtgtggtacttttttaaaaggtgtccagtgtgatgtgcaactggttggagtcgtgggggagacttagtacaccgtggggggtccctgagtactcctccgtgtgcacgcctcgtggactctaccttttacgtccttcgttggatgtaagttcgggtccgccgagacctccggaggggaaggggtctagggaggttgggttacggacaactaagtaaactacgaagagtaggaagtacgaaacggaaaacctagttaggtacggtaacctcgtacgtacggtaacgggacccgtacttaccgacctacttcccgtaccacggaacgaaaccaaccggaacctaaacggtaacccttccgtctttcgtttacacggaactaaagtcggacctagccgttaggacgacggtacgaagccgtacggtcttagggttatactttacgtgttagtcgtcttcgacggtacccgtcggtacccggtccggtacgtttcggccgttcggtcggggacccttacgggtacccctggggtacccc

SEQ ID NO: 84488 - DNA, 552 bp, Homo sapiens
  misc_feature: GYAE6OF01EMC6D.47.46.E02.1.454.CMB.1.raw
  modified_base (206)..(206): a, c, t, g, unknown or other
  misc_feature (206)..(206): n is a, c, g, or t
  modified_base (360)..(360): a, c, t, g, unknown or other
  misc_feature (360)..(360): n is a, c, g, or t
tcagagctcacgtacacgaccggtgctcgatttagactcatctacagggaaagggggaggaactgctcagttaggacccagagggaaccatggaagccccagctcagcttctcttcctcctgctactctggctcccagacttccaccggagacatttgttttgacacagtctccagccaccctgtctttgtcctccgaggggaaangcccacctctcctgcagggccagtcagagtgttggcagctacttagcctggtaaccaacagaaacctggccaggcctcccgaggcctcctcatctatgatgcatccaacgcgggccactggacactcccagccaggttcagtgcagtgagtcgngggacagaccttcactctacacctatcagcacgccgtagacgacctagaagtattttacgacttaactttattactgtccagtcagcgtagactacgtggtcctctctacgttcggacggacgggaccggtgggtaggacgagtacgaacggtacgaacgtggtacgtccgtacgacctacctgtcgttacg

SEQ ID NO: 84489 - DNA, 760 bp, Homo sapiens
  misc_feature: GYAE6OF01A73RT.47.46.E02.1.454.CMB.1.raw
  modified_base (312)..(312): a, c, t, g, unknown or other
  misc_feature (312)..(312): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggtctttttaaaaggtgtccagtgtgaggtgcaactgttggagtcgtgggggagacttagtacacccgtgggggtccctgagactctcctgtcgcagcctcgtggacctctacctttagctaactctgtcagtcgggcgtcgggtccncgagacctccggaggggacgggcgtgggaggtgggtgacaacgaataaacgtccaagtagtagggaacgtacgaaacgtaaaaccgtagtggtacggtaccgtcttacgtagggaaacgggtaccgtaactttaccaaccgttactccgtaaccgaagaacgaaccgaaccgaaccgaaacgtaacctcttcgtttacgtttccgtacgtaactaaacgtcggaacctacgtaccgtaggaacggtaacggttaaccggaaacggaccgtaaccggtcgttacggttacgttaacgtttaacgttcggttaggttccgttaccgttcggttaccggtacccgggtccccggttacccggggccccggttaacccgtttccggggttacccggtttcccggggttaccgggggtaccccggttaccgggggtaaccccggttcccgggg

SEQ ID NO: 84490 - DNA, 540 bp, Homo sapiens
  misc_feature: GYAE6OF01DDCD4.47.46.E02.1.454.CMB.1.raw
  modified_base (204)..(204): a, c, t, g, unknown or other
  misc_feature (204)..(204): n is a, c, g, or t
  modified_base (228)..(228): a, c, t, g, unknown or other
  misc_feature (228)..(228): n is a, c, g, or t
  modified_base (530)..(530): a, c, t, g, unknown or other
  misc_feature (530)..(530): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagcccaccctgtctgtctctccgaggggaaangccaccatctcctgtagggccgtnagagtattagcatcaacttagcctggtaccagcagagacctgggcaggctccaggctctcatcatgatgccgtccaccgagggccactcggttcccagccaggttcagtgcagtgcgtctgggacagagttcactctcacctatcaacagcctgccagtctagaagtattttgctagtttattactgtcagcagtatacataacgtcggcctccgtacacccgttcggacctaaacggggacaaccgtacgtgggaactaagttaaaaccgaacgttggtaggtcctacgacctaacccgtntccgtttacg

SEQ ID NO: 84491 - DNA, 558 bp, Homo sapiens
  misc_feature: GYAE6OF01CVQBH.47.46.E02.1.454.CMB.1.raw
  modified_base (205)..(205): a, c, t, g, unknown or other
  misc_feature (205)..(205): n is a, c, g, or t
  modified_base (231)..(231): a, c, t, g, unknown or other
  misc_feature (231)..(231): n is a, c, g, or t
  modified_base (301)..(301): a, c, t, g, unknown or other
  misc_feature (301)..(301): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagacccactggagaaatagtgatgacgcagtctccagcccaccctgtctgtctctccgaggggaaancgccaccatctcctggtagggccgtnagagtatagcatcaacttgcctggtaccagcagagaccgtgggacaggcctccgaggcctcctcatctangatcgccgtccacgacgggcctacgtcggttcccagcctaggttccaggtggctaggtcggtctgggactaggtacttcactctcacctatcagcacgccgtagacgccgtagtaagtatttgacgttagtttattactgtacacgtactaaacgtaactacgtcggcctccgtctactacgtttcgggcggtacggaccgagggtcgacacgtaggaacgacgtggtcgcgtacgaccactattcgtgtcgttccg

SEQ ID NO: 84492 - DNA, 657 bp, Homo sapiens
  misc_feature: GYAE6OF01A7IOT.47.46.E02.1.454.CMB.1.raw
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggtctttttaaaaggtgtccagtgtgaggtgcaactgttggagtctgggggagacttagtacacccgtggggggtccctgagactctcctgtgcagcctctggactcacctttagcaactctgtcatgggctgggtcccgccagggccgtccgggggaaggggcgtgggaggtgggtctcgaagtatgatgaagagtgggtaggaagcacattccgtacgtggtactccggtaggaacggggtcccggtttacaacccgtatcctacccgaagtacgaactaatttcgaagggacgacacgtctagtatacctaaacaaattacgaactagtcgtaggaacgaggaccgaacggaccgtaaccgggtccgttaattacgttttcgtggttacggacggtaaaagttcttaagtaacggtcgtaacggtcccggaccccccttacggcccgtaccttaccgttttcgtttacggtaccgtttcggtaccggggg

SEQ ID NO: 84493 - DNA, 722 bp, Homo sapiens
  misc_feature: GYAE6OF01CHHQZ.47.46.E02.1.454.CMB.1.raw
  modified_base (199)..(199): a, c, t, g, unknown or other
  misc_feature (199)..(199): n is a, c, g, or t
  modified_base (226)..(226): a, c, t, g, unknown or other
  misc_feature (226)..(226): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctccagagaccactggagaaatgtgatgacgcagtctccagcccacctgtctgtctctcgagggaaancgccacatctcgtggtacgggccgtanagagtatagcatacaacttgcctaggtaccagcgagagaccgtgggcacggcctacccgacggcctcctacactactagtgatccgccgtacccgaccgacgggtccctacgtcggtttacccgacggtaccgtacggttcgaggtcggacgtaggttacgcggttcggtacgggtactaggtacgttacgacttcctaaccacctactaccaacgtacgtcccgtagtaccgtacggttcgttaagtaacgtttagtttcgtaacgtttacgttttaacgttacgttcgtacgacgtacgacggttacgtacgtaccgtaaccgggttccgtaccgtttaccgttacggttaccgggtttccgggaccgggggtaacgggtaaccgggacggggttacgggtaacggtaaccggttaccggaacgggtaaacccggttaacggttcgggtaaccgggttcgaccgggtaacccgttaaccgttcggtttaacccg

SEQ ID NO: 84494 - DNA, 677 bp, Homo sapiens
  misc_feature: GYAE6OF01APIPF.47.46.E02.1.454.CMB.1.raw
  modified_base (178)..(178): a, c, t, g, unknown or other
  misc_feature (178)..(178): n is a, c, g, or t
  modified_base (211)..(211): a, c, t, g, unknown or other
  misc_feature (211)..(211): n is a, c, g, or t
  modified_base (221)..(221): a, c, t, g, unknown or other
  misc_feature (221)..(221): n is a, c, g, or t
  modified_base (347)..(347): a, c, t, g, unknown or other
  misc_feature (347)..(347): n is a, c, g, or t
  modified_base (609)..(609): a, c, t, g, unknown or other
  misc_feature (609)..(609): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcgtgcgtcttagtgtcgatttttaaaggntcagtgtgagtgcaactgtggagtcgtgggganacttagaccnccgtgggggtccctgagctctccgtgtgcagcctctggactcacctttagcaactctgtcagtcgggcttcgggccacgacgggccggtccgggggaagggtcgtggaggttgggtctcgtaagtnttgatggagtaacgtgggtagaaacgcaactagttccgtagtcggaacgttcggtaggtaccgggtcgttaccgaacctcgtccctacgaacggtacgtaacctaactttcggaacgggacctacgtaacgttcttacgtacgtaacccttaaagaaacgttacgaacgtcgttacgagggacgaccggaaccggacggtaacccgacggttacgttaacgtttacgtttcgtaaggtcgtaacgtacgtacgttacgtacnccgtaccggtccccgttacccgacgtaccgttaccgtttacttacgttaccgttcgttcgggtacggg

SEQ ID NO: 84495 - DNA, 760 bp, Homo sapiens
  misc_feature: GYAE6OF01CHIGR.47.46.E02.1.454.CMB.1.raw
  modified_base (218)..(218): a, c, t, g, unknown or other
  misc_feature (218)..(218): n is a, c, g, or t
tcagagctcacgtacacgaccggtgctcgatttagactcatctacagggaaagggggctctgagagaggagcccagccctgggattttcaggtgttttcatttggtgatcaggactgaaccgagagaactcaccatggagtttgggctgagcgtgcgtcttcgtgtggtactttttaaaggtgtcagtgtgaggtgcactgttggagtcgtggggganacgttagtacacccgtgggggtcctgacgactcctccgtgtgcagcctctgactctacctttagcctaactctcgtcagtcgggcgttcgggtcccgccgacgggccggtaccgggggagggtcgtgggaggttcgggtactcgtaagttgttaggagtaggaagtaaggttaggggtacggaagtcgaacgttacgttacgtacggtacggtaccgttacccgggtaacgggtaaccggggttccccggttaccctaaacccgtaacgttcccgttaacccgaaggtaacggtaaaccgttaacgtttaccgaagggtacgaccggtaaccgtccgtttaagttaaccttaaccgtaaactaaacgttacgaaaccgtacgtacccgtaaggacgaaccgggaccggaacggtaccgaccggtacgttaatcgtttacgtaggttacggacgtaaacgttacgtagtaccgaacggtcggttacccccgtccccgaccgtaccgttacccgttctttaaccgtttcgtaccggttccgggg

SEQ ID NO: 84496 - DNA, 632 bp, Homo sapiens
  misc_feature: GYAE6OF01A1MB4.47.46.E02.1.454.CMB.1.raw
  modified_base (302)..(302): a, c, t, g, unknown or other
  misc_feature (302)..(302): n is a, c, g, or t
  modified_base (345)..(345): a, c, t, g, unknown or other
  misc_feature (345)..(345): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggctttttaaaaggtgtccagtgtgaggtgcaactgttggagtcgtgggggagacttagtacacccgtgggggtccctgagactctcctgtgcagcctctggactcacctttagcaactctgtcatgggctgggtccnccgaggccgtccgggggaagggcgtggagtgggtctcgaagtntgatgagagtggtaggaagcactattctacggtcggactccggtggaaacggggtcccggttacaccgtactccgtacccgaagtacgtaactaagtttcgaagggtacgcgaacgtctagtactacctaacaaagttacgaactagtcctagagacgaccggaggactaccgggaccttattacgtttcgagtacgaaccgtaaagttcctaagttcgaccgtacggtccccgaccccccgtagcccgtaccttacctttcgtttacgaccgtttcgggaccgggg

SEQ ID NO: 84497 - DNA, 699 bp, Homo sapiens
  misc_feature: GYAE6OF01BXEO6.47.46.E02.1.454.CMB.1.raw
  modified_base (203)..(203): a, c, t, g, unknown or other
  misc_feature (203)..(203): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggcctcccagagaccactggagaaatagtgatgacgcagtctccagcccaccctgtctgtctctccgagggaangcccacatcctcctggtacgggccgtcagagtattagcatcaacttgcctggtaccagcaggacgaccgtgggcaggctcccaggcctcctcatcctatgatcgcgtcccaccgagggccctacgttcggtttaccccacgtcccgtaacggttccgtaggtcggcgtaggttcggcgttcgtgggacgagtacgtttccaacgttctccacctactaccaacacgccctaggacctagtacgtagtaaagttatttttacgtcgtttaagttttaacttacgttcgtactaaggtcgtaagttacgtactaacttaacggtcggtacccgtaccgttacccgtaacccgtttcccgggaacccggtaaacgggtacccgaaccgggtaccgttaacgggtaaacggttaaaacgttaaaaaccggtaacccggttaaggttccgggtaaccgtttacggaaccgttaacccccgtaaagtttccggttaacccgg

SEQ ID NO: 84498 - DNA, 646 bp, Homo sapiens
  misc_feature: GYAE6OF01A551S.47.46.E02.1.454.CMB.1.raw
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggtctttttaaaaggtgtccagtgtgaggtgcaactgttggagtcgtgggggagacttagtacacccgtggggggtccctgagactctcctgtgcagcctcgtggactctacctttagcctaactctgtcagtgggcgtcgggtccgccgagggccgtccgggggaagggcgtgggaggtggtctcgaagtgttgatgagagtggtagagcacagttcgtacgtggtactcggtaggaacgggtccgttacactactccgtacgagtacgaactaagtttcgaaggtacgacgacgtctagtactactaaacaaagtcgaaacacgtaccgtagaacgaccggaccggaacggaaccgtaccgggtaccgttaagttacgtttcgtaggtacgtaacggtaaagttacgttaagacgtacgtacggtccccgaccccgtacgaccgtccttacgtttcgttacgtccgttcgggtaccgggg

SEQ ID NO: 84499 - DNA, 420 bp, Homo sapiens
  misc_feature: GYAE6OF01EPASL.47.46.E02.1.454.CMB.1.raw
  modified_base (405)..(405): a, c, t, g, unknown or other
  misc_feature (405)..(405): n is a, c, g, or t
  modified_base (412)..(420): a, c, t, g, unknown or other
  misc_feature (412)..(420): n is a, c, g, or t
tcagagctcacgtacacgaccggtgctcgatttagactcatctacaggggaaagggccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgctagtttattactgtcagcagtatcataactggccgctcaccttcggaccaagggcacgactggagtaattaaacgactgtggctgcaccatctgtcttctactccttcccgctactctagatacgtgagtctctgaggcggctgggcagggcncaatcgnnnnnnnnn

SEQ ID NO: 84500 - DNA, 597 bp, Homo sapiens
  misc_feature: GYAE6OF01CQ1DA.47.46.E02.1.454.CMB.1.raw
  modified_base (203)..(203): a, c, t, g, unknown or other
  misc_feature (203)..(203): n is a, c, g, or t
  modified_base (414)..(414): a, c, t, g, unknown or other
  misc_feature (414)..(414): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccgaggggaaancgccaccatcctcctggtacggggccgtcagagtatagcatcaacttgcctggtaccagcagagaccgtgggcaggcctcccgaggctcctcatctatgatcgcgtccaccgacgggccctacgttcggttcccaggtcctaggttccaggtcggcaggtcggtcgtcgtgggactaggtacgttccacctctaccgaacctctaccaacncgtcctgcacgttcgtagtaagttattttgactttagtttacttacgtcgtacacgtactacgttatactaacgttacgtcggaccctcctaccgtacccgttaccggacccgaagggaccacggtacgtagggtaataacgttaaacggacgttggtacgtactcgaccactacgtcgttcg

SEQ ID NO: 84501 - DNA, 768 bp, Homo sapiens
  misc_feature: GYAE6OF01A98HA.47.46.E02.1.454.CMB.1.raw
  modified_base (203)..(203): a, c, t, g, unknown or other
  misc_feature (203)..(203): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagagatgacgcagtctccagccaccctgtctttgtctccgaggggaaangcccaccctctcctgcagggccagtcagagtgttggcagctacttagcctggtaccaacacgaacctggccaggcctccgaggcctcctcatctatgactgcactccaacgacgggcccacgtcggacctacgtccccgagtcccgtaggttccagggtcggacgtaggttcggacggttcggtacggggaactaacgggtaccctttaccgacccgttacctacccgaacccttactaccgaaccggtaccgtaacggtaccccgttaaagggacccgtaccccggttaagggtaaacccggtttaccgtttttagggtaacctttttaacgttacccgtaggtttaccgaacggtcgtaacgggttccggtttacggtaaccggttttccggtacccgggttccccttacccggtacctttacccgggttaaccgggtttccgggggggacccggggggttaaccggtagggggttacggacggtaacgttaacccgggaaaacggtaccggttggggtaccggtacttacgggtaccctaacccggttgtttcccgttaccg

SEQ ID NO: 84502 - DNA, 669 bp, Homo sapiens
  misc_feature: GYAE6OF01BMTLC.47.46.E02.1.454.CMB.1.raw
  modified_base (205)..(205): a, c, t, g, unknown or other
  misc_feature (205)..(205): n is a, c, g, or t
  modified_base (231)..(231): a, c, t, g, unknown or other
  misc_feature (231)..(231): n is a, c, g, or t
  modified_base (411)..(411): a, c, t, g, unknown or other
  misc_feature (411)..(411): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggcctcccagagaccactggagaaatagtgatgacgcagtctccagccaccctgtctgtcctctccgaggggaaangccaccatctcctggtacgggccgtnagagtattagcagcaacttgcctggtaccagcacgaacctggcaggcctccgaggcctcctcatctatgatcgccgtccaccgagggccctacgttcggtttaccccaggtccgtaggtttaccgaggttggccgtaggtcggtccggttcggtagggaactaggtacgttccacttccncgtaacccataccgaactcgtccctgtccagtcgtagaagtacgttcgttacgtaccttaactttaacttactagttaaacctaaaagttactaacggtacgtaccgtcccccgtacttacccggttaccggtttaccggggaccgggtaacggggtaacccggtaaaggggttacgaacggtaaccgtaaccgaaacggtacgttcggtacggcttacggacctaccgtaacgttccgttcgttcccttcgtacccg

SEQ ID NO: 84503 - DNA, 761 bp, Homo sapiens
  misc_feature: GYAE6OF01C7WZ5.47.46.E02.1.454.CMB.1.raw
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctcttcttgtggtctttttaaaggtgtccagtgtgaggtgcaactgtggagtcgtggggagtacttagtaccgaccgtgggggtccctgacgtactctccgtgtgcacgtcctcgtcggtacctaccgtaccctttagacctaacttcgtcgtcgtagtcggggtcgttccggggtccgccgtacgggcccgggtaccgggggaaggggtccgtgggtagggttcgggtactacgtaaggttagttagagtagaagtaagtagggtaggaaacgtacaacgtacttacgtacggtacggtaaccgtcgggtacggtaaccggggtcccggttaccaaccgtacttcccgtacgaacgtaacgtaactaagtttccgaaggacgtcgtaccgtcgttagtaacgttactaaacgtaaagtacgtaaccgtacgacgtaagacgggaaccggaccggtaaccggaaaccggtacccggtaacgttaactttaacgttccggtaggtaaccgtaaacggtaaacgttaactaggtaacgtccgtaccggtccccgacccccgtacggtaccctaccgttactttacgttaccgtccgttgggtaacccggg

SEQ ID NO: 84504 - DNA, 574 bp, Homo sapiens
  misc_feature: GYAE6OF01ERZD0.47.46.E02.1.454.CMB.1.raw
  modified_base (292)..(292): a, c, t, g, unknown or other
  misc_feature (292)..(292): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagacatttgttttgacacagtctccagccaccctgtctttgtctccgaggggaaagagcccaccctctcctgcagggccagtcagagtgttggcagctacttagcctggtaccaacagaaacctggccaggcctccaggctccncatctatgatgcactccaacgacgggcccacgtggcactccccgagcctaggttcaggtggcagtgagtcgtagggacagtaccttcactctcacatcagcacgcctagacgcctagtaagtatttcgacttactttacttacgtgtcacgtcacgtacgtagactacgtcggccttcgtcctacgtttccgggacgggtacgggaccgtaggggtacggacggtatacggacggtaaccgtaacggttggtacggaccgtacggacctaccgtcgttaccg

SEQ ID NO: 84505 - DNA, 831 bp, Homo sapiens
  misc_feature: GYAE6OF01B5SRJ.47.46.E02.1.454.CMB.1.raw
  modified_base (205)..(205): a, c, t, g, unknown or other
  misc_feature (205)..(205): n is a, c, g, or t
  modified_base (302)..(302): a, c, t, g, unknown or other
  misc_feature (302)..(302): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggaagaaatagtgatgacgcagtctccagcccaccctgtctgtctctccgaggggaaancgccaccatcctccgtggtacgggccggtacaggagttattagcatacaattgcctaggtaccagcagacgacgtggcaggcctccgaggtcctccnctatctagtggtcgcactacccgaaacgacgggcccaacgtcggaccaacgttaccccaaggtaccgtaacggtttccgaaggttcgggacgtaaggggtttcggggtaccgtacgggggaacctaacggttaccctttaccgtacccttccgttaacccaacccgtacgttaaccgacggtacccaaaccgggtacccgttaaagggaaccggttaccccgttaaaggtaaaccgggtttaaccgttttttaacggggtttaaaccttttttaacgtttaaccgtttacggttaacccgtaacggtaccgtaaccgggttccgggttaacggttaacggttttccccggtcccgggtccccgtttaccccgtccgtttaccggttaccggggttttccgggggaaccggggtaaccggggtaacccgggttaagggggtacggtaacggtaaacggttaacccggaaaaccggttacggttcgggtaccggtacctttaccgggacccttaaccggtcttttacccgg

SEQ ID NO: 84506 - DNA, 711 bp, Homo sapiens
  misc_feature: GYAE6OF01C1PMY.47.46.E02.1.454.CMB.1.raw
tcagagctcacgtacacgaccggtgctcgatttagactcatctacagggaaaggggtctgagagaggagcccagccctgggatttttcaggtgttttcatttggtgatcaggactgaaccgagagaactcaccatggtagtttgggctgagcgtggctcgtttctcgtgtacgtttttaaaaggtgtcagtgtgagtgcatgtggagtcgtggggagactagtacaccgtgggggtcctgacgactctccgtgtgcagcctcgtacgactcctacctttagcaactcctgtacagtggcgtcgggtcccgcgacggccggtccggggaaggggcgtgggagtcgggtctacgtaagtagttagagtggaaggtaagtggtaggaacgtacactattccgtacgtcggtactccggtacggacgggtccgtacctactactccgtaccgaaggtaactacgttaagttcgaacgggtacgaccgtaacgtcttacggttacttaactaaacgtaaagcaaacgtcgtacccgtaggacggaacgacccggaacgggtaaccgaccgggtacctttaactttacgtttcgtacggttacgaaacggtaaacgttccgtttaagaccgtaccttacggtccccccgacccctaccgggtaccttacccggtttacttttccggtttaaccggtccgttttacggggacccgggg

SEQ ID NO: 84507 - DNA, 627 bp, Homo sapiens
  misc_feature: GYAE6OF01DYWZD.47.46.E02.1.454.CMB.1.raw
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggtcttttttaaaaggtgtccagtgtgaggtgcaactgttggagtctgggggagacttagtacaccctggggggtccctgagactctcctgtgcagcctctggactctacctttagctaactctgtcagtggctgggtccgccaggcgtccggggaagggctggagtgggtctacgaagtattgatgaagagtggaggaacgcacgtattcgtacgtggtacctccggtaggaacgggtccggttcaccgtatccgtccaagagacctaagtttcgaaggacgcgaacgtctagtactaccgtaacaaagtacgaacgtacgtacgtaggagaacggacccggaacgggaccgtacggtacccgttaatttaacgttcgttaggtacgacgtaaagttctaagtacgacgacggtccgacccccgtcgccgtcctactttctttcgtacgttcggtaccgggg

SEQ ID NO: 84508 - DNA, 651 bp, Homo sapiens
  misc_feature: GYAE6OF01DCXQE.47.46.E02.1.454.CMB.1.raw
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggtctttttaaaaggtgtccagtgtgaggtgcaactgttggagtcgtgggggagacttagtaccacccgtggggggtccctgagactctcctgtgcagcctctgactcacctttagcaactctgtcagtgggctgggtccgccgaggccggtccgggggaagggcgtgggacggtgggtcctacgaagttattggaatgaagtaagtgggtaggaacgacgaactattacgtacggtacggaccgtccggtagggaaccgggtcccggttacaccctagtcctaccgaagtacgaactaactttacgaaggtacgaccacgtccgtagttactacctaaacgtaaatacgaacgtacgcgtagagacggaccggaacggaccgtacggaccgtattacgttcgtgtacgtacgaaacgttcgtaagtacgacgacgtcccgacccccgtagtccgtcttaactttgttacgtcgttccggtacgggg

SEQ ID NO: 84509 - DNA, 558 bp, Homo sapiens
  misc_feature: GYAE6OF01B75AO.47.46.E02.1.454.CMB.1.raw
  modified_base (202)..(202): a, c, t, g, unknown or other
  misc_feature (202)..(202): n is a, c, g, or t
  modified_base (226)..(226): a, c, t, g, unknown or other
  misc_feature (226)..(226): n is a, c, g, or t
  modified_base (286)..(286): a, c, t, g, unknown or other
  misc_feature (286)..(286): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaangccaccatctcctgtagggccgtnagagtattagcatcaacttagcctggtaccagcagagacctgggcaggctccaggctccncatctatgatcgcgtccaccagggccacgtcggtttcccagccaggttccagtcggcagtgcgtcgtgggacaggtagttcactcgtcaacctatcaacacgcctgcagtctagaagtattttcgacttagtttattactgtacagtctaagtactacattaaccgtcggcctctccgaccttcggccgtagggaccaacggtaccgtagggaacgtaacgttaaaccgaacgttaggtacggtactacggacctaaccgtagttcgttacg

SEQ ID NO: 84510 - DNA, 456 bp, Homo sapiens
  misc_feature: GYAE6OF01C3BJZ.47.46.E02.1.454.CMB.1.raw
  modified_base (447)..(456): a, c, t, g, unknown or other
  misc_feature (447)..(456): n is a, c, g, or t
tcagagctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtcgcccctagcgcacttcttgacttcgtgggccagggaatcctggtcaccgtctccacacgcctccaccgaacgggccccatccgggtccttcccccgtggccgcccctggcctccgaggacgcacctccgacgagcacgagccggccctgggctcgcctaggtcaacggtcttacttcgtacgtgacgctcgtgacgcgggctggcaaggcgcatgnnnnnnnnnn

SEQ ID NO: 84511 - DNA, 564 bp, Homo sapiens
  misc_feature: GYAE6OF01BPGSS.47.46.E02.1.454.CMB.1.raw
  modified_base (201)..(201): a, c, t, g, unknown or other
  misc_feature (201)..(201): n is a, c, g, or t
  modified_base (227)..(227): a, c, t, g, unknown or other
  misc_feature (227)..(227): n is a, c, g, or t
  modified_base (369)..(369): a, c, t, g, unknown or other
  misc_feature (369)..(369): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaanagccaccatctcctgtagggccggtnagaatattcactcctacttagcctggtaccaacagaaacctggtcaggctcccaggctcctcatctgggatgcatccaacagggccgctgggcatcccagccaggttcaggtggcaggtgggtctgggacagacttcactcncacatcagcagcctagacgcctagaacgtatttgctagtttactactgtacagtacaacggtaatacgtcgacccttccgactcctacgtttcgggacgggtaggacccgaggggttcggaactagttaacggaaaccggtaagttcggtcggtacctaggaccgtaacctagttcctagtttccttacgtaccg

SEQ ID NO: 84512 - DNA, 633 bp, Homo sapiens
  misc_feature: GYAE6OF01EWCSS.47.46.E02.1.454.CMB.1.raw
  modified_base (308)..(308): a, c, t, g, unknown or other
  misc_feature (308)..(308): n is a, c, g, or t
  modified_base (353)..(353): a, c, t, g, unknown or other
  misc_feature (353)..(353): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggtcttttttaaaaggtgtccagtgtgaggtgcaactgttggagtctgggggagacttagtacacccgtggggggtccctgagactctcctgtgcagcctctggactcacctttagctaactctgtcagtgggctcggggtccnccgaggccgtccgggggaaggggctgggagtgggtctcgaagttntggatgagaagtggtaggagcacattcgtacgtggtacctccgtaggaacgggtccgttacacctatcctaccagacgtactaatttcgaggacgccgacgtcgtagtactctaacaaataggaacctagttacgaggaaggtacggaccggacggaaccgaccgggtacccgtttattaacgtttcgtggttacgacgtaaacgtctaagtacgacctaggtcccgaccccccttaggcccgtacctactttacctttacggcctttccggtaccgggg

SEQ ID NO: 84513 - DNA, 728 bp, Homo sapiens
  misc_feature: GYAE6OF01D7KO0.47.46.E02.1.454.CMB.1.raw
  modified_base (180)..(180): a, c, t, g, unknown or other
  misc_feature (180)..(180): n is a, c, g, or t
  modified_base (184)..(184): a, c, t, g, unknown or other
  misc_feature (184)..(184): n is a, c, g, or t
  modified_base (188)..(188): a, c, t, g, unknown or other
  misc_feature (188)..(188): n is a, c, g, or t
  modified_base (209)..(209): a, c, t, g, unknown or other
  misc_feature (209)..(209): n is a, c, g, or t
  modified_base (215)..(215): a, c, t, g, unknown or other
  misc_feature (215)..(215): n is a, c, g, or t
  modified_base (263)..(263): a, c, t, g, unknown or other
  misc_feature (263)..(263): n is a, c, g, or t
  modified_base (293)..(293): a, c, t, g, unknown or other
  misc_feature (293)..(293): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctggagcggtgtgtcttagtcgcgtattttaaaggngtcngtgngagtgactagtgtggagtcgngggganagttagaccgtacccggtgggggtccctggagtacctctcctgtgacncgtcctagtcggtactccgtaaccgtttcnctaaccttcggtacgtcgagtgggcgttccggaccggacgtcgggccggtccggggggaaggcgtggacggttggtccttaggaagttagtttggagttagtaaggaaccgtttgggtaagggtaaacccacgtaaccgttacgtttaaccggtaacggtcggtaaccggttcggtaacgggtaccgggtcccgttaaccaccgtacgtccgtacgagtaaaccgtacttaacgtcggaaggtacgtaccgtacgtacgttagttaactaacgttaaagtaacgtagtaaccgtgttacgtaacggacggaacgaccggtaacgggacgttccggtatttacgttacgtacggtgtaacgtaacgtaacgtagtacgtacgcgtaacggtcccgacccgtacgtacttcttaccgttagtacgtcgttcgggacg

SEQ ID NO: 84514 - DNA, 501 bp, Homo sapiens
  misc_feature: GYAE6OF01DTZZW.47.46.E02.1.454.CMB.1.raw
  modified_base (357)..(357): a, c, t, g, unknown or other
  misc_feature (357)..(357): n is a, c, g, or t
  modified_base (480)..(501): a, c, t, g, unknown or other
  misc_feature (480)..(501): n is a, c, g, or t
tcagagctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtcgccccctagcgcactttcttgacttcgtggggccagggaactccgtggtccaccgtctccacacgcctccaccgaagggcccagtccggtcccttcccccgtggcccgcccctgcctccgaaggcnccacctccgagacgcacgaggccgcccgtgggcctgcccgtggtacaaacggtaccttaccttcccgtaacggtcgacgtccttcgtggacggcgggtctcgggacaagggccgacagtacgnnnnnnnnnnnnnnnnnnnnnn

SEQ ID NO: 84515 - DNA, 813 bp, Homo sapiens
  misc_feature: GYAE6OF01E3QH6.47.46.E02.1.454.CMB.1.raw
  modified_base (152)..(152): a, c, t, g, unknown or other
  misc_feature (152)..(152): n is a, c, g, or t
  modified_base (204)..(204): a, c, t, g, unknown or other
  misc_feature (204)..(204): n is a, c, g, or t
tcagagctcacgtacacgaccggtgctcgatttagactcatctacaggggaaagggggaggaactgctcagttaggacccagacggaaccatggaagccccagcgcagcttctcttcctcctgctactctggctcccagagaccactggtanaaatagtgatgacgcagtctccagccaccctgtctgtctctccgaggggaanacgccaccatcctccgtaggtacgggccggtacaggtacttacgttacgctactaccgtaaacgttacgccgttcgggtaacccagacaaggtaccgacccgtggggaccacgggtccctaccccgacgggtcccttacccctaccgtaacttaccgttaattaggtaacgttccggtaccccgggtttaccccgaaccgggacccgggggtaccccctttaaccggttttcccggggttttacccccaacgggttaccccggttaaggggttttaccgaacgggtttcgggtaaccgtaaggggtttccggtccgggttttacccgggtagggggaacctaacgggtttaaccgtttcccgtaaccttcccgtaccaacccttaacctaacccaaccctacccgtgaccgacgtccctagtacgtagtttaacttcgacgtttaactttacttaccgtacaaaccgtaaagttactaagttcggtacctaccgttccggttaccgggttaccgaccgttaacggaactaaggtggacgttacggaacgtaaacggtcgttaggtcgtctacgacctaccgtgttctcggttcctacgtcgtttccccg

SEQ ID NO: 84516 - DNA, 628 bp, Homo sapiens
  misc_feature: GYAE6OF01DVUTZ.47.46.E02.1.454.CMB.1.raw
  modified_base (201)..(201): a, c, t, g, unknown or other
  misc_feature (201)..(201): n is a, c, g, or t
  modified_base (325)..(325): a, c, t, g, unknown or other
  misc_feature (325)..(325): n is a, c, g, or t
  modified_base (334)..(334): a, c, t, g, unknown or other
  misc_feature (334)..(334): n is a, c, g, or t
tcagagctcacgtacacgaccggtgctcgatttagactcatctacagggaaagggggaggaactgctcagttaggacccagacggaaccatggaagccccagctcagcttctcttcctcctgctactctggctcccagataccaccggagaagttattttgacacagtctccagccaccctgtcttgtctccgaggggaanagcccaccctctcctgcagggtcagtcagagtgttgacagctacttagctaggtaccaagacgaacctggaccaggcctcccgaggcctcctcgatcgtagggattcgacaacgtccgaaacgnggggcccgngtcggctacgtccccaggacctaggttcaggtcggacgtaggtcgggtcgtacggggacacgtacttccacttcgacaccatcgagcgtacgccgtagacgacgtagtaagttagttttagacgttagtttacttacgtcgtacgtaagtactaaacgttaaacgtacgtcggtaccctcgtcctacgtaccgttcggcgggacgggtacgtagggtacgaacgtagtacgtaaacgtacgtaggtacggacgtcgacctaccgtagttctacgttactactcgtcccgtcccg

SEQ ID NO: 84517 - DNA, 746 bp, Homo sapiens
  misc_feature: GYAE6OF01ARLX8.47.46.E02.1.454.CMB.1.raw
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggctttttaaaaggtgtccagtgtgaggtgcaactgttggagtcgtgggggagacttagtaccgacccgtggggggtccctgagactctcctgtgcagcctctggactcacctttagctaactctgtcatgggtcgtcgggtccgccgagggccggtccgggggaaggggccgtaggggtaggtcggggtactacgtaaggttagttaggataggaaggtaaagttggggttaggaaacgcgaactagtttacgtacgtgggtaacctccggtaggaaaccggggtccgttaccaccgtatcccgtaccaacgtaggaacctaacgtttacgacgggtaagaccgacgtccgtagttactacttaaacgtaaatacggaactacggttactacgggagtaaccggaccgggaacggaccggtaacccgggtaccgttaacgttacgtttacgtagtacggtaacggtaaaacgttcgtaaacggtttacggtaccgtaccggtcccggtacccccccgttaggtaccccgtaccttacccttttacccgtttacggttcccgttttccgggtaacccggggg

SEQ ID NO: 84518 - DNA, 560 bp, Homo sapiens
  misc_feature: GYAE6OF01B58E5.47.46.E02.1.454.CMB.1.raw
  modified_base (202)..(202): a, c, t, g, unknown or other
  misc_feature (202)..(202): n is a, c, g, or t
  modified_base (302)..(302): a, c, t, g, unknown or other
  misc_feature (302)..(302): n is a, c, g, or t
  modified_base (395)..(395): a, c, t, g, unknown or other
  misc_feature (395)..(395): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagagatgacgcagtctccagccaccctgtctgtgtctccaggggaaanagccaccctctcctgcagggccagtcagagtattagcagcaacttagcctggaccagcagaaacctgggcaggcctcccgaggcctcctcatctatggtncatccaccgagggcccacgtggtactccccagtcccgtaggttcaggtggcaggtgcgtcgtgggacaggtagttccactctcaccatcaacngcctgctagtctagaatatttcgctagtttactactgtctagctagtactctaattacgtcggtccctctccgtacccgttccggaccgtaaacgggacctaccggtacgtagggaagttaacgttaaacgacgttggtacggactacggacctaccgtgtaccg

SEQ ID NO: 84519 - DNA, 569 bp, Homo sapiens
  misc_feature: GYAE6OF01B3HGH.47.46.E02.1.454.CMB.1.raw
  modified_base (202)..(202): a, c, t, g, unknown or other
  misc_feature (202)..(202): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccgaggggaancgccaccatctcctgtagggccgtcagagtattagcatcaacttgcctggtaccagcagagacctgggcaggcctcccgaggcctcctcatctatgatgccgtccaccgagggcccacgttcggtttccccagcccgtaggttcaggtggcaggtgcgtcgtgggacagtagttcactctaccacctataccaacacgcctgcagtctagaagttatttgacttagtttacttactgtcagtctagtatactagtaacgtcggccctactccgtaccgttcggaaccgaacgggaccaacggtacgtgggtaagtaacgttaaacggtacgttggtacgtacgtacggacctaacctgtccgttacg

SEQ ID NO: 84520 - DNA, 687 bp, Homo sapiens
  misc_feature: GYAE6OF01BG1H6.47.46.E02.1.454.CMB.1.raw
  modified_base (213)..(213): a, c, t, g, unknown or other
  misc_feature (213)..(213): n is a, c, g, or t
  modified_base (241)..(241): a, c, t, g, unknown or other
  misc_feature (241)..(241): n is a, c, g, or t
tcagagctcacgtacacgaccggtgctcgatttagactcatctacaggggaaagggggaggaactgctcagttaggacccagacggaaccatggaagccccagcgcagcgttctcttcctcctgctactctggcctccgagagaccacgtggaagaaatagtgatgacgcagtcctccagcccacctgtctgtcctcgaccgaaggggaaacncgccacatcctccgtggtacgggccgtnaggtagttatagcctagtctaacgttgccgtaggtaccagaccagacgaccgtgggccaggtcctcccgagtctacctcacttcgtattcggactccggacccgtaccgacccggacgggtacctaccggtttccgggttacccccaggtccccgtaaggtttccgacgggttcggacgtacggtcggtccggtcggtagggtaacacgggttacttcccgaactcctaccgtaaccactaaccgaacgtaccgtccgtacggtactacggttacgtaggtaaacttagttttcgaacgtttaacgtttaactacgttgaactagtaactacgtactacgaacgtaccgtcgtaccgtcgtaccgtccgttaccggacgtacggaccacgtacgtacgaagtaacgtaaccgtacgtgtacggtccacgtaccacgtctcgttacg

SEQ ID NO: 84521 - DNA, 667 bp, Homo sapiens
  misc_feature: GYAE6OF01BUER5.47.46.E02.1.454.CMB.1.raw
  modified_base (451)..(451): a, c, t, g, unknown or other
  misc_feature (451)..(451): n is a, c, g, or t
tcagagctcacgtacacgaccggtgctcgatttagactcatctacagggaaaggggtctgagagaggagcccagccctgggattttcaggtgtttcatttggtgatcaggactgaaccgagagaactcaccatggagtttgggctgagctggctctttcttgtggctttttaaaaggtgtccagtgtgatgtgcaactgttggagtcgtgggggagacttagtacaccgtggggggtccctggacgactcctcctgtgcagcctctggactcacctttagcaactctgtcatgggctgggtccgccgaggcgtccgggggaagggctgggaggtcgggtctacgaagtagttgagtagagaagtgggtaggaagcaactatctaacggtggacgtcgtaggaacgggcgttacgaccatccgtaccagacgtactaagtttccgaaggacnccgacgccttaggtaactacctaactaaaatcgaaacgtacgtaccctagggaacgtacggacccggagggaacccgaacggtcccgttaattacgtttccgtaggtacggtacggtaaaacgtttcgtaaacgtaacggccgtaacggtccccgacccccccgttaggacccggtcccttaaccgttttcctttacggtacccggtttaccgggg

SEQ ID NO: 84522 - DNA, 567 bp, Homo sapiens
  misc_feature: GYAE6OF01DIEOB.47.46.E02.1.454.CMB.1.raw
  modified_base (203)..(203): a, c, t, g, unknown or other
  misc_feature (203)..(203): n is a, c, g, or t
  modified_base (230)..(230): a, c, t, g, unknown or other
  misc_feature (230)..(230): n is a, c, g, or t
  modified_base (294)..(294): a, c, t, g, unknown or other
  misc_feature (294)..(294): n is a, c, g, or t
  modified_base (300)..(300): a, c, t, g, unknown or other
  misc_feature (300)..(300): n is a, c, g, or t
  modified_base (316)..(316): a, c, t, g, unknown or other
  misc_feature (316)..(316): n is a, c, g, or t
  modified_base (372)..(372): a, c, t, g, unknown or other
  misc_feature (372)..(372): n is a, c, g, or t
  modified_base (415)..(415): a, c, t, g, unknown or other
  misc_feature (415)..(415): n is a, c, g, or t
  modified_base (557)..(557): a, c, t, g, unknown or other
  misc_feature (557)..(557): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccgaggggaaangccaccatctcctggtacgggccggtnagagttattagcatcaacttgcctaggtaccagcagagacctgggcaggctcccaggcctcctnatctangatcgccgtccaccgngggccacgttcggttccccagtccgaggttcaggtggcagtgcgtcgtgggacagngttcactctcacatacaacacgtcctgacgagtctagtaagtntttgacttagtttattactgtcagtcagttatactaatacgtcgtccgtctacccgtaccgttacgggaccgtaaacgggaccgacgtacgtagggtaacgtaacgttaaacgaacgttggtacggtcgtacgccgtaaccngttcgttacg

SEQ ID NO: 84523 - DNA, 667 bp, Homo sapiens
  misc_feature: GYAE6OF01CB9VI.47.46.E02.1.454.CMB.1.raw
  modified_base (345)..(345): a, c, t, g, unknown or other
  misc_feature (345)..(345): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggtcttttttaaaaggtgtccagtgtgaggtgcaacttgttggagtcgtgggggagacttagtacacccgtggggggtccctgagactctcctgtgcagcctctggactcacctttagcaactctgtcagtgggctggtccgcgaggccgtccggggaagggctggagtgggtctcaagtntgatgagaatgggtagaagcacattctacgtggacctcggtggaacgggcccggttacaccgtactctaccgagtagaactatttacgaggagcacgctagtaactctaacaagtacgaacacggcctaggaacgacgaccggacgggaacgaccggtaccgtaagtttactttccgtagttacggtaacggtaaacgttacgtaaacgtacggtaccggtaacggttcccccggtaccccccgtttaacccggaccgttaacccgttacccgtttttaccgttttacccgggttaccgttttcccggggtaacccgggggg

SEQ ID NO: 84524 - DNA, 647 bp, Homo sapiens
  misc_feature: GYAE6OF01D4TCH.47.46.E02.1.454.CMB.1.raw
  modified_base (203)..(203): a, c, t, g, unknown or other
  misc_feature (203)..(203): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccacctgtctgtctctccgagggaaacgngcccacctctcctgcgagggccagtcagagttagttggcagctaaacgttagccttaggtacccaagcaacgaaaccgtggggacaacggtcctcccgacggccttaccctcgtaactccgtagttcgggtactaccgtacctaccgacccgtaagggtcccaacgttcgggtaacctccccgaaacggtcccgtaggtttaccgaaggttcgggccgtaaggtcgggtacgtaggggacctacgtaaccttcgaacctctaccacctagtcacgcctagccgtagacgtacgtagagttcgtttacgacttaactttagtactggtacaacgtcgtaagcgtaacgcaaccttcggccttactcggaccgtttagggacccggtagggtccaagggcggtactaagtcgaagtcgatggtcggactacgactccgtgtacccg

SEQ ID NO: 84525 - DNA, 452 bp, Homo sapiens
  misc_feature: GYAE6OF01E5TFB.47.46.E02.1.454.CMB.1.raw
  modified_base (354)..(354): a, c, t, g, unknown or other
  misc_feature (354)..(354): n is a, c, g, or t
  modified_base (410)..(410): a, c, t, g, unknown or other
  misc_feature (410)..(410): n is a, c, g, or t
  modified_base (439)..(452): a, c, t, g, unknown or other
  misc_feature (439)..(452): n is a, c, g, or t
tcagagctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtcgcccccctacgcgcacttcttttgacttctggggccagggaatcctggtccacccgtctcccacacgccctccaccaagggccccatccggtccttccccctggccgcccctgcctccaggcncacctccgagagcacagcggccctgggctcgcctggcaaggactacttcctacgtnagctctgagcgggctggcgaagcgcatgnnnnnnnnnnnnnn

SEQ ID NO: 84526 - DNA, 610 bp, Homo sapiens
  misc_feature: GYAE6OF01CZ5C3.47.46.E02.1.454.CMB.1.raw
  modified_base (201)..(201): a, c, t, g, unknown or other
  misc_feature (201)..(201): n is a, c, g, or t
  modified_base (227)..(227): a, c, t, g, unknown or other
  misc_feature (227)..(227): n is a, c, g, or t
  modified_base (290)..(290): a, c, t, g, unknown or other
  misc_feature (290)..(290): n is a, c, g, or t
  modified_base (343)..(343): a, c, t, g, unknown or other
  misc_feature (343)..(343): n is a, c, g, or t
  modified_base (358)..(358): a, c, t, g, unknown or other
  misc_feature (358)..(358): n is a, c, g, or t
  modified_base (379)..(379): a, c, t, g, unknown or other
  misc_feature (379)..(379): n is a, c, g, or t
  modified_base (385)..(385): a, c, t, g, unknown or other
  misc_feature (385)..(385): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatgtgatgacgcagtctccagccacctgtctgtctctccgaggggaaangccaccatctcctggtacgggccgtnagtagtattagcatcaacttgcctggtaccagcagagaccgtggcaggctcccaggcctcctnatctatgatgccgtccacgacgggcctacgttcggttcccagccgtaggttcnggtgcagtgcgtcgnggacagtctcactcacaccanacaacncgtcctgactagtctagtaagttagttttgacttaaggttttacttacgttcgtacgaacgttcctaaagttacttaccgtaacgttaaccgtcgggtcccgttaccttaccgtacccggtttaccgggaccgtaaaccgggactaaccgtacggtaacgggacgttaaacgttaaaaccggacgttggtacggtcctacggtacctacgtacgttcggttaccg

SEQ ID NO: 84527 - DNA, 884 bp, Homo sapiens
  misc_feature: GYAE6OF01ENN4F.47.46.E02.1.454.CMB.1.raw
  modified_base (203)..(203): a, c, t, g, unknown or other
  misc_feature (203)..(203): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccgaggggaaanacgcccaccctctcctgcacgggccagtcagaatattcactcctattagcctgtaccaacagaaacctggtacaggctccaggctcctcactctatgatgcataccaacacgggccacgtcggctaactccccgaagaccgtaggttacgaggttcgggacgtagggtcgggggtcgtacgggggaactaacggtaacctttccgaaccttcccgtacctaaaccccgtaacgttacccgaacggtacccgtaacggtacccccggttaaacggtaacgggtaccccgtaaagggtaaaacggtttaacgtttttttacggggtaacccgttttaaaggttttttaaccgttttaaccgtttaccggttaaccgttaacgggtaaacccgttaaaaaccggtttaaaacgtttaacccggtttacccggggtaaccccccgttttaaccccggtaccttttaccccgggttaacccggtttttacccggggggaacccgggggtaacccgggggtaaaccccggggtacggggggttaaaccgggtaaacccggtaaacgggtttaaacgggaaaaacccgggttaacccgtttaccgggggtaacgggttaaccccgggtttaccggaacccgtaaaccccccggttaagtttaccccgggtttacgttttaacccccgg

SEQ ID NO: 84528 - DNA, 652 bp, Homo sapiens
  misc_feature: GYAE6OF01CNNWS.47.46.E02.1.454.CMB.1.raw
  modified_base (306)..(306): a, c, t, g, unknown or other
  misc_feature (306)..(306): n is a, c, g, or t
  modified_base (531)..(531): a, c, t, g, unknown or other
  misc_feature (531)..(531): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggtctttttaaaaggtgtccagtgtgaggtgcaactgttggagtcgtgggggagacttagtacacccgtggggggtccctgagactctcctgtgcagcctctggactctacctttaagcaactctgtcatgggctgggtccnccgaggcgtaccgggggaagggctggagtgggtctcgaagtattgaatgaagaagtggtacggagcactattcgtacgtggacctccggtaggaacgggtcccgttcgaaccagtacctccgaagacgaaccaaccgccaaagaacttctcttagttcctagactaaaagtcggaactaggaccctaggacgacgtaacgaaacgaccgaacgggtccttagttnttaacttacgttggtcggtgtccttcgtacggaccgtccccgttacgggcccgggtaaccctttggggccctttcgggtacgggggcccgtttaaccggggaacccctttggggtaacccc

SEQ ID NO: 84529 - DNA, 431 bp, Homo sapiens
  misc_feature: GYAE6OF01BGKWK.47.46.E02.1.454.CMB.1.raw
  modified_base (386)..(386): a, c, t, g, unknown or other
  misc_feature (386)..(386): n is a, c, g, or t
  modified_base (416)..(431): a, c, t, g, unknown or other
  misc_feature (416)..(431): n is a, c, g, or t
tcagagctcacgtacacgaccggtgctcgatttagactcatctacaggggaaagggccaccatctcctgtagggccggtcagagtattagcatcaacttagcctggtaccagcagagacctgggcaggctcccaggctcctcatctatgatgcatccaacagggccactgacatcccagccaggttcagtggcagtgagtctgggacagacttcactctcaccatcagcagcctagagcctgaagtattttgctactttatactgtcagcagcgtagcaacgtcggctctctactttcgggcggagggaccgagggtggagatcagacgaacgtgtgctgcacatctgtcttcatccttcccgctatctgatacgtgacgtcgtcnggagcgggtctggcgaggtcgacagtacgnnnnnnnnnnnnnnnn

SEQ ID NO: 84530 - DNA, 648 bp, Homo sapiens
  misc_feature: GYAE6OF01BKRV7.47.46.E02.1.454.CMB.1.raw
tcagagctcacgtacacgaccggtgctcgatttagactcatctacagggaaagggggaggaactgctcagttaggacccagacggaaccatggaagccccagcgcagcttctcttcctcctgctactctggctcccagagaccacgtggagaaatagtgatgacgcagtctccagcccaccctgtctgtctctccgaggggaaagacgccaccatctcctggtacggggccggtcagagtattagcatcaacttcgccttggtaccagcgagacgaccgtgggcacggcctcccgaggcctcctcatctatgactcggccgtacccaccggagggtccctacgttcggtttccccaggtccgtaggttcgaggttcggctaggtcgcggtcgtacggggactagggtacgtttccacgttcctacccgaacctaataccaaaccgtaccgtcccgtaggcctacggttccgtaaggtaacgtttagtttcgtacgtttaagttttacttacgttgtcaaggtctaagtactataacgtacgtccggtcctccgtacctaccgttccggacgtaacgggaccacggtacggtaggaagtaacgttaaacggacgttaggtcggtaccgtcgaccctactcgtcgttacg

SEQ ID NO: 84531 - DNA, 903 bp, Homo sapiens
  misc_feature: GYAE6OF01B4HZU.47.46.E02.1.454.CMB.1.raw
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggtactttttaaaggtgtccagtgtgaggtgcaactgttggagtcgtgggggatacgttagtaccgtacccgtcggggggtccctgacgtacctctccgtgtagcagccctcgtacggaccttcctaacctttacgacctaaccttcgtagttaccgaggtcgggtccggttccggggccccgccggtacgggtccggggttaccggggggaacgggccggttaggggtacggttcgggttccttacgtaaaggttagtttaggaagttaggaaaggttaaggttggggtaacggaacggtacctaacgtaacgtttaccggttaaaccgggtcggtaacccggtttaccgggtaacggggtaaacccggggttcccggtttaacccaaccccgttacgttaccccgttaacccgaaagggtacttaaaacgtttacgtttaacccggaaggggtaaccgtaccgtaacggtttaacgttacgtttaaaccgtaacgttaaaaacgtaaaacgtacggtaacgtaacgtaaccggtacggaaacggaacccggtaccggggaaacggtacccgtaaaccccggttaccggtttatttaaccggttttcgtaacggggttagtaaaccggttaaacggttactaacgtaacgggaccttacgggtaccccccgtccccgtaacggtaccctttacgtttaacccttttccgtacggttccccggtttggtaacccggggg

SEQ ID NO: 84532 - DNA, 557 bp, Homo sapiens
  misc_feature: GYAE6OF01CX45S.47.46.E02.1.454.CMB.1.raw
  modified_base (202)..(202): a, c, t, g, unknown or other
  misc_feature (202)..(202): n is a, c, g, or t
  modified_base (260)..(260): a, c, t, g, unknown or other
  misc_feature (260)..(260): n is a, c, g, or t
tcagagctcacgtacacgaccggtgctcgatttagactcatctacagggaaagggggaggaactgctcagttaggacccagagggaaccatggaagccccagctcagcttctcttcctcctgctactctggctcccagataccatcggagaagttgtgttgacacagtctccagccaccctgtctttgctccgaggggaaangccaccctctcctgcagggccagtcagaatattcactcctacttagcctggtaccaanagaacctggtcaggctccagctctcatctatgatgcatccaacgacgggccacgtggcactcccaagacaggttcaggtggcgtaggtgggtctgggacacggtacttcacttctccacctatcagcacgcctagacgtccgtagaagtacgtttaggtaccttttattacgttgtacgagtcgagtcgttgtacgttcgtcggccgttccgtcctcgtacgtttcgggcggtacgggccgtagggtcggtagacgtacgaaacgacgtggtcggactcgaccactattctgtcttc

SEQ ID NO: 84533 - DNA, 614 bp, Homo sapiens
  misc_feature: GYAE6OF01EJMFC.47.46.E02.1.454.CMB.1.raw
  modified_base (153)..(153): a, c, t, g, unknown or other
  misc_feature (153)..(153): n is a, c, g, or t
  modified_base (180)..(180): a, c, t, g, unknown or other
  misc_feature (180)..(180): n is a, c, g, or t
  modified_base (184)..(184): a, c, t, g, unknown or other
  misc_feature (184)..(184): n is a, c, g, or t
  modified_base (193)..(193): a, c, t, g, unknown or other
  misc_feature (193)..(193): n is a, c, g, or t
  modified_base (203)..(203): a, c, t, g, unknown or other
  misc_feature (203)..(203): n is a, c, g, or t
  modified_base (207)..(207): a, c, t, g, unknown or other
  misc_feature (207)..(207): n is a, c, g, or t
  modified_base (216)..(216): a, c, t, g, unknown or other
  misc_feature (216)..(216): n is a, c, g, or t
  modified_base (286)..(286): a, c, t, g, unknown or other
  misc_feature (286)..(286): n is a, c, g, or t
  modified_base (317)..(317): a, c, t, g, unknown or other
  misc_feature (317)..(317): n is a, c, g, or t
  modified_base (330)..(330): a, c, t, g, unknown or other
  misc_feature (330)..(330): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcggngtcgtctagtcgtcgtattttaaaggngtcngtgtgagtncatgtgagtngggnactagtacnccgtggggcctgagctctcctgcgcacgctcgtaggctctaccttagccaatctgtgagtggctcggccnccgaggccgttccgggggagggtcgtggggngtggtctgtagtntgtataggagtagtacggagagtcgtactattcgtacggtcgtacgtcggtacggtacggtccgtacacgtctaccgacgaagtactaactagttacgacggacgcgtacgtcgtacgttactactaactaacgtaacgtacgtacgtacgtagacgacgacggacggaccgtacgtacgttacttacgttacgtacggtacgtaacgtaacgtaacgtacgtacgtacgtaccgtcccgacccgtaccgtccgtacttaccttacgttacgttcgtcggtcgg

SEQ ID NO: 84534 - DNA, 647 bp, Homo sapiens
  misc_feature: GYAE6OF01DUIT5.47.46.E02.1.454.CMB.1.raw
  modified_base (203)..(203): a, c, t, g, unknown or other
  misc_feature (203)..(203): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatgtgatgacgcagtctccagccaccctgtctgtctctccgaaggggaaancgccaccatcctccgtggtacgggccgtcagtagtatagcatcaattgcctaggtaccagcagacgaccgtgggcaggcctcccgaggcctcctcatctatgatcgcctccgacgacgggcctacgttcggttcccagccgtaggttcgagtcggcagtcgcgttcgtgggactaggtagtttcacgttcctacctaacctactaccaaaccgcgtacctcgtaccgtacgttacgtaacggttaagttacgtttttacgacttttacggttttaacttacgttcgtactaacgtacgtagttaactactaacgttaacggtcggtaccgtccgttaccgtacccggttaccggaaccgtaacgggacctacggtacgtaacgggtaagttaaacgtaaacgacggttggtacggtacgtacgactaaccgtcgttcgttacgg

SEQ ID NO: 84535 - DNA, 591 bp, Homo sapiens
  misc_feature: GYAE6OF01E0AOK.47.46.E02.1.454.CMB.1.raw
  modified_base (202)..(202): a, c, t, g, unknown or other
  misc_feature (202)..(202): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccgaggggaanagccaccatctcctggtagggccgtcagagtattagcatcaactttgcctggtaccagcagagacctgggcacggctacccaggctcctcatctatgatcgacactaccaacgacgggccaacgtggacctatccccgagaactagggttacaggtcggacgtaggtcgggtcgtaggggacagtactcgactctcacatcagcgacgctagcgctacgaagtacttagtactttagttactgtacgagtcgtacggtcgtacggtacgttccgtcggtccctccggtctaccgtaccggtttccgggaccgggtacggggtaccggtacggggtaggacggtacgtaaccgaaacgtacgttggtacgcgtcggtaccgacgttaccg

SEQ ID NO: 84536 - DNA, 609 bp, Homo sapiens
  misc_feature: GYAE6OF01EB188.47.46.E02.1.454.CMB.1.raw
  modified_base (202)..(202): a, c, t, g, unknown or other
  misc_feature (202)..(202): n is a, c, g, or t
  modified_base (407)..(407): a, c, t, g, unknown or other
  misc_feature (407)..(407): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccgaggggaangccacatctcctggtacgggccgtcagagtattagcatctaacttgcctggtaccagcagagaccgtgggcaggcctccaggcctcctcatctatgatcgccgtaccaccgagggtccctacgttcggtttcccaggtcctaggttcgagtcgggctaggtcgcgtcgtacgggacaggtacgttcactctacaccataccaacncgcctgactagtctagtaagttctttagacttagtttacttacgtgtacgtagtacctaagttctaaccgtaagttaccgtcggtaccctcttacccgtaccggttccggaaccggaaccgggtacacgggtacgtacgggaaactaaacggttaaccgaacgttgggtacgtacgtaccgtacctacccttgttcttaccg

SEQ ID NO: 84537 - DNA, 737 bp, Homo sapiens
  misc_feature: GYAE6OF01CSJCU.47.46.E02.1.454.CMB.1.raw
tcagagctcacgtacacgaccggtgctcgatttagactcatctacagggaaaggggtctgagagaggagcccagccctgggatttcaggtgttttcatttggtgatcaggactgaaccgagagaactcaccagtggagttgggctgagctggcttctttcttgtggttactttttaaaaggtgtcctagtgtgaggtgctaacgtgttggagtcggtggggatacgttagtaccgacccggtcgggggtcctgacgtactctcctgtcgcacgcctcgtcgacctccgtaactttacgacctaactctgtctaggtcgggtccgtcgggtcccgcgacgggtccgggaccgggggaaggtcgtgggtaggttcgggtactacgtaagttataggagtaggaaggtaagtagggtaggaacgactaactacgttacgtacgggtcggtaaccggtccggtaagggtaccgggtcccgttaacaccctacgtacccgtacgagaacgtaacttaagttacggaaggtacgacgtaacgtcttagtaactaactaaacaacgtacgaacgtacgtcgtaggacggacggaaccggacgggaacccgtacggtaccgttagttaacgttcgtagtaccgtaacgtaaacgttacgtaagaccgtcgtaaccgtcccccggaccccgtacgcccgttaacgtttaccttacggtttccgtacggttcccgggtaaccggggg

SEQ ID NO: 84538 - DNA, 692 bp, Homo sapiens
  misc_feature: GYAE6OF01C3BFM.47.46.E02.1.454.CMB.1.raw
  modified_base (158)..(158): a, c, t, g, unknown or other
  misc_feature (158)..(158): n is a, c, g, or t
  modified_base (183)..(183): a, c, t, g, unknown or other
  misc_feature (183)..(183): n is a, c, g, or t
  modified_base (206)..(206): a, c, t, g, unknown or other
  misc_feature (206)..(206): n is a, c, g, or t
  modified_base (258)..(258): a, c, t, g, unknown or other
  misc_feature (258)..(258): n is a, c, g, or t
  modified_base (262)..(262): a, c, t, g, unknown or other
  misc_feature (262)..(262): n is a, c, g, or t
  modified_base (265)..(265): a, c, t, g, unknown or other
  misc_feature (265)..(265): n is a, c, g, or t
  modified_base (290)..(290): a, c, t, g, unknown or other
  misc_feature (290)..(290): n is a, c, g, or t
  modified_base (295)..(295): a, c, t, g, unknown or other
  misc_feature (295)..(295): n is a, c, g, or t
  modified_base (308)..(308): a, c, t, g, unknown or other
  misc_feature (308)..(308): n is a, c, g, or t
  modified_base (370)..(370): a, c, t, g, unknown or other
  misc_feature (370)..(370): n is a, c, g, or t
  modified_base (414)..(414): a, c, t, g, unknown or other
  misc_feature (414)..(414): n is a, c, g, or t
  modified_base (430)..(430): a, c, t, g, unknown or other
  misc_feature (430)..(430): n is a, c, g, or t
tcagagctcacgtacacgaccggtgctcgatttagactcatctacagggaaaggggtctgagagaggagcccagccctgggatttttcaggttgtttttcatttggtgatcaggactgaaccgagagaactcaccatggagtttgggctgagcggtgngtcttagtgtcgtatttttaaaggngtcagtgtgaggtgactatgtgngtcgtgggggagtacttagtacgtacccgtgggggtccctgagtctctctgngcanccncgtagctctaccttagcaaccttgngtacngtggcgtcggccncgtaggcggacggggaggcgtggaggtggtctagagttgtagagtacgaaggatggacgganacctgtactttccgacgtagtaccgtcggtagacgggtcctacnccgtactctagagtanaccgtaattacgaggctcgacgtcctacgttataccttaaagaaacgtacgaacgtacgaaccggttgaacggacggtaaccggaaccggtaaccggtaacccggtacccgtttaagtttaaccgttttcccgtaagggtttacccggaaaaggtaaaccggttaattaacgggtccacgttaacccggcccgttccccccgtacggttacccctaccgtttaacccgtttcgttttcggttccgttcgggtaaccccgggg

SEQ ID NO: 84539 - DNA, 521 bp, Homo sapiens
  misc_feature: GYAE6OF01DT2OD.47.46.E02.1.454.CMB.1.raw
  modified_base (202)..(202): a, c, t, g, unknown or other
  misc_feature (202)..(202): n is a, c, g, or t
  modified_base (226)..(226): a, c, t, g, unknown or other
  misc_feature (226)..(226): n is a, c, g, or t
  modified_base (351)..(351): a, c, t, g, unknown or other
  misc_feature (351)..(351): n is a, c, g, or t
  modified_base (371)..(371): a, c, t, g, unknown or other
  misc_feature (371)..(371): n is a, c, g, or t
  modified_base (389)..(389): a, c, t, g, unknown or other
  misc_feature (389)..(389): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaangccaccatctcctgtagggccgtnagagtatagcatcaacttgcctggtaccagcagagacctgggcaggctcccaggctcctcatctatgatgcgtccacagggccactggttcccagccaggtcagtggcagtgcgtctgggacagngttcactctcaccatcaacngcctgcagtctagaagtnttttgacttagtttattacgtgtcagtcagttatactataacgtggccctctacgtaccgttcggaccaacgggaccacggacgtaggaagtaagttaaacgactggtacggctacgaccacctgttcgtcg

SEQ ID NO: 84540 - DNA, 722 bp, Homo sapiens
  misc_feature: GYAE6OF01ED6D9.47.46.E02.1.454.CMB.1.raw
  modified_base (203)..(203): a, c, t, g, unknown or other
  misc_feature (203)..(203): n is a, c, g, or t
  modified_base (229)..(229): a, c, t, g, unknown or other
  misc_feature (229)..(229): n is a, c, g, or t
tcagagctcacgtacacgaccggtgctcgatttagactcatctacaggggaaagggggaggaactgctcagttaggacccagacggaaccatggaagccccagcgcagcttctcttcctcctgctactctggctcccagagaccactggagaaatagtgatgacgcagtctccagccacctgtctgtctctccgaggggaaancgccacatctcctggtacgggccgtnagagttattagctatacaacgttagccgttaggtaccagcaggacgaccgtgggcaggcctccgaggtcctcctcattctatgagtcggccgtaccgaccgacgggtcctacgtttcggttaccccaggtccgtaggttcgaggtcggacgtaggtcggtcggttacgtacggggaactacggttacgtttaccaccgttacctacccaacccgtacttaacccgaaacgtccggcccttacggactaggttaccgtaaggtaaagtttacgttttcgacgtttaagtttttaacttacgtcgtactacgtacgttaacgttactaacctaacgttaaccggtccggtacccgttaccttacccggttaacccggttaccggggaaacccgtaaacggggacccgtaaacggtacggttaaagggtaacgttaaaacggtttaaacggacggttcgggtaacggtctacggaccctaactgtttccgttaacg

SEQ ID NO: 84541 - DNA, 754 bp, Homo sapiens
  misc_feature: GYAE6OF01CABFM.47.46.E02.1.454.CMB.1.raw
  modified_base (203)..(203): a, c, t, g, unknown or other
  misc_feature (203)..(203): n is a, c, g, or t
  modified_base (230)..(230): a, c, t, g, unknown or other
  misc_feature (230)..(230): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccgaggggaaancgccaccatcctcctggtagggccgtnagagtatagcatcaacttgcctggtaccagcagagaccgtgggcaggcctcccgaggcctccgtcatctatgatcgcgtcccaccgagggccctacgttcggtttaccccaggtcccgtagggtttccaaggttggctagggtcgacggtcgtggggactaggtacgtttccaacttctaccgaacctataccaaccgacgtcccttacggacgtagttaccgtagtaaaggtttacgtttttacgacgtttaacggtttttaatttaaccgttcgttaccgtaacggtaccgtaaggtttaaccttacgtaaacgtttaaccggttacgggtccccgttaacgttacccgttacccggtttacccgggtaacccggtaaaaccgggggtacccgtaaacccgggtaaccgggttaacggggtaaacgttaaaacggtttaaaaacccgggtaaaccggttacggggttacgggtaacccggttacggaacccgtaaacccgttaagttttaacccggttccgg

SEQ ID NO: 84542 - DNA, 568 bp, Homo sapiens
  misc_feature: GYAE6OF01BQRZC.47.46.E02.1.454.CMB.1.raw
  modified_base (203)..(203): a, c, t, g, unknown or other
  misc_feature (203)..(203): n is a, c, g, or t
  modified_base (319)..(319): a, c, t, g, unknown or other
  misc_feature (319)..(319): n is a, c, g, or t
  modified_base (356)..(356): a, c, t, g, unknown or other
  misc_feature (356)..(356): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccgaggggaaangccaccctctcctgcagggccagtcaggagtgttggcagcaactacttagcctggtaccagcagaaatctggccaggcctcccgaggcctcctctatttagtggtacatacaacgngggaccacgtggacactcccagaccagattcgagcgnacgtgagtcgtagggacagaccttcacttctcaccatacacgcacgtactacggacgcctagaacgtatttacgactagtatactactgtactagactagtagttacggttggacacgttttagacggtcgttacggaccgtaacgggaccggtaaggggtaggtaaacgtacgtaaacggacgtaacgtacggtaggcgtcgccgtaaccg

SEQ ID NO: 84543 - DNA, 702 bp, Homo sapiens
  misc_feature: GYAE6OF01DHWTL.47.46.E02.1.454.CMB.1.raw
  modified_base (391)..(391): a, c, t, g, unknown or other
  misc_feature (391)..(391): n is a, c, g, or t
  modified_base (417)..(417): a, c, t, g, unknown or other
  misc_feature (417)..(417): n is a, c, g, or t
tcagagctcacgtacacgaccggtgctcgatttagactcatctacagggaaaggggtctgagagaggagcccagccctgggattttcaggttgttttcatttggtgatcaggactgaaccgagagaactcacatggagtttgggctgagctggcttctttcgttgtggtactttttaaaaggtgtcagtgtgaggtgcaagtgtggagtcgtggggatacgttagtaccgaccggtgggggtccctggacgtactctccgtgtcgcacgtcctcgtcggtacctccttaaccgtttagacctaacttctagtccgagtcgggtcgtcgggtcccgcgacgggtcgggtaccgggggaagggtcgtagggtaggtcgggtctacgaaagttntagtagtggaagtagtggaggaaacncaagtacgtttacgtacggtaggtaccgtaccggtaggaaaccgggtccgttacaaccgtactccgaacgaaggtacgtaacgtaacgttagaacggtacgacgtacgtcgtacgtaactaacgtaaacaaagtacgaacgacgtacgagaacgacggaccgacggacccggtaacggtaccgttaattacgttacgtacgtagtaacgtaacgtagtaacgtcacgtacgtcccgaccccgtacgccgttacctactttctttcggtacgttcgggtaccgggg

SEQ ID NO: 84544 - DNA, 723 bp, Homo sapiens
  misc_feature: GYAE6OF01AWFYB.47.46.E02.1.454.CMB.1.raw
  modified_base (201)..(201): a, c, t, g, unknown or other
  misc_feature (201)..(201): n is a, c, g, or t
  modified_base (230)..(230): a, c, t, g, unknown or other
  misc_feature (230)..(230): n is a, c, g, or t
  modified_base (308)..(308): a, c, t, g, unknown or other
  misc_feature (308)..(308): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccacctgtctgtctctccgaggggaangccaccattctccgtggtacgggccggtnagtagtattagcatcaacttagcctaggtaccagcagacgaccgtgggacaggcctacccgaggtcctcctcatctangatcgccgtaccaccgacgggcctacgttcggtttacccagtccctaagggttcaggtcggactaggtcgacggtcggtagggactaggtacgttccacgttcctaccgaccttataccaaaccgacgtccgttcgactacggttaccgttaaggtaaacgtttgtttttacgaacgttttaagttttaaccgtttacgttacgtacgtaacgtaccgtaagtttacctaacgttaacgttaaccgggttcgggtaccctaccgttaacccgttacggttaccccgggtaaccggaacggggtaaccctaaccgggtacggttaacgggtaaaccgttaaaacggttaaacccggaggtttacgggtccgggtaaccttaaccggaacccgttaccttaacggttctttacccgg

SEQ ID NO: 84545 - DNA, 811 bp, Homo sapiens
  misc_feature: GYAE6OF01B3AQZ.47.46.E02.1.454.CMB.1.raw
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggtactttttaaaggtgtccagtgtgaggtgcaactgttggagtcgtgggggatacttagtaccacccgtgggggtccctggacgactcctcctgtcgcagcctcgtcggacctccgtacctttagacctaacctctgtcagttgggcgtcgggtcccgccgagggtccggtaccggggggaacggggtcgtggggaggttcgggtctacgtaagttattggaagttaggaagtaaggtggtaagggaacgtctaactacgtttaccgtaacggtcggtaccgtttccggtaggggtaacccggggtcccgttacacccgtacttcccgtaccgaaggaaccgtaactaacgtttacgaacggtacgaccgtaacggtcttacggttaacttaacccgttaaaacgaaacgttaccggtaaacctacggttacgtaacgggaacggaccggtaacccgggaacggtacccgtaaccgggttaacccgttaatttaccgtttaccgttacggtacggttaaccgtaaacgttccgttaaacggttaccggaccgttaacccgggttcccccgaacccccttaaccgggtccccgtacctttacccgttttacccgtttacgtacccggttttccgggtaacccggggg

SEQ ID NO: 84546 - DNA, 708 bp, Homo sapiens
  misc_feature: GYAE6OF01CAX1D.47.46.E02.1.454.CMB.1.raw
  modified_base (201)..(201): a, c, t, g, unknown or other
  misc_feature (201)..(201): n is a, c, g, or t
  modified_base (225)..(225): a, c, t, g, unknown or other
  misc_feature (225)..(225): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccacctgtctgtctctccgagggaaangccacatctcgtggtacggccgtnagtagtatgcatcaacttgcctggtaccagcagagaccgtgggcacggcctcccgaggcctcctctactctatgactcggcccgtaccgaccgacgggtccaacgttcggtttacccgacgtccgtaggttcgaggtggtacgtaggtcggcgttcgagggaacgtagtacgttccacttctacctaacctataccaacgtacgtcctacgcgtacgttaccgtagtaaacgtttcttttacggtactttaacgttttaacgttaccgttcgttaacgacgtacgtaacggtttacttaaccgtaacgttaacccggtcgggtaccccgtaccgtttacccgtacccggttacccgggaacccgaaacgggggtaaccctaacccgggtaaacggttacggggtaaacgtaaacggttaaaaaccggtaccggttacggaaccgggttctaccgggtaacctaccgttaacgttccgttaccg

SEQ ID NO: 84547 - DNA, 756 bp, Homo sapiens
  misc_feature: GYAE6OF01CKBKL.47.46.E02.1.454.CMB.1.raw
tcagagctcacgtacacgaccggtgctcgatttagactcatctacagggaaagggggaggaactgctcagttaggacccagagggaaccatggaagccccagctcagcttctcttcctcctgctactctggcctcccagataccatcggagtaagttgtgttgacacagtctccagccaccctgtctttgtctccgaggggaaagacgccacctctcctcgcagggccagtcagagtattagcagactaactacgcctcggtaaccagactaaggaaaccgtggggacaacgggcctacccgaggccctccgtacacgttctagttcggggtcaccacgtaccccgaacccggacggggtccctaacgttcgggtaactccccgagtaccgtagggttcaaggtcggcgtagggttcggggtcgtagggacaggtacgtttccacgtctaccaacctagtacacgccgtacgcctacgactcggttactaagttaagtaacgttttgactttaattttacgttactacgtacgtaacgtacgtaaagttaacgttaaacttaacgtcgggtaccctttaccggtaccggttccggggtaaaccgtaaccgggggtaacctaaaccgggacggtaaacgggaaacggttaaaaaccgttaaaaccgggtaacgttacgggttccgggaacttaccggtaaaccccggtaaacctttaccggttaccgttttccgggtaaccttttacccgtaacccg

SEQ ID NO: 84548 - DNA, 756 bp, Homo sapiens
  misc_feature: GYAE6OF01AWXGU.47.46.E02.1.454.CMB.1.raw
  modified_base (221)..(221): a, c, t, g, unknown or other
  misc_feature (221)..(221): n is a, c, g, or t
  modified_base (233)..(233): a, c, t, g, unknown or other
  misc_feature (233)..(233): n is a, c, g, or t
tcagagctcacgtacacgaccggtgctcgatttagactcatctacagggaaagggggagaactgctcagttacggacccacgagggaacctatggaagtccccagtctcagcttctcttcctcctgctactctgctccagtataccatcggagtaagttgtgtttgacacgtagttactccacgcccacccgttgtcctttgtcctaccgagggggtaaancgtccacccgtntcctgcacgggccagtcagtaatacttccacttcctactacgcctaggaccaacacgtaaacctggtaccacggtcctacccgaggtccttccgtactacgtcctaagtcgtacgtcggactacgtccaaagtcgggaccacgtggacacgtacccaggtaccgtaggttcgaaggtcggactaaggttcggggtacgtacggggactacggtacttacgaccgttcctaccgacctacgttccaagtccgaacggtaccttaacggaccgtaccgtacggtaaacgttacgtttaacgggttaacttttacgttaaccgttacggttaccgtaacggtaccgtaaggtacgttacggttacgtttcccgtaccgggttcccccgtaccgttcccttacgttaccggtttaccgggaccgggtaacgggtacccggtaaggggtacccggtaagtaaccgtaaccgaaacggtacgttcggtacgtccgtcgtacctactaacgtccgttcggttccttaccg

SEQ ID NO: 84549 - DNA, 609 bp, Homo sapiens
  misc_feature: GYAE6OF01AWQBT.47.46.E02.1.454.CMB.1.raw
  modified_base (306)..(306): a, c, t, g, unknown or other
  misc_feature (306)..(306): n is a, c, g, or t
  modified_base (338)..(338): a, c, t, g, unknown or other
  misc_feature (338)..(338): n is a, c, g, or t
  modified_base (462)..(462): a, c, t, g, unknown or other
  misc_feature (462)..(462): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcgtggctctttcttgtggtcttttttaaaaggtgtccagtgtgaggtgcaactgttggagtcgtgggggagacttagtacacccgtggggggtccctgagactctcctgtgcagcctctggactcacctttagcaactctgtcatgggctgggtccncaggccgtcgggggaagggctggagtggtctnaagtatgatgagatggtggaagcacgtattcgtacggtggtactccggtaggaacggggtcccggttacaccgatcctccaagacgtactaagtttcgaggacgcaacgcttagtatacctaanaaatgaaccagtctagaagacgaccggaggaccgtacgggtcctaagttatttcgtgtacggacgtaaaggtcttaagtacgcctagtcccgaccccccttaggacccgtcctaaccttttccttacgtccgtttcggtaccggggg

SEQ ID NO: 84550 - DNA, 695 bp, Homo sapiens
  misc_feature: GYAE6OF01C50XL.47.46.E02.1.454.CMB.1.raw
  modified_base (204)..(204): a, c, t, g, unknown or other
  misc_feature (204)..(204): n is a, c, g, or t
  modified_base (298)..(298): a, c, t, g, unknown or other
  misc_feature (298)..(298): n is a, c, g, or t
  modified_base (314)..(314): a, c, t, g, unknown or other
  misc_feature (314)..(314): n is a, c, g, or t
tcagagctcacgtacacgaccggtgctcgatttagactcatctacaggggaaagggggaggaactgctcagttaggacccagacggaaccatggaagccccagcgcagcttctcttcctcctgctactctggctcccagagaccactggagaaatagtgatgacgcagtctccagcccacctgtctgtctctccgaggggaaancgccaccatcctcctggtacgggccgtacagtagttatagcatactaacttgccgtaggtaaccagacaggacgaccgtgggcgaggcctccgnggtcctcctcatctangatgacactaccaacgacggaccacgtcggacactcccgacgtaccgtaggttcgaggtcggacgtagtcggagtcgtacggggaacacggtaccttacaccgtcctacctaccctattaccgacgtacgacggtacctaacgtaccggaccttaggtaacgttacttttacgtacctttaacctttttaacgttaccttcggtactaacggtcgtaacggtaccgttacggaaccgttaccgttccggtcccttacgttacccggttaccgggttaccggggaccgggtaccggggttaaccgggtaggggttaacgggaaggttaccggttaacggaacggtaccggttaacggttgggtacggcgttaccgtaacccg

SEQ ID NO: 84551 - DNA, 944 bp, Homo sapiens
  misc_feature: GYAE6OF01BY74K.47.46.E02.1.454.CMB.1.raw
tcagagctcacgtacacgaccggtgctcgatttagactcatctacagggaaaggggtctgagagaggagcccagccctgggattttcaggtgtttcatttggtgatcaggactgaaccgagagaactcacatggagtttgggctgagctggctctttctgtggtactttttaaaggtgtccagtgtggaggtgcaacgttggttgggagttcggtgggggagtacgttaggtaccgacccggttggggggtccctggacgtactctccgtgtacgctacgtcctcgtacggaccttcctaaccgtttacgacctaaccttccgttaggttaccgtaggttcggggtccgttccggggtccccgccgggtacgggtcccgggtaaccggggggaacggggtccgtaggggtacggttcggggtacctacggtaaggttacgtttaggaaggttaggaaggtaaggttggggtaacgggaaacgtaccgtaacgttacgtttaccgtaacgggtaccggtaaccgtttaccggggtacgggtaaaccgggggttaccccgtttaccgaacccgttacgttacccgtaccgtaacggtaaccggttaaaccctttaaggtttacccggaaacgggtaccgaccgtaaccggtaacgttacggttaaccttaaccgtaaacgtaaagttaccgtaaacgttacggttacggtacgggaacggaccggaacccgggacggggtaacccctaaccgggtccttttaaagtttacccggtttacggtaacggttacgggtaaacccgtttaaacggttcgttaaacgccgggttaaccggttacccgggtcccccccgttaacccccccgggttagacccccggttttaaccttacccgggttttaaccgtttcccgggtaaccccgggtttcggggttaaccccgggggg

SEQ ID NO: 84552 - DNA, 907 bp, Homo sapiens
  misc_feature: GYAE6OF01EX649.47.46.E02.1.454.CMB.1.raw
tcagagctcacgtacacgaccggtgctcgatttagactcatctacagggaaagggggctctgagagaggagcccagccctgggattttcaggtgttttcatttggtgatcaggactgaaccgagagaactcaccatggagtttgggctgagctggctctttcttgtggtctttttaaaaggtgtccagtgtgaggtgcaactgttggagtcgtgggggagtacttagtacacccgtcggggggtccctgagactcctcctgtgcagtcctcgtcggactcctaccgtttagacctaacttctcgtctagtcgggcgtcgggtcccgccgacgggtccggtaccggggggaagggggtccgtaggggtacgggtcggggtaccttacggtaacggttagtttagggaacttagggaaaggtaaaggttgggggtaacggggtaaacgtaccgaacgttaacgtttaccggtaaccgggttacgggtaacccgttacccgggggttaacgggtaaacccggggggttcccccggggtttacccaaccccggttaaccttaccccggttaacccgaaacgggaaacggttaacccgttaaacgtttttccggaaacggggtaacgtacccgtaacccggttaccgtttacgggttaaacctttaaccgttaaaacccgtaaacgtttaaccggaaaacctaaccgggtacccggttaaggaaaccgggtaaccgggaaccccggaacgggtaaccggtaacccggggttaccgtttaagtttaaccgttttcgtaggtaaccgggtaaacggtaaaacgttaccgttaacgtaacggaccgttaccggtaccccgtacccccgtaccgtcccgttacctaccgttttccgtttagtcccggttaccgggg

SEQ ID NO: 84553 - DNA, 638 bp, Homo sapiens
  misc_feature: GYAE6OF01C7FX1.47.46.E02.1.454.CMB.1.raw
  modified_base (201)..(201): a, c, t, g, unknown or other
  misc_feature (201)..(201): n is a, c, g, or t
  modified_base (208)..(208): a, c, t, g, unknown or other
  misc_feature (208)..(208): n is a, c, g, or t
  modified_base (223)..(223): a, c, t, g, unknown or other
  misc_feature (223)..(223): n is a, c, g, or t
  modified_base (226)..(226): a, c, t, g, unknown or other
  misc_feature (226)..(226): n is a, c, g, or t
  modified_base (232)..(232): a, c, t, g, unknown or other
  misc_feature (232)..(232): n is a, c, g, or t
  modified_base (268)..(268): a, c, t, g, unknown or other
  misc_feature (268)..(268): n is a, c, g, or t
  modified_base (279)..(279): a, c, t, g, unknown or other
  misc_feature (279)..(279): n is a, c, g, or t
  modified_base (287)..(287): a, c, t, g, unknown or other
  misc_feature (287)..(287): n is a, c, g, or t
tcagagctcacgtacacgaccggtgctcgatttagactcatctacagggaaagggggagggaactgctcagttaggacccagacggaaccatggaagccccagcgcagcttctcttcctcctgcctactctggcctccagagaccactggagaaatgtgatgacgcagtctccagcccacctgtctgtctctcgagggaancgccacntctctgtacggcgtnagngtatgnatcaattgctagtacagcagagaccgtggcacggcnccgagctcctntacgtctntgagtcgaccgtccgacgcggtacctcgttcggttcccgacgtccgtagttcgaggtcgctaggtcgtacggtcgtagggactagtcgttacacgtctacactacgtacacctacgtcctagctacgttcgtagttaacgttgttttacgcgtttaagttttacgtacttacgtacagtaacgtagttactaacgttacgtaacgttccggtacccgttacgttacccgtaccgggtaccggaaccgtaagggaccccgtaaggaaccggttacggaacgttaaacggttaaaaccgtaccggttacgggtcgttacccgacgttaaccaccgttacgttcccgttacccg

SEQ ID NO: 84554 - DNA, 604 bp, Homo sapiens
  misc_feature: GYAE6OF01ERJMH.47.46.E02.1.454.CMB.1.raw
  modified_base (202)..(202): a, c, t, g, unknown or other
  misc_feature (202)..(202): n is a, c, g, or t
  modified_base (229)..(229): a, c, t, g, unknown or other
  misc_feature (229)..(229): n is a, c, g, or t
  modified_base (414)..(414): a, c, t, g, unknown or other
  misc_feature (414)..(414): n is a, c, g, or t
  modified_base (421)..(421): a, c, t, g, unknown or other
  misc_feature (421)..(421): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagcccacctgtctgtctctccgaggggaangccacatctccgtggtacgggccgtanagtagtatagctatacaacttagcctaggtaccagcagagaccgtgggcaggcctcccgaggtcctcctcgactctagtgatcggccgtaccaccgacgggccctacgttcgggttacccagtccgtaggttccaggttcggctaggtcgcgtcgtgggacagtacgttcacctgtaccacctanaccaacncgcctgactagtactagtaagttatttacgacttagtttactagttcgtactagtctagtactacaacgtaacgtccggtacctcttaccgaccgttacggaccgaacgggacctaacggtacgtacgggtaagtaaacgtaaaccggtacggtggtacgtcacgtaccactcgtcgttaccg

SEQ ID NO: 84555 - DNA, 759 bp, Homo sapiens
  misc_feature: GYAE6OF01CN6NR.47.46.E02.1.454.CMB.1.raw
  modified_base (149)..(149): a, c, t, g, unknown or other
  misc_feature (149)..(149): n is a, c, g, or t
  modified_base (188)..(188): a, c, t, g, unknown or other
  misc_feature (188)..(188): n is a, c, g, or t
  modified_base (197)..(197): a, c, t, g, unknown or other
  misc_feature (197)..(197): n is a, c, g, or t
  modified_base (218)..(218): a, c, t, g, unknown or other
  misc_feature (218)..(218): n is a, c, g, or t
tcagagctcacgtacacgaccggtgctcgatttagactcatctacaggggaaaggggggaggaactgctcagttaggacccagacggaaccatggaagccccagcgcagcttctcttcctctgctactctggctccagagaccatgganaaatgtgatgacgcagtctccagccacctgtctgtctcncgagggaancgcacatctcgtgacggcgtnagtagtattcgctatcaacttcgccgtagtaccagacacgagtacgtggacgacggcctaccgaggtcctcctcacgttactagtcgagttcgaccgtaccgaaccgacgggtacctacgttcggtttacccgagtccgtaggtttccaagggtcgacgtagtcggtaccggtcgtagggacctaagggtaccgtttacgactcctaacccgacctaacccgaacctacgccgtagtactacggtacgttacgtaaagttaacgttttcgaagtttaacgttttacgtttaacgttacgtacctaaagtaacggtttaaaacccgttaacgttaaccggttaccggtccccggttaacccgttacccggtttaccgttacccgggttttaacggggacgggggttaaaccgggaaccggggttcgggggtaaacggtacggtaaaccggttaaacgggaaacccggtttaaggttcggttaccgggtaaccggtctacccggtaaacgttaccgttaaccgttcgtttaaccgtttacccg

SEQ ID NO: 84556 - DNA, 629 bp, Homo sapiens
  misc_feature: GYAE6OF01B9CEH.47.46.E02.1.454.CMB.1.raw
  modified_base (338)..(338): a, c, t, g, unknown or other
  misc_feature (338)..(338): n is a, c, g, or t
  modified_base (477)..(477): a, c, t, g, unknown or other
  misc_feature (477)..(477): n is a, c, g, or t
  modified_base (483)..(483): a, c, t, g, unknown or other
  misc_feature (483)..(483): n is a, c, g, or t
  modified_base (549)..(549): a, c, t, g, unknown or other
  misc_feature (549)..(549): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcgtgcgtcttacgtggtgtactttttaaaaggtgtcagtgtgaggtgacaactgtggagtcgtggggagactagtacgacccgtgggggtcccagtagctctcctgtgcacgcctctggactccacttagcaactctgtcagtggctggtccgccgaggcggtccggggagggtcgtggaggtgggtcntaaggtatagtatggagaagtgggtacgagcatacttacgtacgtgacgtcgtaggaacgggtccgtacgacctactctccgaagacgaacctagttacgaggacgcgaacgtctgtactacgtaacaaatacgaaccngtacgngaacggacgaccggtaaggaccgtaggtacccgtaatttactccggtagtagaacggtaaacgttnaaaggttacgctaccggtcccgacccccgttaagccctaaccggtacttttggttaaccgccgttttacggacccggggg

SEQ ID NO: 84557 - DNA, 650 bp, Homo sapiens
  misc_feature: GYAE6OF01A9QLB.47.46.E02.1.454.CMB.1.raw
  modified_base (203)..(203): a, c, t, g, unknown or other
  misc_feature (203)..(203): n is a, c, g, or t
  modified_base (233)..(233): a, c, t, g, unknown or other
  misc_feature (233)..(233): n is a, c, g, or t
  modified_base (424)..(424): a, c, t, g, unknown or other
  misc_feature (424)..(424): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccgaggggaaancgccaccatcctcctggtaggggcccggtnagtagtattagcatcaacgttgcctggtaccagcagacgaccgtgggcacggcctcccgaggcctcctcatctatgatcgccgtccaccgacgggcctacgttcggtttccccacggtccgtaacggtttcaaggtcgggctaggtcggcgttcgtgggacctagtacgttccacgtcctaccaaccctanaccgaacgacgtccgtgcgtagtcgtagtaagtttagttttacgtactttagttttacttacgttgtactacgtacctagttactactaagttaaccgtcgggtacctacctacccgtaccgttaccggaccgtaacgggaccaccgtaacgtagggtaacgttaacggtaaaccggtacgttagggtacgtccgttacgacccgtaaccgttagttcgtttaccg

SEQ ID NO: 84558 - DNA, 750 bp, Homo sapiens
  misc_feature: GYAE6OF01BIS12.47.46.E02.1.454.CMB.1.raw
  modified_base (358)..(358): a, c, t, g, unknown or other
  misc_feature (358)..(358): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggtctttttaaaaggtgtccagtgtgaggtgcaacgtgttggagtcgtgggggatacgttagtacacccgtgggggtccctggagactctcctgtgcacgcctcgtcgtactctacctttacgcaactctagtcagtggcgtcgggtcccgcgacggccggtccggggaaggcgtggcggtggtctacgaagtntagagtagagtaagtggtaggaagtcgaactagttcgtaacggtcggtaaccgtccggtagggtaaccgggtcccggttacgaccctagtccgaccgtaagacgttaactacgttacgagacgaccgtacgtctagttaactacgtaactaaacgtcgaaaccgtcgtacctaggaacggacggaacccgggaaacgggtaacccggtaaccgggtaccgtttaattaccggttttaccggtacgggtacgggtaaaccgttaaaaggttacccgtaacgggttaaacgcccggttaaaccggtacccccgaaccccccggttacggtaccggttaccccttaccggtttttaccgttttaacccggtaccgtttcccgggtaaaccggggg

SEQ ID NO: 84559 - DNA, 458 bp, Homo sapiens
  misc_feature: GYAE6OF01BCMGB.47.46.E02.1.454.CMB.1.raw
  modified_base (231)..(231): a, c, t, g, unknown or other
  misc_feature (231)..(231): n is a, c, g, or t
  modified_base (394)..(394): a, c, t, g, unknown or other
  misc_feature (394)..(394): n is a, c, g, or t
  modified_base (433)..(434): a, c, t, g, unknown or other
  misc_feature (433)..(434): n is a, c, g, or t
  modified_base (438)..(458): a, c, t, g, unknown or other
  misc_feature (438)..(458): n is a, c, g, or t
tcagagctcacgtacacgaccggtgctcgatttagactcatctacaggggaaagggccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtcgtgggacagagttcactctcaccatcaacngcctgcagtctagaagattttgctagtttattactgttcagtcagtatacataactcggccgcttccaccgttcggaccgaagggacacgactggaagtaattaaacgacttggtggctgaccactatctgtcttcactccttacccgctatctgactacgtnagtctgtgcggccgggtcgcggacgaaggcgactagtgnngacnnnnnnnnnnnnnnnnnnnnn

SEQ ID NO: 84560 - DNA, 753 bp, Homo sapiens
  misc_feature: GYAE6OF01C1BHV.47.46.E02.1.454.CMB.1.raw
  modified_base (156)..(156): a, c, t, g, unknown or other
  misc_feature (156)..(156): n is a, c, g, or t
  modified_base (209)..(209): a, c, t, g, unknown or other
  misc_feature (209)..(209): n is a, c, g, or t
  modified_base (241)..(241): a, c, t, g, unknown or other
  misc_feature (241)..(241): n is a, c, g, or t
tcagagctcacgtacacgaccggtgctcgatttagactcatctacagggaaagggggagaactgctcagttaggacccagacggaaccatggaagccccagcgcagccttctcttcctcctgcttactcgtggcctcccagacgacccagtggaanaaatgtagatgacgcagtcctccagcccacctgtctgtctcacggaagggaancgtccactagtcctcgtgggtacgggccgtanaaggtattagtacgctaacgtacctaaacgttcgccgttaggaaccagacgacggacgtaccgtgggcacggtccctaccgacggtcctacctacacttactagttgactccgccgtacccgaaccggacggtcccgtaccgtttccggttacccgacggtaccgtaacggttcgaaggtcggacgtagggtcgtcggtcggtacgggactaggtacgttccaccttaccacctaccgtactaacccgaaccgtaccggtcctacggtaaccgtaggtttacgtaaggttaagtttacgtttcgtaacgttttaagtttaccgttacgttacggtactaggttaacgtaacggttactaactaaccgtacggttccgtacccgtaccttaccggtaaccccggtacggaaacccgggtacggaacccgtaaggtaacggtaacgggttaaaactaaacggttaaacggacgttggaacggtcctacgaaccctaaccgttgtccgtttaacc

SEQ ID NO: 84561 - DNA, 423 bp, Homo sapiens
  misc_feature: GYAE6OF01B7SEW.47.46.E02.1.454.CMB.1.raw
  modified_base (384)..(384): a, c, t, g, unknown or other
  misc_feature (384)..(384): n is a, c, g, or t
  modified_base (409)..(423): a, c, t, g, unknown or other
  misc_feature (409)..(423): n is a, c, g, or t
tcagagctcacgtacacgaccggtgctcgatttagactcatctacaggggaaagggccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagtattttgactaatttattactgtcagcagtataatactggcctcgcttcggaccaagggacacgactggaacgtaattaaacgaacgtgtgctgaccacatctgtcttcattcctcccgctatctgatacgtgactctnggagcggtctggcaaggcacatagnnnnnnnnnnnnnnn

SEQ ID NO: 84562 - DNA, 715 bp, Homo sapiens
  misc_feature: GYAE6OF01E1878.47.46.E02.1.454.CMB.1.raw
tcagagctcacgtacacgaccggtgctcgatttagactcatctacaggggaaagggggaggaactgctcagttaggacccagacggaaccatggagccccagcgcagcttctcttcctcctgctactctggctcccagagaccactggagacatttgttttgacacagtctccagcccaccctgtctttgtctccgaggggaaagacgcccaccctctcctgcgagggccagtcagagtgttggcagctacttagcctaggtaccaacacgaacctggccaggcctcccaggcctcctcatcttaactgatcgactaacaccgaacgacggtccacgtcggacctacgtcccacggtaccgtacggttccgaggtggaccgtgggtacggtacggttacggtacggggactaacggtacctttaccctaacctcccttaacccaccgtaacgtccgaccgacgtaccggtaaccgtacggtacgtaccgttaaggtaagttttactttacggtatttaaccgtttattacgtacgttcacgttactacgttaactacgtaacttacggcccgttacccgtccgttaacccggtttacccgaccgggaaccggtaaccggaaccgtaacccggagttaaccggtaaacgtaaacggtttaaaacgccggttagggtacgtacccgtacgaaccctacttaacgtcccttttaccgg

SEQ ID NO: 84563 - DNA, 597 bp, Homo sapiens
  misc_feature: GYAE6OF01A54U8.47.46.E02.1.454.CMB.1.raw
  modified_base (372)..(372): a, c, t, g, unknown or other
  misc_feature (372)..(372): n is a, c, g, or t
  modified_base (486)..(486): a, c, t, g, unknown or other
  misc_feature (486)..(486): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcgtggcgtcttacgtgtggctttttaaaaggtgtccagtgtgatgtgcaactgttggagtctggggagacttaggtacacccgtggggggtccctgagactctcctgtgcagcctctggactcacctttagttcctcttggatgaattgggtccgccagacctccgaggggaagggctggagtgggttggcaacataaatccagatggaatcaagaaaacctntgttaggactctcgtgaacgggccgtattccaccagtcctacagagaccaacgccaaagaactctcttgtttcaggactaaagtgaacacgccgtagacgagtacgaagaccgngtcttggtattatactgtgtctctcgttcgaccgtcgtccgggcccggttaccttcggttccttcgggtccgggggtacccttcgggggtaaccccgttgggttacccccg

SEQ ID NO: 84564 - DNA, 580 bp, Homo sapiens
  misc_feature: GYAE6OF01DMB6F.47.46.E02.1.454.CMB.1.raw
  modified_base (286)..(286): a, c, t, g, unknown or other
  misc_feature (286)..(286): n is a, c, g, or t
  modified_base (377)..(377): a, c, t, g, unknown or other
  misc_feature (377)..(377): n is a, c, g, or t
  modified_base (408)..(408): a, c, t, g, unknown or other
  misc_feature (408)..(408): n is a, c, g, or t
  modified_base (443)..(443): a, c, t, g, unknown or other
  misc_feature (443)..(443): n is a, c, g, or t
  modified_base (465)..(465): a, c, t, g, unknown or other
  misc_feature (465)..(465): n is a, c, g, or t
  modified_base (467)..(467): a, c, t, g, unknown or other
  misc_feature (467)..(467): n is a, c, g, or t
tcagagctcacgtacacgaccggtgctcgatttagactcatctacagggaaaggggtctgagagaggagcccagccctgggtatttttcaggttgtttttcatttggtgatcaggactgaaccgagagaactcaccatggagtttgggctgagcgtgtcgtcgttagtcgtcgtattttaaaggtgtcagtgtgaggtgcagtgtggagtgtggggatacttagtacgcccggtgggggtcctgacgtcctctcgtgtgcacgcctctcggacttccgtactttanctactcgttgtcagtcggcgttggccgcgcggtcgggacgggaggcgtggacgtggtctgtagtagttgagtgaagagtggaggactacgnttagtcgtgacgtcgtcgtgggacgtctacncacttcgacagtataccttagcgacgactcgactnttacatactaagaactacgacncncgagacgcgacgacgacgtacgtcgttcttactcgtagtacgtacgtacgtagtacgtacgtacgtccgtcccgtaccgtccgtctcttacgttacgttcgttcgtcggtcgg

SEQ ID NO: 84565 - DNA, 754 bp, Homo sapiens
  misc_feature: GYAE6OF01A3QMW.47.46.E02.1.454.CMB.1.raw
  modified_base (220)..(220): a, c, t, g, unknown or other
  misc_feature (220)..(220): n is a, c, g, or t
  modified_base (298)..(298): a, c, t, g, unknown or other
  misc_feature (298)..(298): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcgtggcgtcttacgttgtgtactttttaaaggtgtccagtgtgaggtgcaactgttggagtcgtggggganacttagtacacccgtggggggtccctgagactctcctggtgcagcctcgtggactctactttagactaactctgtccngtcgggccgtcgggtcccgaccgacgggtccggtaccggggggagggtccgtaggggacggttcgggtactacgtaagttagttggtagtaggaagtaaggtgggtaggaaacgtcgtaaccgtagttaccggtaacggtcgggtaaccgttaccgggtagggtaaccggggtcccggtttaccacccggtactcccgtaccgaacggtacgtaacttaacgtttccggaagggtcaaccgtcggtacttaggttaacctacctaaaagtaacgttacgaaacggtctaccgtaggaacgccggtaaccggaggtaccgtccgggtacctttagttacttaccgtgaacgggtaacgtaaacggttctaaggtactacccggacggtcccccgtaacccccggtgttccgtaaccctttacggtttcgtacccggttacgttccggggtaccgggg

SEQ ID NO: 84566 - DNA, 625 bp, Homo sapiens
  misc_feature: GYAE6OF01AZ5JJ.47.46.E02.1.454.CMB.1.raw
  modified_base (205)..(205): a, c, t, g, unknown or other
  misc_feature (205)..(205): n is a, c, g, or t
  modified_base (399)..(399): a, c, t, g, unknown or other
  misc_feature (399)..(399): n is a, c, g, or t
  modified_base (436)..(436): a, c, t, g, unknown or other
  misc_feature (436)..(436): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggcctcccagagaccactggagaaatagtgatgacgcagtctccagcccaccctgtctgtctctccgaggggaaangccacatctcctggtacggggccgtcagagttattagctataccaacttagcctggtaccagcagacgacgtgggcaggcctcccgaggtcctcctcattctagtgacgtgccgtccacgacgggcctacgttcggttacccagtccgtaggttcaggtgctaggtcgcgtcgtagggacaggtactctactcncacactacacgtacgctcgctacgtactagtaagttntttacgactttagtttacttagtcgtacacgtacgtagttactacgtaagttaccgtccggtccctcccgttaccgtaccggttaccggaccggtaaacgggtccgaaccggttacggtagggtaaccgttaaagtaaacccggttacgtcggttacggaccgttacgactacccgtcttggttacccg

SEQ ID NO: 84567 - DNA, 766 bp, Homo sapiens
  misc_feature: GYAE6OF01BN85H.47.46.E02.1.454.CMB.1.raw
tcagagctcacgtacacgaccggtgctcgatttagactcatctacagggaaaggggtctgagagaggagcccagccctgggattttcaggtgtttcatttggtgatcaggactgaaccgagagaactcaccatggagtttgggctgagctggctctttcttgtggtactttttaaaaggtgtccagtgtgaggtgcaactgttggagtcgtgggggagacttagtaccacccgtggggggtccctgagactctcctgtgcagcctctggacttctacctttagacctaactctgtccagtcgggcgtcgggtccgccgaggccgtaccgggggaagggtcctagggaggtcgggtctacgaagttatgagtgaagtaagtggtaggaagctaacgtacttacgtaacggtcggtaaccgtccgggtagggtaaaccgggtcccggttaccgaaacccgtacgttccgtacccgaaggaacgtaacgttaaacgtttacggaaacgggtaacgaccgtaaccggtaccgttagtaacgttaccgtaaaaccgtaaaagtacgtaaaccgtaggttaccgtaggaacggaacggacccggtaacgggaaccgtaccgggtaccgttaagtttacgttacgtaggtacggaacgttaaaacgttctaaacggtacgtacggtaacggtccccgtaaccccccggtaacggtaccgtacccgttaaccttttacggtttaccgtaccggttttcgggtaaacccgggggg

SEQ ID NO: 84568 - DNA, 555 bp, Homo sapiens
  misc_feature: GYAE6OF01DD8B8.47.46.E02.1.454.CMB.1.raw
  modified_base (524)..(524): a, c, t, g, unknown or other
  misc_feature (524)..(524): n is a, c, g, or t
  modified_base (526)..(555): a, c, t, g, unknown or other
  misc_feature (526)..(555): n is a, c, g, or t
tcagagctcacgtacacgaccggtgctcgatttagactcatctacaggggaaagggccaccatctcctgtagggccggtcagagtattagcatcaacttagcctggtacccagcagagacctgggcaggcctcccaggctcctcatctatgatgcgtccaccagggccactggttcccagccagttcagtggcagtgcgtcgtgggacagagttcactctcaccatcaacagcctgacagtctagaagtattttgactaagtttattactgtcagtctagtatctaataacgtggccgctaccgacccgtttccggaccgtaaacggggaaccacgggtaaccttagggaaacgtaacgtttaaaaaccggacgttacggtcgggtacctacggtccctaaccgactttaccttcgttcttaccgtacttcccgtaccccgtacctacgttccgtagtaccgtagtcgaacgtccgtagtcggagtccggggctcgggaccgaagggtccacgtacgtgcgtangnnnnnnnnnnnnnnnnnnnnnnnnnnnnnn

SEQ ID NO: 84569 - DNA, 787 bp, Homo sapiens
  misc_feature: GYAE6OF01BLAHR.47.46.E02.1.454.CMB.1.raw
  modified_base (202)..(202): a, c, t, g, unknown or other
  misc_feature (202)..(202): n is a, c, g, or t
  modified_base (228)..(228): a, c, t, g, unknown or other
  misc_feature (228)..(228): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggcctcccagagaccactggagaaatagtgatgacgcagtctccagccaccctgtctgtctctacgagggaancgccacatctcgtggtacgggccgtnagtagtattagcatactaacttagccttaggaccagcaggacgccgtgggacacggtcctacccgaggtcctcccgtcactccgttatcgtacgtcgccgtacccgacgacggtaccctacgttccggttcccagtccgtacggtcaggtcggacgtacggtcgtacgttcggtacgggtactaacggttaccgtttccaacccgtttacctacccgtaacctaaccgttaacccgaacgttaacccggtcccgtacggtacccgtaacggttaccgttaaggtaacgttttacgttttaccggtaacgttttaaacggtttttaaccgtttaccgtaacggtttaccggtaaacgttaccggtaacgtttaaccgttaaccgtaacgtttaacccgggttcccgggtacccgttacccgttaccgtaaccccgggtttacccgggaacccggttaacggggtaccctaaaccgggtacggttacgggtaaacgttaacgtaaaccggtacgttacggtacggtaccgtacgtaccctaaccgttcgtcggtttacccg

SEQ ID NO: 84570 - DNA, 701 bp, Homo sapiens
  misc_feature: GYAE6OF01D6CRU.47.46.E02.1.454.CMB.1.raw
  modified_base (195)..(195): a, c, t, g, unknown or other
  misc_feature (195)..(195): n is a, c, g, or t
  modified_base (244)..(244): a, c, t, g, unknown or other
  misc_feature (244)..(244): n is a, c, g, or t
  modified_base (603)..(603): a, c, t, g, unknown or other
  misc_feature (603)..(603): n is a, c, g, or t
  modified_base (652)..(652): a, c, t, g, unknown or other
  misc_feature (652)..(652): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtgtactttttaaaaggtgtccagtgtgaggtncaactgtggagtcgtggggagtacttagtaccacccgtcgggggtcccngagactctctgtgcagcctcgtggactcctacctttagcaactctagtcagtcggcgtcgggccgccgacgggccggtaccgggggaacgggtcggtcgggtaggtcggtactacgaagttagtgagtggaagtagtagggaggaacgacgtactacttaccgtacggtcggtaccgtccggtacggtacgggtcccgtaccacctacgttacccgtaccgaagtacgtaacttaagttacgaacggggactcctacgttcgtaagttaacctacgtaaacgaaactggtaacctcggttacgagtaacggacgtaccggaacggaaccccgttacgggtacctttattaccgtttcgnggtaacgtaccgtaaattgaacgtcgaccgtacgttcccccgaaccccnggtacctaccctttaggttacccttacggtccgtccggggtaaccgggg

SEQ ID NO: 84571 - DNA, 735 bp, Homo sapiens
  misc_feature: GYAE6OF01CR1CU.47.46.E02.1.454.CMB.1.raw
  modified_base (153)..(153): a, c, t, g, unknown or other
  misc_feature (153)..(153): n is a, c, g, or t
  modified_base (211)..(211): a, c, t, g, unknown or other
  misc_feature (211)..(211): n is a, c, g, or t
  modified_base (697)..(697): a, c, t, g, unknown or other
  misc_feature (697)..(697): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggcctccagagacccacgtggaanaaatgtagatggacgcacgtctccacgcccacctgtctgtcctctacggaagggaaancgccaccgatcctccgtggacggccagtacagtattatcgacagacctaattcgcgtaggtaccagacaacgaaccgtgggaccacggcctaccgacggtccctacctactactacgttagtcggtacacctaccgtacccgacggtaccggacctacgttacggtacctccggaacgtccggtaacggttcgacggtcgggtacgacggggttcggtacggtacgggaagtacgttacgtcctaacgtcctaccacgtactaccgacgtaccgcgtccctacggtactacggtttaccgtaaggttaacgttttacgttttacgaactttttaaaggttttaaccttttacggtacgttaacgagttacgttaaactttaaccgtaagttaacccggttcggtacctttcgggttacccgttacggaacccgggtaacgtacgtaaccggtcggtaaagggtaaccggttaaataacggttacgngttacggcgttaccacgtacttacgttcttaccgttac

SEQ ID NO: 84572 - DNA, 717 bp, Homo sapiens
  misc_feature: GYAE6OF01EDZOH.47.46.E02.1.454.CMB.1.raw
  modified_base (202)..(202): a, c, t, g, unknown or other
  misc_feature (202)..(202): n is a, c, g, or t
  modified_base (231)..(231): a, c, t, g, unknown or other
  misc_feature (231)..(231): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccacgtggagaaatagtgatgacgcagtctccacgccaccctgtctgtctctcgagggaanacgccactatctccgtggtacgggccgtnagtagtatagcatactaacttagcctagtaccagacgagacgaccgtcggacgacggcctccgacggtcctaccgtctacttctagtgacgtcgccgtccgaccggcggtaccctacgttccgttacccaaggtccgtaggttaccgaggtcggcgtacggtcggtccgtcggtacgggacgtacgtacgtacctacgtacctaccaacctaacgtaccgaactaccgtccgtagacgtacgttacgtaaggttaacgtttacgtttaccgtaatttaaacgtttttacttacgttacgttacgaacgttacgtaaagttaaccttaaacgtaaccgttcgggttacccgttcccggttacgttaccgggtaaccggtaaccgggtaccgaaccggttacgggtaacggtaaacgtaaacgtttaaaccggtacgttgggtaccgtacgtacgtaccgacttacggttcgtttccgtcctttaccg

SEQ ID NO: 84573 - DNA, 695 bp, Homo sapiens
  misc_feature: GYAE6OF01C0LE1.47.46.E02.1.454.CMB.1.raw
  modified_base (189)..(189): a, c, t, g, unknown or other
  misc_feature (189)..(189): n is a, c, g, or t
  modified_base (283)..(283): a, c, t, g, unknown or other
  misc_feature (283)..(283): n is a, c, g, or t
  modified_base (321)..(321): a, c, t, g, unknown or other
  misc_feature (321)..(321): n is a, c, g, or t
  modified_base (336)..(336): a, c, t, g, unknown or other
  misc_feature (336)..(336): n is a, c, g, or t
  modified_base (429)..(429): a, c, t, g, unknown or other
  misc_feature (429)..(429): n is a, c, g, or t
  modified_base (482)..(482): a, c, t, g, unknown or other
  misc_feature (482)..(482): n is a, c, g, or t
  modified_base (517)..(517): a, c, t, g, unknown or other
  misc_feature (517)..(517): n is a, c, g, or t
tcagagctcacgtacacgaccggtgctcgatttagactcatctacagggaaagggggctctgagagaggagcccagcccctgggattttcaggttgttttcatttggtgatcaggactgaaccgagagaactcaccagtggtagtttgggctgagcgtgtcgtcttaggtcgtgtaactttttaaaggntacagtgtaggaggtgactaactggttggagtcggtggggaagtactttagtaccgacccggtcgggggtcctggaactctctccgtgtcgccncgtcctcgcggactccaacctttagacctactctgtcngtcggtcgtggcccncgacggcggtaccggggaggtcgtggcgtggtcctagtaagttattgaatggaagtagtgacgagtacacgtattcgtacgcgacgttccggngtaacgggccgtacaccgaactccgaagactaacgttacgtacgagggtaccngaccgtatcgtactaacgaacctaaagacgtaacncgacgtacggaacgccggaacgaaaccggcgttaaacccgggtcttaatttaccgttgtacgggttaaccaagtaccgttatacccggtacggaaaccgtccccggttcccgtaccccggtaggttacttaacccgttaacggttttcccttaaagggtcccgtttaaggggccccgg

SEQ ID NO: 84574 - DNA, 777 bp, Homo sapiens
  misc_feature: GYAE6OF01CNZOL.47.46.E02.1.454.CMB.1.raw
  modified_base (215)..(215): a, c, t, g, unknown or other
  misc_feature (215)..(215): n is a, c, g, or t
  modified_base (250)..(250): a, c, t, g, unknown or other
  misc_feature (250)..(250): n is a, c, g, or t
tcagagctcacgtacacgaccggtgctcgatttagactcatctacaggggaaagggggagaactgctcagttaggacccagacggaaccatggaagccccagcgcagcttctcttcctcctgctactctggcctcccgagcgaccctagtaggaagaaatgtgatgacgcagtcctccacgccctacctgtctgtcctctaccggaagggaaacncgaccctaccatccgtccgtaggtacgggccgtanaggtagttatacgctaataccaacgtttcgccgtaggtaccagacaggacgtacgtgggacacggtcctaccgagtcctctactatacgttgacgtacgtcgaccgtacccgacggcggtaccctcggttccgttacccgagtccgtaggtaccgtaggtcgacgtaggtcggtacgtcggtacggactaggtaccgttcacgttccacacctaactaaccaccgtccggtactacggacttacggttacgtaaggttaacgtttagtttacgtaacttttaaagtttacgtaacgtttacgacgtaaacgttacgtaaagttaacttaaccgtacgttaccggtaccgttaccgggttaccgtaaccgggaacccggtaaggtaacccgtaacgggtacggtttaaacggggtaaacgttaaacggtttaaacgggtaaccggtttcgggtaaaccgggttacccgtaccggttaacccttaacccggtaactttccgggttttaccccggttacctttaaccccg

SEQ ID NO: 84575 - DNA, 855 bp, Homo sapiens
  misc_feature: GYAE6OF01EGCKP.47.46.E02.1.454.CMB.1.raw
tcagagctcacgtacacgaccggtgctcgatttagactcatctacagggaaagggggctctgagagaggagcccagccctgggattttcaggttgttttcatttggtgtatcaggactgaaccgagagaactcaccagtggtaggtttgggctgagcgtggtcttctttcgttggtggttacgttttttaaaaggtcgtccgtagtggtgaggtgcaactggttggaggttcggtgggggactacgttacgtaccgtacccgggttacggggggtcccttaggacggtaccttccgtccgtgtcgacgtcggtccttcggtcggtaccttccttaaccgtttagacctaacgttccgttgtcgtacggtcgggtcgtccggggtacccgccggtaggggcccgggtaccggggggtaagggccggttaggggtacgggttacgggtcgttaacgtaagggtttagttaggtaacggttaaggaaggttaacggttaggggtacggtaaaccggtactaacggtaccgtttcccgggtaacggttaaccgggttacccgtccggggttaaacgggtaacccggggttcccgttaccaaccggtacttaccgtaaccgtagtaacgttaaccttaacgttacggaacggtacgtaccgtacgtaccgtttaaggtacttaaccgtaacgtaaacgtcgaaacgtcgaccgtagacgtacgacggacggtacccgaccgttacgtttactcgtttagtggtactacgtaagttacccgtagtaccggtaccgaccgttaccccgggaaccccttacggtacctaccgtttaccgtttacgttcgtcccggtttccggg

SEQ ID NO: 84576 - DNA, 772 bp, Homo sapiens
  misc_feature: GYAE6OF01CYYNO.47.46.E02.1.454.CMB.1.raw
  modified_base (192)..(192): a, c, t, g, unknown or other
  misc_feature (192)..(192): n is a, c, g, or t
  modified_base (686)..(686): a, c, t, g, unknown or other
  misc_feature (686)..(686): n is a, c, g, or t
  modified_base (703)..(703): a, c, t, g, unknown or other
  misc_feature (703)..(703): n is a, c, g, or t
  modified_base (714)..(714): a, c, t, g, unknown or other
  misc_feature (714)..(714): n is a, c, g, or t
tcagagctcacgtacacgaccggtgctcgatttagactcatctacagggaaaggggtctgagagaggagcccagccctgggtattttcgaggttgttttctatttggtgatcaggactgaaccgagagaactcaccagtggtagttgggctgagcgtggtcttctttcgttggtggttacgtttttaaaggngtcctagtgtgtaggtgactaagtggttaggagtcggtaggggaacgtacgttacggtaccgaccgggttcggggggtccctaggacgtacctcttccgtggtcggacctacgcccgttgtcggtacctaccttaccgtttaacgaccgtaaccttcgtacgtcgtaggtcggggtaccggtcccggggtcccgacggtaccggggaccgggttaccggggggaacgggtcggttagggacggttcgggtactaacgtaaggttactaggacgtagaaggtacgtgggaagaagtacagttacgtacgttacggtacggtaccgttcgggtaacggtaacccgggtcccgtttaacgaaccgtacgtaccgaacgtaacggtaactaaccgttaaggtcggaaaggtaccgtaccgaacgttacgttagttactaacctaaagtaacaacggacgtacgtcgagaacggacgtaccgaacgggactcgtacttnttaccgttgaacggtanaacggttactntaacgacgcgttacgccccgtaccgtcacgttcctaaggttcacgtgttccgggacgg

SEQ ID NO: 84577 - DNA, 859 bp, Homo sapiens
  misc_feature: GYAE6OF01BVMSB.47.46.E02.1.454.CMB.1.raw
  modified_base (202)..(202): a, c, t, g, unknown or other
  misc_feature (202)..(202): n is a, c, g, or t
tcagagctcacgtacacgaccggtgctcgatttagactcatctacagggaaagggggaggaactgctcagttaggacccagagggaaccatggaagccccagctcagcttctcttcctcctgctactctggcctccagataccatcggagaagttgtgttgacacagtctccagccacctgtctttgtctacgaggggaacncgccacctctccgtgcgagggccagtcaagtaatactccacctcctacttacgcctggtaaccaacacgaaaccttggtacacggtccttacccgacggtccttaccttcacttcctagtgtaacgttcgacctaactacccgaaaccgacggggtacccagtacggaccctaacgttacccccgaaaggtaccgtaagggtttaccaacgggtcgggacctaggggtcggggttccgtaagggggaaccctaggttaaccgttccgtaacccttaccgtccaaaaccgtcttaccggaacgaccgaaccgtacccgttaagacccggtaacctttaggtaaacgttaccggttttaacgttaaccgtttttacgttaaccgttcggttaacctaacggccgtttaacggccgggttttaagtcccgggtttcccggttacccgggttaccccctcccgggtttacccgtttaaccggttaccccggggttttacccgggggaaccgggggtaacccggggtaacccggggttaaggggggtaccggtaaaccgggttaaaccgtaacccggttaaaaccgggtacggttcggggtaaaccgttccggaccgtaaccgttaacccgtatttcccgttcgggttttccttaaccccgg

SEQ ID NO: 84578 - DNA, 624 bp, Homo sapiens
  misc_feature: GYAE6OF01C66E5.47.46.E02.1.454.CMB.1.raw
  modified_base (202)..(202): a, c, t, g, unknown or other
  misc_feature (202)..(202): n is a, c, g, or t
  modified_base (257)..(257): a, c, t, g, unknown or other
  misc_feature (257)..(257): n is a, c, g, or t
  modified_base (407)..(407): a, c, t, g, unknown or other
  misc_feature (407)..(407): n is a, c, g, or t
  modified_base (614)..(614): a, c, t, g, unknown or other
  misc_feature (614)..(614): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagcccacctgtctgtctctccgaggggaangccaccatctcctggtacgggccgtcagagtatagcatcaacttgcctggtaccngcagagaccgtggggcaggtcctccccgaggcctcctcattctatgatcgaccgtcccacgcgggcctacgttcggttacccagcctaggttcaggtcggcagtcgcgtcgtgggactagtacgttcacttcctacgacctatacaaccncgtccctgacgtacgttctagtaagttattttcggactttaagtttacttacgtgtacacgtacgttacgttaatactaacgttaaccggtcggtacccgtcttacccgtacccggttcggaaccccggtaaaggggaccctaccggaacggtaggtaagtaaaacgtttaaaccggaacgtttggacgtacacgtacctaaccgtnttccggttac

SEQ ID NO: 84579 - DNA, 974 bp, Homo sapiens
  misc_feature: GYAE6OF01D2BPR.47.46.E02.1.454.CMB.1.raw
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggcttctttcttgtggtactttttaaaaggtgtccaggtgtggaggtgactaacttggttgggtaggttcggtgggggtagtacgtttaacggtaccgtaccccggttcgggggggtccctaggaacgtaccttccttccgttggttcgccgacgtcctcgttacggtaccttaccttaaccttttaacggacctaaccttcgttacggtacgtaggttcggggtccgttcgggggtccccgaccggtacggggtccgggtaccgggggggaagggggtccgttagggggtacgggttcggggttaccttaacggtaaggtttagtttaggtaagttaggtaaaggtaacggttaggggtaacggaacgtaacgtaacgttaacgtttaccggtaacgggttacgggttaacccgttaccggggttaacgggtaaccggggtccccgttaaccgaacccgttacgttacccgtaaccgtaaacggtaaaccgttaaaccgttaaacgtttaccgggaaacggggtaacctaccggtaaccgttcgtttaaggtaacttaaccgtaaaaccgtaaagtaccggaaacgttacggttacggaacggtaacgggaccggtaaccggggtaacggtaacccggtaccgggttaaccgtttacgtttaacggtttacgtacggggttaacgtaaacggttaaaacgttacgttaacgtaccggtaaacgtccccggttaacccccggtaccccgtaccgttacccgttaacccgtttaccggttttccgtttaaccgggtacccggtttcccggggtaaacccggggg

SEQ ID NO: 84580 - DNA, 723 bp, Homo sapiens
  misc_feature: GYAE6OF01C9D78.47.46.E02.1.454.CMB.1.raw
  modified_base (195)..(195): a, c, t, g, unknown or other
  misc_feature (195)..(195): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggtctttttaaaaggtgtcagtgtgaggtgnaactgttggagtcgtggggagtacgttagtacgacccgtgggggtccctggacgactctcctgtgcagcctcgtggactcaccctttagcaactctgtcagtggctgggtccgccgaggcgtcggggaaggcgtggagtgggtctacgaagtattgataggaagaagttgggaggaagtcaacgtagttacgtaacggttggaccgtccggtagaaacgggggtcccggtttacaacccgtaatcccgttaccgaacgaacgtaaccgtaagttttaccgaaggtacgccaaaccggtcttacggtaattacctaaacgaaactacggtaaactaacgttacgtagaaggacggacccggaacggaaccggtaacccggtaccgttaagttaacgttttaccgtaggtacgtaacgtaaaacggttacttaaagtaccggtacgtacggtcccggtacccccccgttacgacccgtaccctaaccgtttttccgtttaccgttaacccgttcgggttaaccccggggg

SEQ ID NO: 84581 - DNA, 696 bp, Homo sapiens
  misc_feature: GYAE6OF01BEB3T.47.46.E02.1.454.CMB.1.raw
  modified_base (200)..(200): a, c, t, g, unknown or other
  misc_feature (200)..(200): n is a, c, g, or t
  modified_base (503)..(503): a, c, t, g, unknown or other
  misc_feature (503)..(503): n is a, c, g, or t
tcagagctcacgtacacgaccggtgctcgatttagactcatctacaggggaaagggggaggaactgctcagttaggacccagacggaaccatggaagccccagcgcagcttctcttcctcctgctactctggctcccagagaccactggagaaatagtgatgacgcagtctcagccacctgtctgtctctcgagggaacncgccacattcctctggtacgggccgtcaggtattattacgctatacaacgttagccgttaggtacccagacgtaaggacgtaccgtgggccacggtcctacccgaggtccttaccgtctaacgttctaagtgactcgtccgtacccgaccgacgggtccttaccgtttccggttacccacggtcccgtagggttcgacggtcggaccgtagtcggcgtacgtacgggaactacgtagttaccaccttcgaccgactactaccgaactcgtccgtagtacctacgttacgtaaggtaacgtttntttacggtactttaaacggttttactttacgcgtaccgtagttacgtaacgtaactacgttaacgaccgttcgggccttaccgtacctaccgggttacggaaccgaaacggtcctaacggtacggtacggtaaacgtaacgttaaaccggtacgtacggtacggtctaccggtactacccgtgttccgttacg

SEQ ID NO: 84582 - DNA, 661 bp, Homo sapiens
  misc_feature: GYAE6OF01BN4GX.47.46.E02.1.454.CMB.1.raw
  modified_base (202)..(202): a, c, t, g, unknown or other
  misc_feature (202)..(202): n is a, c, g, or t
  modified_base (230)..(230): a, c, t, g, unknown or other
  misc_feature (230)..(230): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagcccacctgtctgtctctccgaggggaanacgccaccatctccgtggtagggccgtnagagtatagcatcaacttagcctggtaccagcagagaccgtgggcacggcctccgaggtcctcctcactctatgatcgccgtcccgaccgacgggtccctaacgttccggttacccgacgtacccgtagggttcgaggtcggacgtaggttcggtaccggttcggtaggggaactacggtacgttccgtacctcctacccgaaccattaaccaacctccgtcccgtgaccgtagttaccgtaggtaaagtttagttttcgaactttaattttacgttactcgtacgtagtactaagttaataaacgttacgtcggtcccgttacgtccgttacggaacccgtaagggaacccgacggtgtaacgggtaaacgtaaacgttaaaccggtagtacggcggtactcggactacccgtatcgttcgttcttaccg

SEQ ID NO: 84583 - DNA, 958 bp, Homo sapiens
  misc_feature: GYAE6OF01DQBTH.47.46.E02.1.454.CMB.1.raw
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgacctggtctttttcttgtggtctaattttaaaaagtgtccagtgtgaggtgcagctggtggagtcgtgggggaggcttagtacagccgtgggggtccctgagactctcctgcgcacgcctctggtactttcttacctttagtagttatcgtccattgtacgttcgggtcccgccgtaggcctaccgaagggggtaacggggtccgttaggggtaggttcgggttcctacgtaacggtttaatttaacgtccgttaaggtacgttacgggtaaacgttccggaaccgtaaaaccgaaaacccgttaccgggacccgggttaacccgtttacccggggttagggaaacccgggggtaaccccgttaacgtttaccccgaaaccccgttacgttaccccgttacccgaaaacgggaaaccgtaaacccccgtaaaaccccggaacccgaaaaaaccgggaaaccccgtaaccggttaaccgtttaacgggtttaaccttacccggttaaccggaaacccttaaaaaggttcccgaaccctaaaaccggttacggtttccgaaacgggtaaacccgggaacccggtaaccccgggtaaacggttaacgggtccgggtacccggggtttaactttacgggttttaacgtttttaacgttttcccggtagggttaccgtaaaccggtaaaaagggttacgttaaaccgttacccggttaaaaccgggttcgggggttaacccggggttaaaaccctttttaactttttttaacgggttcccgggtaaaccgggtttccggggtaaaccccggggggg

SEQ ID NO: 84584 - DNA, 949 bp, Homo sapiens
  misc_feature: GYAE6OF01B774G.47.46.E02.1.454.CMB.1.raw
  modified_base (203)..(203): a, c, t, g, unknown or other
  misc_feature (203)..(203): n is a, c, g, or t
tcagagctcacgtacacgaccggtgctcgatttagactcatctacaggggaaagggggaggaactgctcagttaggacccagacggaaccatggaagccccagcgcagcttctcttcctcctgctactctggctcccagataccactggagaaatagagatgacgcagtctccagcccacctgtctgtcgtctccgagggaancgcccaccctctcctgcgacgggccagtcagagtattagcagacctaacgttacgccgttaggtaaccaggaccaacggtaaaacccgtggggaccaacgggcccttaccccggacgggtcccttacccctcgtaaccttccttaacgttggaaccgttcggtacccgtaccccgaaacccggtaccggggaccccttaacccggttttcccgggtttacccccaggttaccccggttaaggggtttacccgtaagggttccgggaaccgtaacgggtttccggtacccgggttttacgggaaccgggggaaccttaacgggtaccgttttaccccgaacgtttccccgtaaccctaccccgtaaataacccggtaaaccaaccggtcccgtacggtacccttacggttaccgttaaggttaacgtttagttttaccggtacgtttttaacgttttaaacgtttaccggttagttaccgtaacggttaacgttaacgttaccgtttaaccgtaaccgtttaaacccgggttccccgggacccgtttacccgttaacccgttaaccccggggtttaccccgggaaacccgggtaaacccgggtacccgtaaacccgggttaacccggttaaccgggggttaaagttaaaacccggttttaaaaacccggggtaccgtttaggttaaccgggggtacccttaacccgggaaccccttaaccggttacggtttccccgttttaacccgg

SEQ ID NO: 84585 - DNA, 705 bp, Homo sapiens
  misc_feature: GYAE6OF01B7IO0.47.46.E02.1.454.CMB.1.raw
  modified_base (154)..(154): a, c, t, g, unknown or other
  misc_feature (154)..(154): n is a, c, g, or t
  modified_base (222)..(222): a, c, t, g, unknown or other
  misc_feature (222)..(222): n is a, c, g, or t
  modified_base (258)..(258): a, c, t, g, unknown or other
  misc_feature (258)..(258): n is a, c, g, or t
  modified_base (567)..(567): a, c, t, g, unknown or other
  misc_feature (567)..(567): n is a, c, g, or t
  modified_base (697)..(697): a, c, t, g, unknown or other
  misc_feature (697)..(697): n is a, c, g, or t
tcagagctcacgtacacgaccggtgctcgatttagactcatctacagggaaagggggaggaactgctcagttaggacccagacggaaccatggaacgcccagcgcagcttctcttcctcctgctactctggcctcccagacgaccacgtggaanaaatagtgatgacgcgagtcctccaggccctacccgtgttctcgtcctcctaccggaaaggggaaacncgtacccaacctatcctccgtaggtacggggccgtnaggtaagtacttagctaactactaaacgttgccttaggtaaccagacaggacgtaccgtgggaccacggcctcccgaggtcctacctatagtcctagtcgatccgaccgtacccgaacggacggtccctaacggttccggttcccaggtacccgtaggttccgaaggtcggtactagggtcggtcggtaccggtagggactaggttaccgtacctaactcccgaccaacctaacgtaccaaactccggtccctagtacgtacgttacgtagtaacgtttattgggtacttaagttttcgtacgtcgtanagtactagtacctaacgtacgtacgtcggtaccctactaccgtacggtacggaaccgacggacctacggcggtaaagtaacgttaaacgttaaacgggtctaggtacgggtacccaggtaccctacgttnttccgtac

SEQ ID NO: 84586 - DNA, 845 bp, Homo sapiens
  misc_feature: GYAE6OF01DXSBI.47.46.E02.1.454.CMB.1.raw
tcagagctcacgtacacgaccggtgctcgatttagactcatctacagggaaagggggaggaactgctcagttaggacccagacggaaccatggaagccccagcgcagcttctcttcctcctgctactctggctccagataccatcggagtaagttgtgttgacacagtcctccacgccctacccttgttcttttcgtccgtaccggaagggggaaacgcgcccctacccttctccgtcggcgacgggccagtcaggtagttggttggcagtcttacttacggcctacggtaaccaacgacgtaaaaccgtcgggacccgacggtaccctcccgacgggtcccttcctacacttacctagtacggtactcggtactaaccgtacccgaaaccggtacggggtaccctacggttacgggaccctaaccgtaccccgaaaggtaccgtacgggtttaacgtacgggtcggggtacgtaggggttccggggtacggtacgggtaacgtaacgttaccttacccgtaccttcctacccaaaccgtacgttccgaacggacccgtaccggttaaccgtaacggggaacccgttaccgttaaacgggtaaaccggtttaccgtttttaacggttaaaccttttttaacggttaaccgttaggtaccgacggtttacgaacggttcggtacggtttactccgggttaccgtcccgtaccgttaccgttaccgttaccgggttccggggacgggtaaccgggtaccggtaggggtacggtaacgtaccggttaaacgaaaccgggttgtacgggttcgaccgttacgacccttacggtcttcggttcttacccg

SEQ ID NO: 84587 - DNA, 558 bp, Homo sapiens
  misc_feature: GYAE6OF01BN263.47.46.E02.1.454.CMB.1.raw
  modified_base (202)..(202): a, c, t, g, unknown or other
  misc_feature (202)..(202): n is a, c, g, or t
  modified_base (226)..(226): a, c, t, g, unknown or other
  misc_feature (226)..(226): n is a, c, g, or t
  modified_base (256)..(256): a, c, t, g, unknown or other
  misc_feature (256)..(256): n is a, c, g, or t
  modified_base (261)..(261): a, c, t, g, unknown or other
  misc_feature (261)..(261): n is a, c, g, or t
  modified_base (362)..(362): a, c, t, g, unknown or other
  misc_feature (362)..(362): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatgtgactgacgcagtctccagccaccctgtctgtctctccaggggaaangccaccatctcctgtagggccgtnagtagtattagcatcaacttagcctggacngcagngacctgggcaggctccaggctcctcatctactgtactcgcgtaccaccaggcccactcggtttcccagtccgtacgtcgagtggacagtgcgtctgggacncgtagttcactcgtcacactcaactacgcctcgctacgtctggtaagtattttgctacgtatactacctgtcagtcagttactggttaggaccacgtatacgggacgttaccggtcgaacgggtaccgaaggggttcggaaactacgaaggtccgaaccgttggacggtcgagtaccacccgtagtccgttaccgg

SEQ ID NO: 84588 - DNA, 710 bp, Homo sapiens
  misc_feature: GYAE6OF01DWMTK.47.46.E02.1.454.CMB.1.raw
  modified_base (161)..(161): a, c, t, g, unknown or other
  misc_feature (161)..(161): n is a, c, g, or t
  modified_base (197)..(197): a, c, t, g, unknown or other
  misc_feature (197)..(197): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggcttctttnttgtggtactttttaaaaggtgtccagtgtgaggtnctaactgttggagtcgtgggggatacttagtacacccgtggggggtccctgacgactctcctgtgcacgcctcgtggactcacctttagccaactctcgtcagtcgggtcgtcgggtcccgccgagggtccggtaccggggggaagggtcgtgggacggtgggtcctagtaacgttattgaagtgaagtagtgggtaggaagctactagttaccgtacggtgtaccgtcggtagggtacgggtccgttacaccgtactcctaccgaagtacgtaactaagttcgacgggacgtaccgacgtcttacgtactactaaactaagtacgtaacacggtcctaggaacggaacggccgggaacggaaccgtaccgggtaccgttaatttcgtttacgtaggttacgaacggttaaacgtacttacgggtaacgtccgtacggttacccccgtaccccccgtaggaccctttaccttaaccgtttcgtttacccggtccgtttccggggtaaccgggg

SEQ ID NO: 84589 - DNA, 584 bp, Homo sapiens
  misc_feature: GYAE6OF01C5VOW.47.46.E02.1.454.CMB.1.raw
  modified_base (68)..(68): a, c, t, g, unknown or other
  misc_feature (68)..(68): n is a, c, g, or t
  modified_base (201)..(201): a, c, t, g, unknown or other
  misc_feature (201)..(201): n is a, c, g, or t
  modified_base (223)..(223): a, c, t, g, unknown or other
  misc_feature (223)..(223): n is a, c, g, or t
tcagagctcacgtacacgaccggtgctcgatttagactcatctacagggaaagggggaggaactgctnagttaggacccagacggaaccatggaagccccagcgcagcttctcttcctcctgctactctggctccagagaccactggagaaatagtgatgacgcagtctccagccacctgtctgtctctccgaggggaaangccacatctctggtaggccgtnagagttatagcatcgaacttgcctggtaccagcaggagacctgggcaggctccgaggctcgcatctatgatgcgtacaccgagggccacgtcggtttcccagcctaggttccagtcgcaggtgcgtctgggacaggtagttcactcgtccactatacaactagacctggactagtacctaggtaagttagttttcgacgttagttttaacttacgttgtacgtaggactaaggtactacaacttaaccgtgtcccgtactaccgtaccgttccgggaccgtaaacgggccaaacggtaacgtggaagtaacgttaaaacggacgttacggtggtccgtagacgtaacctagtcgtttaccg

SEQ ID NO: 84590 - DNA, 708 bp, Homo sapiens
  misc_feature: GYAE6OF01E15N6.47.46.E02.1.454.CMB.1.raw
  modified_base (207)..(207): a, c, t, g, unknown or other
  misc_feature (207)..(207): n is a, c, g, or t
  modified_base (238)..(238): a, c, t, g, unknown or other
  misc_feature (238)..(238): n is a, c, g, or t
  modified_base (241)..(241): a, c, t, g, unknown or other
  misc_feature (241)..(241): n is a, c, g, or t
  modified_base (307)..(307): a, c, t, g, unknown or other
  misc_feature (307)..(307): n is a, c, g, or t
  modified_base (371)..(371): a, c, t, g, unknown or other
  misc_feature (371)..(371): n is a, c, g, or t
  modified_base (412)..(412): a, c, t, g, unknown or other
  misc_feature (412)..(412): n is a, c, g, or t
tcagagctcacgtacacgaccggtgctcgatttagactcatctacaggggaaagggggaggaactgctcagttaggacccagacggaaccatggaagccccagcgcagcttctcttcctcctgctactctggcctcccagacgaccactgggagaaatgtgatgacgcagtctccagccaccctgtctgtctctccgagggggaaancgcccactatctccgtggtacggggcccgtnagngtattacgcagcaacttagcctggtaccagccaagaacctggggcaggcctcccgaggcctccctnatctagtggtctcactccacgacgggcctacgtcggtactcccgagcctaggttcaggtcggcngggttcgggtctcgggactaggtacgtttaccaccgttccnccgacctaactccacggcctaccggtccctacggcctaacggttccgtaaggtaagtttacgttttacgggacctttaacggttttttactacccggtttgtacgtaaccggtccgtaacggttaacttaccgtaaaccgttaaccggtcggggtaccccttacccgttacccggtacccggttccggggaaaccgtaaccggggtaccaaccgggttacgtagggtaaacgtaacggttaaaaccggacgttagggtcccggtacgtaccgacctacccgtagttccgttacccg

SEQ ID NO: 84591 - DNA, 707 bp, Homo sapiens
  misc_feature: GYAE6OF01CIUNF.47.46.E02.1.454.CMB.1.raw
  modified_base (219)..(219): a, c, t, g, unknown or other
  misc_feature (219)..(219): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggtcttttttaaaaggtgtccagtgtgaggtgcaactgttggagtcgtggggganacttagtacacccgtggggggtccctgagactctcctgtgctagccctcgtcggactctacccgtttagccaactctgtcagtcggggcttcgggtccccgccgaggcctaccgaggggaacggggcgtggaggtgggtctcgaggctagttggtggtagtggtcgccgaggacacgattaacgtaaacgtcctgacgacgggtaccgtaatttctttactctaccgaagtacaactaacttacccaaggaaacctacttaacgtgtaatttcgtagacctagttacgacctaagtacgtaggaagacggttaacggacggtaaccgtacgggtacccgtaattacgtttagttacggttaaggttaaagtacggggttatacggggttacggtacgttaacggtccggtttcgggttaaccgggggggacccccgggttaaacccgttacggggttacccgtaccccggttcgttcccgttacccgg

SEQ ID NO: 84592 - DNA, 701 bp, Homo sapiens
  misc_feature: GYAE6OF01B9JZI.47.46.E02.1.454.CMB.1.raw
  modified_base (204)..(204): a, c, t, g, unknown or other
  misc_feature (204)..(204): n is a, c, g, or t
  modified_base (234)..(234): a, c, t, g, unknown or other
  misc_feature (234)..(234): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagcccacctgtctgtctctaccgaggggaaancgccaaccatcctccgtggtacgggccgtnagtagtatagctatacctaacttcgcctaggtaccagcaaggacgaccgtggggcaggtcctcccgaggtcctcctacattcctagtgactcgccgtaccaccgacgggcccttacgttccgggttacccagtccgtaaggttcgtacggtgggactaggtcggccgttcggacgggaactagtacgttaccacgttccacctacctactaccaactcgtccgtgtacctagtcgtaacggtaagttacgtttcgacttttacggttttaacttacgttcggtactaacggtacgttaagttaaccgtaacttaaccgtaacgttccgggtcccttaccgttacccgtaccccggttaccgggaacccgaaacggggaccctaaccggtacggtagggtaaacgtaaacgttaaaccggacggttcggtacggtaaccgtcgaaccctccgtaagtttccgttacgg

SEQ ID NO: 84593 - DNA, 752 bp, Homo sapiens
  misc_feature: GYAE6OF01B3C4T.47.46.E02.1.454.CMB.1.raw
  modified_base (362)..(362): a, c, t, g, unknown or other
  misc_feature (362)..(362): n is a, c, g, or t
  modified_base (586)..(586): a, c, t, g, unknown or other
  misc_feature (586)..(586): n is a, c, g, or t
tcagagctcacgtacacgaccggtgctcgatttagactcatctacagggaaagggagctctgagagaggacgcccagcccgtgggtattttcgaggttgtttttctatttggtgatcaggactgaaccgagagaactcaccagtggtagtttgggcgtggagcgtggtcttcttttcgttggttaggttacgttttttaaaaggtgttccgtaggtggtaggtaggtcgaccgtaagttgggtttggacggttcggtagggggaacgtacgttaacggtaccggtacccggtcgggggtccctggacgtactccgtcgtgtgacgcgcctgtcgtctccgtacttacgactactgtgtacgnggtcggtcgtcgggtacccgcggtacgggtaccggtacggggaggtcggtgggtacggttcggttaccgtagtaacggttagtttggaagtaggaagtaaggtcggtaagtaacgacgtaagttcgttaccggtacggtcggtaccgtcggtacggtaacggtccgtaccacgtacgtccgtacgagtaacgtacgttagtacggacgtacgacgtcgtacgtntacgtaacgtacaagggtcaacgtacgcgaaggtacgacggacggaacgtacggtacgtaccgtttatcgttacggtacgaacgttaacgtaacgttctagtacgtccgtaccggtacccgtaccccgttacgtccttaacttacccgttcgttagttaccccggg

SEQ ID NO: 84594 - DNA, 769 bp, Homo sapiens
  misc_feature: GYAE6OF01B9GHP.47.46.E02.1.454.CMB.1.raw
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggcttctttcttgtggcttaattttaaaaagtgtccagtgtgaggtgcagtcgtggtggaggtcgtgggggaggtcgttagtacgacggccgtcgggggtccctgagacctctcctgcgcagcctcgtggatttcttcctttaggttaacgttatcgacctagttcggtacgttcggggtcccgaccgtacggccgtaccggaagggggaacggggtcgtgggtaggttcgggtctacggaggtcgtaggtttgggtaggtaggttggtacgaccgtagacctacgtaacgttaacggtaacgtcccgtggcggtaagggcctagtttacttacgcctacgtagaacgtaactattccggaaagtaactaacgtctagtacgttctacgacgtacggtttacacccggtaagtacgtacgggaagtacgggtacggaaggtcccggtaccgggtactttaagtttagtttaaacgttggttttaaacgggtaaaagggttcggggtaacggtttaggggtacgggttacgttaccccgggtaaccggtttcgggggtttaccggggggaaacccccggggtttaccctttcggggtaaccccgttccccgtttaccgg

SEQ ID NO: 84595 - DNA, 923 bp, Homo sapiens
  misc_feature: GYAE6OF01ENH2V.47.46.E02.1.454.CMB.1.raw
  modified_base (285)..(285): a, c, t, g, unknown or other
  misc_feature (285)..(285): n is a, c, g, or t
tcagagctcacgtacacgaccggtgctcgatttagactcatctacagggaaaggggagctctgagagaggagcccagccctgggtattttcgaggtgttttcatttggtgatcaggactgaaccgagagaactcaccatggagtttgggctgagcttggtctttttcgtgtggtacttaatttaaaagtgtccagtgtgaggtgcagctggtcggagtcggtggggagtcttagtacagtccggtcgggggtccctgagtacctcgtcctgccgcacgtcccttntaggtactttccgttaccgttttaaggttagtttactacggtacctaagttcggtacgtttccggggtaccccgtacggtacgggtaccgttaccggggaaagggggtaacggggcgttaggggtaggttcggggtaccttcggaagggtcgtaggtttaggggtacggttacggtcggggttacggacccgtaaggggtacctaaacgttaagtttaaacccggaaacgttccccgtagggtaacccggtacgggggtccctttaacgttttaccgtttaacgttcccgttaaccggaaagggtaacttaaacccgttaacgtttaacccggaaaaggtaacctaaaccgtttacctaagtttaactttccggtagacccggttaaggttacccggtaaacgtacggttaaccggtaaggaacgggtacggttaaccggaacgggttaacccctaccgggggtaaccctttaaggttaacttaacgggttttaacggtttaaagggtttaaagggttacgggttaaggttcggggttaaaccggtacccggttaaacggttaccccgggttcggggttaaacccggggggtaacccccggttaccccggggtttacggtaaccccgggtttacccgg

SEQ ID NO: 84596 - DNA, 748 bp, Homo sapiens
  misc_feature: GYAE6OF01AF54V.47.46.E02.1.454.CMB.1.raw
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggtctttttaaaaggtgtccagtgtgaggtgcaactgttggagtcgtgggggagtacttaggtaccgtaccccggtggggggtccctggacgaccttctccctggtcgcgacggtcccttcgtcggacctcctaaccgtttacgacctaactctcgtcgagtcggccgtcgggtcccgcgacggcggtccgggggaagggtcgtgggaggtcgggtctacgaagttagtgagtagagtacgtgggtacgaacggtctacgtagttccgtacggtacggtacgtcggtaggacgggtcccggttacaccgtactccgtaccgaagacgtaacgttagtttacgaggtacgaccgtacgtacgttacgttacctacgtaaacgtaaagtacgaacgtacgttacggtagtaacggcggtaaccggacgggtaaccgtaacccggttaccgttaacttaacggtttacgtacggttaacggaacgttaaaacgtcgttaacgtacggtacctaccgggttccccgacccccgttacgaccgttacccttaccgtttagtttacccggttacgtccgggtaaccgggg

SEQ ID NO: 84597 - DNA, 722 bp, Homo sapiens
  misc_feature: GYAE6OF01E0895.47.46.E02.1.454.CMB.1.raw
  modified_base (305)..(305): a, c, t, g, unknown or other
  misc_feature (305)..(305): n is a, c, g, or t
tcagagctcacgtacacgaccggtgctcgatttagactcatctacagggaaaggggtctgagagaggagcccagccctgggattttcaggtgttttcattttggtgatcaggactgaaccgagagaactcaccatggagtttgggctgagctggcttctttcttgtggtcttttttaaaaggtgtcagtgtgaggtgcaactgttggagtcgtgggggatacttagtacacccgtgggggttccctgagctctcctgtgcagcctctgactccacctttagcactctgtcagtggctcgggtccncgaggcgccgggggaaggcgtggaggtcggtctctaagttcttgatggagtaagtagggtcggaaagctaatagttccgtacggtcggtaacccgttcggacggggtaacgggtcccggttaccaaccgtacttcccgtacctaggtaacgtaaacttagtttaccggaagggtaacgacccgtacgtactttaacggtacttaaccgttaaacctaaaacgttaccggaaacgtaacgtaccccgtaggacgggaacccgtaacccggaacgggtacccggtaaccggttaccgttaacgttttatttaccgttgttacggaaacgttaaacgtactacgtacgtcgtacccggtccctacccccgtagtcccgtacttaccgtttccgttacggttccgttccggtaaccggggg

SEQ ID NO: 84598 - DNA, 768 bp, Homo sapiens
  misc_feature: GYAE6OF01B1E7K.47.46.E02.1.454.CMB.1.raw
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggcttctttcttgtgtactttttaaaggtgtccagtgtgaggtgcaactgttggagtcgtggggatacgttagtaccaccgtgggggtccctgagctctcctgtcgcagcctgtcggactctacctttagactaactctgtaccagtcgggcgtcgggtccgcgacggccgtccgggggaagggtccgtggacgtgggtactacgaagtagttgatgagagtgggtagaagcgatacttacgtaacgtcggtaaccgtcggtagggaaacgggtccggttaccaaccgtacgtcctaccgaggaacgtaaccttaacgttcgaaacgggactaaccgaccggtaccttggttaactaacctaaacgtaaaacgttcgaaaaccgtcgacgttaacggaacggaccgaaccgggaacggtaacccgtaaccggggtacccgttttaaagtaccgtttttacccgaggttaaaccggtaacggttaaaaccgttccttaaaacggtacggtaaccgttacccggttaccccggtacccccccgtaaagggttcccctaaaccgtttaacccttttcggttttaacccgggtaaccgtttttccggggaaacccgggggg

SEQ ID NO: 84599 - DNA, 827 bp, Homo sapiens
  misc_feature: GYAE6OF01BBVQT.47.46.E02.1.454.CMB.1.raw
  modified_base (154)..(154): a, c, t, g, unknown or other
  misc_feature (154)..(154): n is a, c, g, or t
  modified_base (214)..(214): a, c, t, g, unknown or other
  misc_feature (214)..(214): n is a, c, g, or t
  modified_base (244)..(244): a, c, t, g, unknown or other
  misc_feature (244)..(244): n is a, c, g, or t
tcagagctcacgtacacgaccggtgctcgatttagactcatctacaggggaaagggggaggaactgctcagttaggacccagacggaaccatggaagccccagcgcagcttctcttcctcctgctactctggcctcccagacgaccagtggaanaaatagtgaatcgacgcagtcctccagcccaccctgtctgtcctctacggaaggggaacncgccactatccgtccgtggacgggccgtanaggaagttactacgctattacctaaacgttcggccgttacggacccaaggtaccaaggaacgtacccgtggggaccacggtccctccgaggtcccttaccctcgtaatttccgtaattcggacttaccggaactacccgtaccgaaaccgggacggtaccctacggtacggaaccaaccgtaccccggtagtaacccgggttaggtttacgagggttcgggaccgttaccggggttggttaccgggaccgggaaagtaccgttacccgttacctaaccgtttacaacccgtaaccctacggtacgaacgtaccgtaaccggtacccgtaacggtaaccgtaaccggttaacgtaacgggtttaccgtttaacggttttaccgtttacgttaccgttacgtaccgttacggaacgtacgggttaccgttagggttaccgttaccggttccggtaccctaccggttccgttaccggttaccggttacccggggacggtaaccggggtaaccggtcggggtaacggtaacggtaacgtaaaccggtaacggtacggtgggtacccgtagtacgtacgtccggtacg

SEQ ID NO: 84600 - DNA, 786 bp, Homo sapiens
  misc_feature: GYAE6OF01D2UJU.47.46.E02.1.454.CMB.1.raw
  modified_base (189)..(189): a, c, t, g, unknown or other
  misc_feature (189)..(189): n is a, c, g, or t
  modified_base (261)..(261): a, c, t, g, unknown or other
  misc_feature (261)..(261): n is a, c, g, or t
  modified_base (267)..(267): a, c, t, g, unknown or other
  misc_feature (267)..(267): n is a, c, g, or t
  modified_base (371)..(371): a, c, t, g, unknown or other
  misc_feature (371)..(371): n is a, c, g, or t
tcagagctcacgtacacgaccggtgctcgatttagactcatctacagggaaaggggtctgagagaggagcccagccctgggattttcaggtgtttcatttggtgatcaggactgaaccgagagaactccaccatggagtttgggctgagctggctctttcttgtggtactttttaaaggtgtccagtgngaggtgcaactgtggagtcgtgggggatacttagtacacccgtcgggggtccctgacgactctcctgtcgcncgcctntggactctacctttagcctaactctgtcagtgggcgtgggtcccgccgtacggcggtaccggggggaagggtccgtgggacggttgggtactacgtaaaggttnttaggagttaggaaaggtaagttgggtaaggaacgtacgtaacgtaagtttaccgtacggtacgggtaaccgttccggtaacggggtaaaccgggggtccccggttactaaccccgacttacccgtacccgaaggtaactaaccgttaaagtttcggaaacggggtaccaccgtaaccggtcttaaggttaaccttaacctaaaacgtaaaagtaccgtaaaccgaccggtaccgtaagggaacggaccgaaccgggaaccgggaacccggtacccgggttacccgtttaagtttaaccgtttcgttacgggtaacggtaaccgttaaagttccctaagtaccgtcggtaaccggtcccgaccccccgtagccccgttacctcgttttccgtttacggcctttcgggtaccgggg

SEQ ID NO: 84601 - DNA, 633 bp, Homo sapiens
  misc_feature: GYAE6OF01CR8HD.47.46.E02.1.454.CMB.1.raw
  modified_base (183)..(183): a, c, t, g, unknown or other
  misc_feature (183)..(183): n is a, c, g, or t
  modified_base (186)..(186): a, c, t, g, unknown or other
  misc_feature (186)..(186): n is a, c, g, or t
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
  modified_base (264)..(264): a, c, t, g, unknown or other
  misc_feature (264)..(264): n is a, c, g, or t
  modified_base (272)..(272): a, c, t, g, unknown or other
  misc_feature (272)..(272): n is a, c, g, or t
  modified_base (290)..(290): a, c, t, g, unknown or other
  misc_feature (290)..(290): n is a, c, g, or t
  modified_base (345)..(345): a, c, t, g, unknown or other
  misc_feature (345)..(345): n is a, c, g, or t
  modified_base (353)..(353): a, c, t, g, unknown or other
  misc_feature (353)..(353): n is a, c, g, or t
  modified_base (371)..(371): a, c, t, g, unknown or other
  misc_feature (371)..(371): n is a, c, g, or t
  modified_base (394)..(394): a, c, t, g, unknown or other
  misc_feature (394)..(394): n is a, c, g, or t
  modified_base (420)..(420): a, c, t, g, unknown or other
  misc_feature (420)..(420): n is a, c, g, or t
tcagagctcacgtacacgaccggtgctcgatttagactcatctacagggaaaggggtctgagagaggagcccagccctgggatttttcaggttgttttcatttggtgatcaggactgaaccgagagaactcaccatggagtttgggctggagcggtgtcgtcttagtgtcgtattttaaaggntcngtgtgagtganatgtgntgtgggcagtnacgcggtgggcctganctctctgcgctncctgtcggctcgttaacgttcncctatctntcgtgtcggcgtcggccncgaggcggaccggggaaggtctgggcggtggtactagagtatgagtgaaagtggnggaccagnactagttccagtcgacgngtacggacggtccagctactacnccaaggcctataaaccgttgaagggngacgtacacgttagtactaacgtaacaacgtaacgtacgtaacgtcgtacgacgaacggaccggtaacggaaccgtacggttacccgttagtttacgttcgttcggtacggtacgtaaacgttacgttacgtaccgtacgtaccgtacccgtacccgtacccgtaccgttacccgttaccgtttacggtttaccggtttcgttcggtaccggg

SEQ ID NO: 84602 - DNA, 610 bp, Homo sapiens
  misc_feature: GYAE6OF01B77KG.47.46.E02.1.454.CMB.1.raw
  modified_base (206)..(206): a, c, t, g, unknown or other
  misc_feature (206)..(206): n is a, c, g, or t
  modified_base (294)..(294): a, c, t, g, unknown or other
  misc_feature (294)..(294): n is a, c, g, or t
  modified_base (449)..(449): a, c, t, g, unknown or other
  misc_feature (449)..(449): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggaagaaatagtgatgacgcagtctccagcccaccctgtctgtctctccgaaggggaaangccaccatctcctggtacgggccggtcagagtattagcatcaaacttgcctggtaccagcagagacctgggcaggctcccaggctccnatctatgatcgcgtccaccgagggcctacgtggtttcccagcctaggttcagtcggactaggtgcgtcgtgggaacagagtttccaactctcgaaccatacaacgacgcctgactagtctagaagtatttgacttaagtttattactgtacacgntagtatacaacgttaatcgggccgtctaccgtaccgtttaccggacccgtaaaggggacccaacgggaaccgttaggggaaacgttaaacggtttaaaaaccggaacgttcgggttacgggacccttacggaaccctaacccggtaatttccggttaccgg

SEQ ID NO: 84603 - DNA, 922 bp, Homo sapiens
  misc_feature: GYAE6OF01EQ9PA.47.46.E02.1.454.CMB.1.raw
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggcttctttcttgtggtactttttaaaaggtgtcctagtgtgaggtgcactgttggagtcgtggggagtacttagtaccgtacccggttcgggggtccctgacgacttccgtcctgtcgcacgtccgtcgtcgtacctccttacctttacgacctaactctcgtcgaggtcgggtcgtcgggtcccgccgtacgggtccggtaccgggggagggtcggtgggaggttcgggtactacgtaagttagttagagtagagtaaggtgggtagaacgtcctaacgttagttacgtacggtacggtacccggttacggtacggggtaaaccgggtccgttacccaaccgttacgttacccgtaaccgaacggtaacccgttaaaacgttaacgttttacggaacgggaaccgtaccgtaacggtacgtttaacgttaactttaacccgttaaaacgtaaacgttaacggaacccgtaacggtacccggttaagggaacggtaaccgggaaccccggggtaacggtaaacccgggttacccggggttaccttttaaacggtttaccgtttttaaaccgggcggtttaaaaccgggaaaccggttttaaaaacgtttcccgtttaaaagggtacccggttaacccgggttaacccgggttcccccccggtaaccccccccggttaagggtacccccgttaccccgtttttaaacccggtttttcccgggttaaacccgggtttttaaccccgggttccgggggttaaaccccgggggg

SEQ ID NO: 84604 - DNA, 641 bp, Homo sapiens
  misc_feature: GYAE6OF01D0NKA.47.46.E02.1.454.CMB.1.raw
  modified_base (138)..(138): a, c, t, g, unknown or other
  misc_feature (138)..(138): n is a, c, g, or t
  modified_base (201)..(201): a, c, t, g, unknown or other
  misc_feature (201)..(201): n is a, c, g, or t
  modified_base (227)..(227): a, c, t, g, unknown or other
  misc_feature (227)..(227): n is a, c, g, or t
  modified_base (289)..(289): a, c, t, g, unknown or other
  misc_feature (289)..(289): n is a, c, g, or t
  modified_base (300)..(300): a, c, t, g, unknown or other
  misc_feature (300)..(300): n is a, c, g, or t
  modified_base (402)..(402): a, c, t, g, unknown or other
  misc_feature (402)..(402): n is a, c, g, or t
tcagagctcacgtacacgaccggtgctcgatttagactcatctacagggaaagggggaggaactgctcagttaggacccagacggaaccatggaagccccagcgcagcttctcttcctcctgctatctggctcccagngaccactggagaaatgtgatgacgcagtctccagccaccctgtctgtctctccgaggggaaancgccacatctcctggacgggccggtnagagtatagcatcaacttgcctaggtaccagcagagaccgtgggcaggctccgaggctcctnatctagtggtncactccacggacggcctacgtggtacctccgagtcctaggttcaaggttgggctagggtgggtctaggggacaggtacgtttcaccgttaccacaacccgtntaccgacgcgacgtccgtagccgtagttacgtaggtaaagtttacgttttagaacttttaattttaactttacgttacggtactaaggtaactaagttaataagttaccgttcgtacctcgtaccgttcgggaaccgtaacggtacgtaaccggtaacgtagggtaacgtaaaccgttaaaacggtacggttacggtacggaccgttacggtaaccctacgtttactcgttcgtttacc

SEQ ID NO: 84605 - DNA, 589 bp, Homo sapiens
  misc_feature: GYAE6OF01DOWXJ.47.46.E02.1.454.CMB.1.raw
  modified_base (305)..(305): a, c, t, g, unknown or other
  misc_feature (305)..(305): n is a, c, g, or t
  modified_base (346)..(346): a, c, t, g, unknown or other
  misc_feature (346)..(346): n is a, c, g, or t
  modified_base (357)..(357): a, c, t, g, unknown or other
  misc_feature (357)..(357): n is a, c, g, or t
  modified_base (409)..(409): a, c, t, g, unknown or other
  misc_feature (409)..(409): n is a, c, g, or t
  modified_base (466)..(466): a, c, t, g, unknown or other
  misc_feature (466)..(466): n is a, c, g, or t
tcagagctcacgtacacgaccggtgctcgatttagactcatctacagggaaaggggtctgagagaggagcccagccctgggattttcaggtgtttcatttggtgatcaggactgaacagagagaactcaccatggagtttgggctgacctggctttttctgtggctattttaaaaagtgtccagtgtgaggtgcagctggtggagtcgtgggggaggcttagtacacccgtggggggtccctgacgactctcctgtgcagcctctggactcgaacctttagcaactctgtcagtgggctgggccncaggccgtccgggggaagggctggacgtgggtctcgaagtnttgatacgganaagtggtggaagcaatattctacggtggaccgtcgaggaacgggtccggtanaccgatctcgaagcaatattacgaggacacaaggcctagtatcctaacaaatcgaanagtcgtagaagtcggaccgaggccacggtactaatacgttctaggtacgacgtaaagtcctaagtaaggctaacgtccgtaccccctaggccgtactaccgtttcgttacgtcctttacgggg

SEQ ID NO: 84606 - DNA, 854 bp, Homo sapiens
  misc_feature: GYAE6OF01CZVME.47.46.E02.1.454.CMB.1.raw
  modified_base (206)..(206): a, c, t, g, unknown or other
  misc_feature (206)..(206): n is a, c, g, or t
tcagagctcacgtacacgaccggtgctcgatttagactcatctacaggggaaagggggaggaactgctcagttaggacccagacggaccatggaagccccagcgcagcttctcttcctcctgcttactctggcctcccagagaccactggagaaatagtgatgacgcagtctccagcccacctgtctgtctctaccgaggggaaancgccaccatctccgtggtacgggccggtcaagtagtatacgcatacaacttagccgtaggtaaccaggacgtaaggacggtacccgtgggggaccacggggccttaccccgaagggtccttcccctactaacttccgttaaggtcggttcgaccgtaaccgtccccgaaaccggtaccggggaacccttaacggttacgggttaaccctcccccggaacggtccgtaacgggtttcgaacggttggaccgtagggtcggtaacgtttcgggacgggtaactacgtaccttccgtaaccttcctacctaaccgacttacccgagtacccgtacggtaaccccgtaaggtaaccgtacccgttaaagggtaacgttttacggtttttacgaacccttttacgtttttaaacgttaccgttttacgggaacccttaagggtaccgtaacgggttaccggttaaaacgtacccgggttaactttccggttaacccctttaccggttccggtttaacccggttttacccgggggaccgggggtaaacgggggttaacccggtaaggggggtacggaagggttacccttaacggaaacgggttaaccgttaacggttcggttaaaccgggcgttaaccgggctaacccgttacg

SEQ ID NO: 84607 - DNA, 656 bp, Homo sapiens
  misc_feature: GYAE6OF01DMOFZ.47.46.E02.1.454.CMB.1.raw
  modified_base (620)..(620): a, c, t, g, unknown or other
  misc_feature (620)..(620): n is a, c, g, or t
  modified_base (622)..(622): a, c, t, g, unknown or other
  misc_feature (622)..(622): n is a, c, g, or t
  modified_base (624)..(624): a, c, t, g, unknown or other
  misc_feature (624)..(624): n is a, c, g, or t
  modified_base (629)..(656): a, c, t, g, unknown or other
  misc_feature (629)..(656): n is a, c, g, or t
tcagagctcacgtacacgaccggtgctcgatttagactcatctacagggaaaggggctggagtgggtctcaagtattgatgagaatggtggaagcacattctacgtggactccgtgaagggccggttcaccatctccagagactaatttcaggagcacgctgtatctaacaaatgaacacgcctgaagacggaccggaaggaccgaccggtccgtattatttcgtgtgacgtaaagtctagtacgcacgtccgaccccctacgccgccttacttttcttcgtacttcggcggggtaccgaaggtactccgtcggtcctacccgtcctaccacaccgccctaccgaaccggaaccggcctacgttcccggttccccttccccgtcggcccgtcccctacgtcctaccggacggaccgtacccgaacccgtccggaacgaccgaccgaacccggaccgggtcccggtccccggtcgggcccgttaccggtcccggttacgggtaacccgtaaaccggtaccccgttttaacccgtacccggttacgggtttaccacgggttccgttaccggtcggggtaacgggccgggtcggtacggaacggaccggggtcaccgttaagngnancagtnnnnnnnnnnnnnnnnnnnnnnnnnnnn

SEQ ID NO: 84608 - DNA, 879 bp, Homo sapiens
  misc_feature: GYAE6OF01ETE9H.47.46.E02.1.454.CMB.1.raw
  modified_base (153)..(153): a, c, t, g, unknown or other
  misc_feature (153)..(153): n is a, c, g, or t
  modified_base (194)..(194): a, c, t, g, unknown or other
  misc_feature (194)..(194): n is a, c, g, or t
  modified_base (198)..(198): a, c, t, g, unknown or other
  misc_feature (198)..(198): n is a, c, g, or t
  modified_base (253)..(253): a, c, t, g, unknown or other
  misc_feature (253)..(253): n is a, c, g, or t
  modified_base (442)..(442): a, c, t, g, unknown or other
  misc_feature (442)..(442): n is a, c, g, or t
tcagagctcacgtacacgaccggtgctcgatttagactcatctacaggggaaagggggaggaactgctcagttaggacccagacggaaccatggaacgccccagcgcagcttctcttcctcctgctactctggctcccagagaccacgtgganaaatagtgatgacgcagtcctccgacgccacccttgtcctnttcncgtacgaaggggaacacgccctacacgttcctccgttaggtacgggtcccggtanaggtaattattacggactattccgaaaacttacgccttagggaaccaggtaccaggaacggtacccgtagggccgacgggtaccctaccccgaaggttccctaccgttacaagttcccgttaagttggaaccgttcgaccccggaccctaaccgggacggttaccctaccggttttcggttaaaccccncggtaccggttaacgggttccgaacgggtcgggtactaccggggttacggccgggttaccggttaacggggaaaccctagggtttaacccggtttccaaacccgtttactacccggaaaccctttacgtaacccgaaacggttaccgcccgttacgtaacccggtaggtttaacccgtaagggttaacgtttaacgtttacggtaccgttttaaacggtttttccgtaacggtttatacgttaacgggtacttaacgttaaccgtacgttaaaacgttaccgggtacccgtaccggtttaccctacccggttaacccggttaccggaacccgggttaaacggaaccgttaacggtaaaccggttaggtaaaccgggtaattaaaaccgagttacgggtaacgtcgttacggaccgttaaaccttggtcctttacggg

SEQ ID NO: 84609 - DNA, 755 bp, Homo sapiens
  misc_feature: GYAE6OF01B3FNQ.47.46.E02.1.454.CMB.1.raw
  modified_base (194)..(194): a, c, t, g, unknown or other
  misc_feature (194)..(194): n is a, c, g, or t
  modified_base (705)..(705): a, c, t, g, unknown or other
  misc_feature (705)..(705): n is a, c, g, or t
tcagagctcacgtacacgaccggtgctcgatttagactcatctacagggaaaggggtctgagagaggagcccagccctgggattttcaggttgttttcatttggtgatcaggactgaaccgagagaactcaccatgggtagtttgggctgagcgtggtcttcgtttacgttggtacggttacgtttttaaaggngttaccaggtgtgaggtgacctagttggtacgggtagttcggtaggggtatacgttacgtaccggtacccgggttgggggtccctaggaccgtaccgttccgttccgttaggtcgtaccgacggtaccttccggtacggtaccttacctaaccgtttacgtaccgtaacgtttcgtacggtctacgggtcgggtcggtcgggtcccgacgggtacggggtaccgggtacgggggtaacgggtcggtagggtacgggttcgggttaacttacggtaaagttacgtttggaagtagggtaaggtaggtacggggagtacgacaggtttactacggtcggtacggacgtttacggagggtacggtcgtaccaactcgtacacgtaatacgtacgtacgcggagtcacgtacggtatagtactaacaacgaagttacaaccgtgacgtaacggagacgtacggcgtaacggtccgtagttagttctagtcgaagtagactagagtccgagtcccnccccggtacgtccttacgtccctttagctttccggacggttccgtacggg

SEQ ID NO: 84610 - DNA, 746 bp, Homo sapiens
  misc_feature: GYAE6OF01DBHNY.47.46.E02.1.454.CMB.1.raw
  modified_base (200)..(200): a, c, t, g, unknown or other
  misc_feature (200)..(200): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggaagaaatagtgatgacgcagtctccagccacctgtctgtctctcgagggaancgccaccatcctccgtggtacgggccgtcagagtatagctatcaacgttgccgtaggtaccagacacgagaccgtgggcacggcctacccgaggtcctccctcgacgttccgtaggggtactcggacaacctacccgaaacggcggggcccgtcgtacggccctaccgtccccgaggtacccgtaggttaccgaggttcgggacgttaggggtttcgggtaccgtaggggtaacctacggttaccctttacccgaaccgtttcccgtaaccctacccgtaacgttaccgaaccggtaccgtaaccggtacccgttaaacggtaccgtaccgtttaagggtaaacgttttacgttttacggtaaccttttaggttttaacgtttaccgttaggttaccgtaacgtacgttaaacgttactaacgtaacgttaacgtccggtaccgtccgttacccgtaccgttaccggaccgtaaccggacctacggacgttaggaagtaaccgtaaacgtcgtacggtacgacgtaccgactaacgttcgttaccg

SEQ ID NO: 84611 - DNA, 746 bp, Homo sapiens
  misc_feature: GYAE6OF01AKUDT.47.46.E02.1.454.CMB.1.raw
  modified_base (161)..(161): a, c, t, g, unknown or other
  misc_feature (161)..(161): n is a, c, g, or t
  modified_base (219)..(219): a, c, t, g, unknown or other
  misc_feature (219)..(219): n is a, c, g, or t
  modified_base (248)..(248): a, c, t, g, unknown or other
  misc_feature (248)..(248): n is a, c, g, or t
  modified_base (704)..(704): a, c, t, g, unknown or other
  misc_feature (704)..(704): n is a, c, g, or t
tcagagctcacgtacacgaccggtgctcgatttagactcatctacagggaaagggggaggaactgctcagttaggacccagacggaaccatggaagccccagcgcagccttctcttccctcctgctactctggcctccagacgaccacgtggagaaatgtnatggacgtcacgtcctcaccgacctccctgtccgtctcgttccgacgagggaaacgcnccaccgatcctccgtaggacgggccggtnagtacgtatacgcatacgtacgtcgtcgtacgacagacgtacggacgtaccggtggccgtaccggtacccgtccgacggtcccttacctacgtacgttacctgtaacggtctccggtacccgttaaccgaaccgggttacgaccccgtttaccggttaccggttaccccgaggttaccgttacggttaccgtaacggtcggacgttggtcccggtacgtacggacgggtactacggtactccctacgtcaccgtacctagactacgcgtcccagtaccgtcggtacgttaacggtaagtttaccgttagttaccggtttaagttacgttactacgtacgtactaagttacgtaacttacgttaccgtaacgtccgtacgtaccctaccggttaccggaacccggtacgaaccggtacgtaccggtaacggtacggttaaagaccggtttaaaccgnggttaccgagggttcaccgtacgacttccgttacgttacccg

SEQ ID NO: 84612 - DNA, 709 bp, Homo sapiens
  misc_feature: GYAE6OF01DTPIW.47.46.E02.1.454.CMB.1.raw
  modified_base (464)..(464): a, c, t, g, unknown or other
  misc_feature (464)..(464): n is a, c, g, or t
tcagagctcacgtacacgaccggtgctcgatttagactcatctacagggaaaggggtctgagagaggagcccagccctgggattttcgaggttgttttcatttggtgatcaggactgaaccgagagaactcacatggtagtttgggctgagcgtggtcttcttttcgttggttggttacttttttaaaaggtcgtccgtagttgtgtagtgtgactaacgtggttggacgtcggtgggggactacgttacgtaccgacccggttcgggggtccctagacgtcttcctccgtgtcgacacgtcctcgtacggaccttacttaccttacgacctacttcgtgtctaggtcggtcgtcggtccgcgacgggcgggtacggggagggtcgtgggtacggtcggtcacggagtcgtggttggtagggtgtcggtacgccgtaagactagtacgttaacgtaacgtccgngacgacggtctatttcttgtaccacgtacgtacgaacttacgacgtaacgtaactagttccgtagtcttacgagtcgttagtacgacgtacgaggtaccgaggtacgaaggaccgtaacgtccgttaagttattaggtttacgtaggttaacgtaggtggtaggttacggtcggtacgtacggttcggtacccgggtacggggtaccccgttacgttccgtacccgtccgttcgttaaccgtccg

SEQ ID NO: 84613 - DNA, 734 bp, Homo sapiens
  misc_feature: GYAE6OF01BX3HC.47.46.E02.1.454.CMB.1.raw
  modified_base (213)..(213): a, c, t, g, unknown or other
  misc_feature (213)..(213): n is a, c, g, or t
tcagagctcacgtacacgaccggtgctcgatttagactcatctacagggaaagggggaggaactgctcagttaggacccagacggaaccatggaagcccagcgcagcttctcttcctcctgctactctggctccagtacttccaccggagactatttgttttcgactacagtctccagcccaccttgttctttcgtctaccgaaggggaaacncgccctaccctcgtcctcgacgacgggcctacgtcgaaggtaggttgttcggactagtacttacgttaacggccgttacggtaacccaaacgaacggtaaaccgtcgggacctaacgggtcctcccgtaacggtccttaccgtacgtaacttcgtaatcggtaactcgacctaacgtacccggaaacgcgggtaccctacggttccgaccgtaacctcccgacggtacctagggttccaagggtcggactaggggtacgtacggtcggtacgggaactacggttccctacgtaacgtcctaacgacctagtacccacgtcctacgtaccgtacgacgtacgtacgtaagttacttactactttacttacgttacgtcgtacgtacgtcgtaacgtcgtaacgtacctaaccggttcgtaccttcgttaccgtcggttacgggacgggtacgggtacgtagggtgaacgtcgttacggacggtacgtacggtacggtcgtacgacgacgtactcgttgtccg

SEQ ID NO: 84614 - DNA, 723 bp, Homo sapiens
  misc_feature: GYAE6OF01EVNHD.47.46.E02.1.454.CMB.1.raw
tcagagctcacgtacacgaccggtgctcgatttagactcatctacagggaaaggggtctgagagaggagcccagccctgggattttcaggtgtttcatttggtgatcaggactgaaccgagagaactcaccatggagtttgggctgagctggcttctttcttgtggtactttttttaaaaggtgtccagtgtgaggttgctaactgttggagtcgtgggggagtacttagtaccacccgtggggggtccctggacgacctctcctgtcgcacgcctcgtcggtaccttcctacctttacgacctaacctctgtactagtggcgtcgggtcccgcgacggtcggtccggggaagggcgtgggaggttcgggtactcgtagttgtgatgagagtggtagagcatattacgtagtcggtactcgtaggaacgggtccgtacacgtatcctacaggacacttaagttcgaagcgactcggtacttacgtaactaccgtaactaaaaggtccgaaacgttcggtaccgtaggaacggaccgggtaccgggaaacccggacggttaacccgggttccctttaaggttaccgtttcgttcggaaacggtaccgttaaaagtacccgtttaggaaccgttccggaaccgtttaccccggacccccgtaacggtcctaaacccggtttcgttttaacctttcggtaacccgtttccgggggtaaacccgggg

SEQ ID NO: 84615 - DNA, 673 bp, Homo sapiens
  misc_feature: GYAE6OF01AV2P5.47.46.E02.1.454.CMB.1.raw
  modified_base (203)..(203): a, c, t, g, unknown or other
  misc_feature (203)..(203): n is a, c, g, or t
  modified_base (290)..(290): a, c, t, g, unknown or other
  misc_feature (290)..(290): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtcctccagcccaccctgtctgtctctccgagggaancgccaccatcctctgcgaggccagtcagtagtattagcagactaacttagcctaggaccaggacaacggaaccttggacacggtccncccgaggtcctcctacgacttactataggactcgaccactacccgaacggaccgggaccacgtcggaccctactacccgaaggtaccgtacggttcgaacggtggaccggtagggtcgggtacgtacgggactacgttaccgtcacttccgaccacctagtaccagtacctacgtaccgaggtactcccggtaagtacgtttacgttacggtttaactttacgttacgttcgactaacggccgtaggtcgttcgtaacgttccgtcggccccttcgacgttcccggttacgggtaccggggacgggtacgggtaacccggtagggtacggtaacgtacgtaaaccggtaacgtacggtcggaagtccgtaccgtcgtaacccg

SEQ ID NO: 84616 - DNA, 528 bp, Homo sapiens
  misc_feature: GYAE6OF01CV905.47.46.E02.1.454.CMB.1.raw
  modified_base (493)..(493): a, c, t, g, unknown or other
  misc_feature (493)..(493): n is a, c, g, or t
  modified_base (502)..(528): a, c, t, g, unknown or other
  misc_feature (502)..(528): n is a, c, g, or t
tcagagctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgacgaaagtctatagcagtcgccccctacgcgctacttcttgactttcgtggggccagggaactccgtggtccaccgtctccacacgcctacccaccgaacgggccccacttccggtcccttccccccgtggcccgtcccctcgccctccgacgggacgccaccctccgaagacgccacgacggcccggcccgtgggcctcggcccgttcggacgtaaggtacccttacttacccgtacgtggacgtcctcgtggacggccgggctcgggacgaaggccgnaagtacggnnnnnnnnnnnnnnnnnnnnnnnnnnn

SEQ ID NO: 84617 - DNA, 728 bp, Homo sapiens
  misc_feature: GYAE6OF01BR5EA.47.46.E02.1.454.CMB.1.raw
  modified_base (330)..(330): a, c, t, g, unknown or other
  misc_feature (330)..(330): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagttgggctgagctggctcttcttgtggtactttttaaaggtgtcagtgtgaggtgctactgttggagtcgtgggggatacgttagtacctacccggtgggggtccctgacgtactcgtcctgtcgcgacgtcctcgtggacctcctaacctttacgaccaacttctagtcagtcgggcgtcgggtcccgccgngggccggtacgggggaagggcgtgggacggttggggtcctagtaagttgtgtaagtacgaaggtaagtggtacggaacgctaactacgttacgtacggtcggtaccgtcggtacgggtaaccgggtcccggtacctaaccacgttcccgtaccgtaaggacgtaaccgttaacgttcggtaagacccggaactacgtacgttaagtactaacctaaacgtaaagtacgaaacgtgttacgaggacgaccggaccggtaacggacgacccggttactagtttcgttcggagtacggacgttaaaccgtgttacggacctagtaccggttccccggtacccccgagtacccggttacctttaccgttttccgtttacgtcccggtttcggaacccggggg

SEQ ID NO: 84618 - DNA, 671 bp, Homo sapiens
  misc_feature: GYAE6OF01APWEL.47.46.E02.1.454.CMB.1.raw
  modified_base (192)..(192): a, c, t, g, unknown or other
  misc_feature (192)..(192): n is a, c, g, or t
  modified_base (204)..(204): a, c, t, g, unknown or other
  misc_feature (204)..(204): n is a, c, g, or t
  modified_base (232)..(232): a, c, t, g, unknown or other
  misc_feature (232)..(232): n is a, c, g, or t
  modified_base (264)..(264): a, c, t, g, unknown or other
  misc_feature (264)..(264): n is a, c, g, or t
  modified_base (308)..(308): a, c, t, g, unknown or other
  misc_feature (308)..(308): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggcctcccagagaccactggagaaatagtgatgacgcagtctccagcccacctgtctgtctcnccgaggggaaancgccaccatcctcctggtacgggccgtnagagtatagcatcaacttgccttgacagcagngacctggcaggcctcccgacggtcctccctacacttcgttaacncgtagtacgcccgtaccgaccgacgggtcctaccgttacggtttccccgacgtacccgtaggttaccaggttacggcgtaggttcggccggttacgtacggggtacctaagggttacgttaccctaccggttcctacccacccgactacaacctaacggtcctacggactaacgttccgttaggaaagtttcgtttcgacttttaagtttacctttcgtacgttccgtagtaccttagtaacctacgtacgtaaccgtcgggtacctcgtacctaccggttaccgaccggtaacggaccgtacggagttacggaacgttaacgtaaccgagttcggacgtcgacctctacctattccggttac

SEQ ID NO: 84619 - DNA, 525 bp, Homo sapiens
  misc_feature: GYAE6OF01A7NZ2.47.46.E02.1.454.CMB.1.raw
  modified_base (212)..(212): a, c, t, g, unknown or other
  misc_feature (212)..(212): n is a, c, g, or t
  modified_base (265)..(265): a, c, t, g, unknown or other
  misc_feature (265)..(265): n is a, c, g, or t
  modified_base (296)..(296): a, c, t, g, unknown or other
  misc_feature (296)..(296): n is a, c, g, or t
  modified_base (355)..(355): a, c, t, g, unknown or other
  misc_feature (355)..(355): n is a, c, g, or t
  modified_base (493)..(493): a, c, t, g, unknown or other
  misc_feature (493)..(493): n is a, c, g, or t
  modified_base (495)..(496): a, c, t, g, unknown or other
  misc_feature (495)..(496): n is a, c, g, or t
  modified_base (498)..(499): a, c, t, g, unknown or other
  misc_feature (498)..(499): n is a, c, g, or t
  modified_base (501)..(525): a, c, t, g, unknown or other
  misc_feature (501)..(525): n is a, c, g, or t
tcagagctcacgtacacgaccggtgctcgatttagactcatctacaggggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgttatatttcngtgacgaaagtctatagcagtccgccccctagcgctacttctttgactttcgnggggcagggactccgtggccaccgtctcacncgccctcccacgacggccctcgtccgtccttccccgtggccgccctgcctccgacgacnccacctcgagacgacacgcggccggccgtagggcctcggccgttcggacgaacggtccttaccgttaccgtacggtcgtagtcctacgttggacgggtcggtcggtaggaccggtaacgggccgtcgaagtaggcagngnngnngnnnnnnnnnnnnnnnnnnnnnnnnn

SEQ ID NO: 84620 - DNA, 925 bp, Homo sapiens
  misc_feature: GYAE6OF01ET9GO.47.46.E02.1.454.CMB.1.raw
tcagagctcacgtacacgaccggtgctcgatttagactcatctacagggaaaggggtctgagagaggagcccagccctgggattttcaggtgttttcatttggtgatcaggactgaaccgagagaactcaccatggtagtttgggctgagctggtcttcttttcttggtaggttacttttttaaaaggtgtcctaggtgttggaggtgactaacttggttggagttcggtgggggagtacgttacgtaccgtacccggtcgggggtccctgacgtaccttcctccgtggtgcacgtcctacgtcggtaccttctaacctttagactaaccttcgttcgtactaggtcgggtcgttcgggtcccggccgtacgggtccgggtaccggggggagggttcggtacgggggtaggttacgggttactacgtaaggttagttggtacgtaggtaaggtaagggttacgggtaggaaacgtaccttaacgttagtttaccggtaaccggtcgggtaacccggttaccgggtaacggggtaaccggggttccccggttaaccgtaaccctaacgttacccgtacgtaacggtaaccgttaaacgttaaccggtttacggaacggggttaccgtaacccggttaacggtacgtttaacgttaaccttaaccgttaaaaccgaaaacgttaacggtaaaccgttaggttaacccggaggtaacgggaaccccggtaacggaacggtaaccccgggttaacggttaccgttttaaacgtttacgttttccggtaaggttaacggtaaaccgtttaaaaggttccttaagggtccgtaaccggtaccccggttccccggacccccgttaaacggcccgtttacccgttaacgttttacccgggtttcgttacccgggttccgggttaacccggggg

SEQ ID NO: 84621 - DNA, 924 bp, Homo sapiens
  misc_feature: GYAE6OF01DK0YU.47.46.E02.1.454.CMB.1.raw
tcagagctcacgtacacgaccggtgctcgatttagactcatctacagggaaaggggtctgagagaggagcccagccctgggattttcaggttgttttcatttggtgatcaggactgaaccgagagaactcaccatggtagttgggctgagctggcttctttcttggtggttacttttttaaaaggtgttcctagttgtgaggtgactaacttggttggaggttcggttggggggaacttaccgttaacggttaacccgtaccccgggttcgggggggttacccctggaacggtaccttccgttcccgtggtcgaccgtacgtcccgttcgtccggtactccttaacccgtttaagacctaaacctttctacggttacgtacggttcggggtccggtccggggtccccggacccggtaacgggggtcccgggggtttaacccgggggggaaagggggtccggttagggggtacggtttacggggtttacccgttaaggtaaagtttagtttaaggaaggttaggaagggttagttaggggtaaggtaaccgtactaacgtaacgtttaccgtacggtacggttaccggtcggtaagggaccgggggttcccgttactaaccctacttacccgtacgaaggtaaccgtacgtttaacgttacggaagggacgacgtaacggtcttacgttaacgttacctaaactaaaccgttacgaaacgtacggacctagggtacggaaccgacccgggtaaaggaccccgtaaccgggttacctttaacgtttaagtttccgttagggtaccgtaaacggttagttaaccggtagtaccggtacgttaacccgggtccccgtacccccgtagacccgttacccgtttaccctttttccgtaaccgggttttcccggtcgggttaccccggggg

SEQ ID NO: 84622 - DNA, 636 bp, Homo sapiens
  misc_feature: GYAE6OF01EPQTB.47.46.E02.1.454.CMB.1.raw
  modified_base (200)..(200): a, c, t, g, unknown or other
  misc_feature (200)..(200): n is a, c, g, or t
  modified_base (225)..(225): a, c, t, g, unknown or other
  misc_feature (225)..(225): n is a, c, g, or t
  modified_base (252)..(252): a, c, t, g, unknown or other
  misc_feature (252)..(252): n is a, c, g, or t
  modified_base (293)..(293): a, c, t, g, unknown or other
  misc_feature (293)..(293): n is a, c, g, or t
  modified_base (312)..(312): a, c, t, g, unknown or other
  misc_feature (312)..(312): n is a, c, g, or t
  modified_base (412)..(412): a, c, t, g, unknown or other
  misc_feature (412)..(412): n is a, c, g, or t
  modified_base (443)..(443): a, c, t, g, unknown or other
  misc_feature (443)..(443): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctcgagggaancgccacatctccgtgtaggcccgtnagagtatagcatcaattgcctggtacngcagagaccgtggcacggctccaggcctccgtcagtctagngtagtcgcctaccgaccgnggaccctacggttcggttaccccagtccgtaaggttcaggtcggactaggtcgcgtcgtaggacagtacgttcgcttaccgtaccaacgtatccgaaacngtcccgtagacgtagtacgtaggtaaacgtnttttcgaacttagttttacgttacttggactaacgtctaagttacttacggtaacttacggtcgggtacctcgtaccctaccgttcgggaaccaaacggggtacctaccggtacgtacgggtaaaggtaacgtttaaacccggacgttaacggtcgggtaccctacgttaacgacccgttacgtcgtttaccg

SEQ ID NO: 84623 - DNA, 659 bp, Homo sapiens
  misc_feature: GYAE6OF01BBKJZ.47.46.E02.1.454.CMB.1.raw
  modified_base (155)..(155): a, c, t, g, unknown or other
  misc_feature (155)..(155): n is a, c, g, or t
  modified_base (179)..(179): a, c, t, g, unknown or other
  misc_feature (179)..(179): n is a, c, g, or t
  modified_base (193)..(193): a, c, t, g, unknown or other
  misc_feature (193)..(193): n is a, c, g, or t
  modified_base (341)..(341): a, c, t, g, unknown or other
  misc_feature (341)..(341): n is a, c, g, or t
  modified_base (386)..(386): a, c, t, g, unknown or other
  misc_feature (386)..(386): n is a, c, g, or t
  modified_base (623)..(623): a, c, t, g, unknown or other
  misc_feature (623)..(623): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcggtgngtcttagtgtgtacttttaaaggntcagtgtgaggtgnaacttgtgagtcgtgggggatacttagtacaccggtgggggtccctggagtctctccgtgcgcagtcctcgtggactctaccgtttagcctaactctactcgagtcgggcttcgggccgacgacgggccgtccgggggaaggcgtggnggtggtctgaagttagtagtataggaagtaggtacggtaggtaanaccgtaacgtacttacggttacggttacggacggttacggttaccggaacgggtccccggttacaacccgttagtacccacgagtaacgacttaacgtacgaacggagtccgacctagttagactttaaccgtaaacgtaaagtacgaaccaagttcccaggacggaaccgcgtacgaccgtacggtccttaattccgtagtgtaacacgttaatcgatagcgtacgccctccgacnccgtaccttacgttccgttgtccgttcggtaacggg

SEQ ID NO: 84624 - DNA, 657 bp, Homo sapiens
  misc_feature: GYAE6OF01D7IID.47.46.E02.1.454.CMB.1.raw
  modified_base (156)..(156): a, c, t, g, unknown or other
  misc_feature (156)..(156): n is a, c, g, or t
  modified_base (182)..(182): a, c, t, g, unknown or other
  misc_feature (182)..(182): n is a, c, g, or t
  modified_base (220)..(220): a, c, t, g, unknown or other
  misc_feature (220)..(220): n is a, c, g, or t
  modified_base (266)..(266): a, c, t, g, unknown or other
  misc_feature (266)..(266): n is a, c, g, or t
  modified_base (384)..(384): a, c, t, g, unknown or other
  misc_feature (384)..(384): n is a, c, g, or t
tcagagctcacgtacacgaccggtgctcgatttagactcatctacagggaaaggaggctctgagagaggagcccagccctgggattttcaggtgttttcatttggtgatcaggactgaaccgagagaactcaccatggagtttgggctgagcgtgngtcttacgtgtgactttttaaaaggngtccagtgtgaggtgcaactgttggagtcgtggggganacttagtaccacccgtgggggtccctgagctctcctgtgcagcctntggactcacctttagcaactctgtcagtggctcgggtcccgccgaggccgttccgggggaagggctgggaggtgggtcctagaagttagttgaatcggagaaacgttggtacgggaanacacgtagttacgtacggtcgtacgtccggtaggaaccggtccgtaccacctacgtaccgtacgacgaacgtacttaacgttcgaagacgaccgtaccgtgttacgtaactacctaaataaagtacgaacgtacgtacgtaaggacggaacggaccgtaaggaaccgaccggttacgttaacgttacgttcgtaggacgtaaccgtaacgttcgtaagacgtaccgtacgtacccgaccccgtacgacctaccgttaccgtttctcggtaccg

SEQ ID NO: 84625 - DNA, 722 bp, Homo sapiens
  misc_feature: GYAE6OF01CJQD9.47.46.E02.1.454.CMB.1.raw
  modified_base (383)..(383): a, c, t, g, unknown or other
  misc_feature (383)..(383): n is a, c, g, or t
tcagagctcacgtacacgaccggtgctcgatttagactcatctacagggaaagggggctctgagagaggagcccagccctgggattttcaggtgttttcatttggtgatcaggactgaaccgagagaactcaccatggagtttgggctgagctggctctttcttgtggtacttttttaaaaggtgtccagtgtgaggtgcaactgttggagtcgtggggagtacgttagtaccacccggtcgggggtccctgagactctccgtgtcgcacgcctcgtcggactcctaccgtttacgactaactctcgtcagtcgggtcgtcgggtcccgccgacgggtccggtaccgggggaaggggcgtaggagggttcggggtcggcggtntacgtacgtccgtcgagtcggactcgtacttcgtaacgttacgttacgcgaacgtaccgtcccgtagggacgggtcctacgttacaccactcctacgaagacaactaacgttacccaacgaaccgtacggtctactcgtccgacctaccgtacgaacccgacgtacccgtaggaaaccgaccggttcgaaacccggtactacccgttcttaccgttacccttaaccgtacgtcggtacggacggtaagtacgggttaaggttccggtaaacgttccgttaagttacggtttcgggacgtaaccggttttccggttacccggtcccggttaccccggggg

SEQ ID NO: 84626 - DNA, 585 bp, Homo sapiens
  misc_feature: GYAE6OF01C6G84.47.46.E02.1.454.CMB.1.raw
  modified_base (254)..(254): a, c, t, g, unknown or other
  misc_feature (254)..(254): n is a, c, g, or t
  modified_base (300)..(300): a, c, t, g, unknown or other
  misc_feature (300)..(300): n is a, c, g, or t
  modified_base (356)..(356): a, c, t, g, unknown or other
  misc_feature (356)..(356): n is a, c, g, or t
  modified_base (478)..(478): a, c, t, g, unknown or other
  misc_feature (478)..(478): n is a, c, g, or t
  modified_base (512)..(512): a, c, t, g, unknown or other
  misc_feature (512)..(512): n is a, c, g, or t
tcagagctcacgtacacgaccggtgctcgatttagactcatctacaggggaaaggccaccatctcctgtagggccggtcagagtatagcatcaacttagcctggtaccagcagagacctgggccaggctcccaggctcctcatctatgatgcgtaccaccgagggccactggtttcccagccaggttcagtggcagtgcgtctgggacagtagttccactcctcaccatcaacacgcctgctagtctagaagtntttgctaagtttattacctgtacagctagtatcaatacgtcggccnctacctccgttacgaccaagggaccacggtactaggagtaactaaacgatggtcgntacgactactatcgtcgtacttacgactttcctacccgtatactcgtacggaataccggtgtacgtctacgtacggacgtcgggtaccgtcgggaactaagggccgtaccgttaaggacccngtccgaagtacggactagcgtaccaggctaaccncgtacgtcgtactacgtacgactacgtcgtagtacgtcgtacgtagtacgtacgtacgtacgactcgtgtacg

SEQ ID NO: 84627 - DNA, 788 bp, Homo sapiens
  misc_feature: GYAE6OF01AREZN.47.46.E02.1.454.CMB.1.raw
  modified_base (173)..(173): a, c, t, g, unknown or other
  misc_feature (173)..(173): n is a, c, g, or t
  modified_base (186)..(186): a, c, t, g, unknown or other
  misc_feature (186)..(186): n is a, c, g, or t
  modified_base (615)..(615): a, c, t, g, unknown or other
  misc_feature (615)..(615): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcacatggagttgggctgagctgctctttctgtgtcttttaaagtntcagtgtgaggtnctactggtggtagtcggtggggatacgttagtaccgaccggttcgggggtcctagtaggtacctccgttcctcggtcgtccgtacgtcctcgtcggtacctaccgttacccgttagtacctaaccgttcttacggtactacggtcgggttccgtccggggttaccccgacggtaaccgggtcccgggtaacgggggggtaacgggtcggtacgggtacggggttcgggtaccgtaccggagggtacgtacgtttcggggtacgggttagggttcgggttaccgaccggaggaacccgtacgttaaacggttacggtaaacccgtcgtcggaccggtacgggtaccgttacttttaccgttactccgttaacgacgtacgtaacgtaacccgttacgaacggtactaacgttacgtagttacgtttaacnccgtaacggtacttaccggactacgtaacgtaggtagaacgggtacgacggttaacggtacgtacgttattacgttaggtattacggtaagtcgtagtcggacgttcgtcgtacggttccggacggggtacccgttaaccgtcgtaccgtaccgttcctaccgttcgtaccgg

SEQ ID NO: 84628 - DNA, 605 bp, Homo sapiens
  misc_feature: GYAE6OF01CMLPE.47.46.E02.1.454.CMB.1.raw
  modified_base (202)..(202): a, c, t, g, unknown or other
  misc_feature (202)..(202): n is a, c, g, or t
  modified_base (229)..(229): a, c, t, g, unknown or other
  misc_feature (229)..(229): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctcagccaccctgtctgtctctccgaggggaaancgccaccatcctcctggtagggccgtnagagtatagcatcaacttgcctggtaccagcagagacctgggcaggcctcccgaggcctcctcatctatgatcgccgtccacgacgggcctacgttcggttacccagtccctaggtttccaggtggactagggttcgggtcgtagggactaggtacttcgactccgtcacctatcagcagcctagcgccgtagaagttatttgacttagtttacttactgtaccgtagactaaacgtaatccgtaggcccttaccgcttaccgtacgtttccgggacgggtaacgggaccggtagggtcggtaactacggtaacggaaaccggtaacgttggtacggtactacgtaccgtacctagttccgtgtttcccttaaccg

SEQ ID NO: 84629 - DNA, 824 bp, Homo sapiens
  misc_feature: GYAE6OF01CCI2I.47.46.E02.1.454.CMB.1.raw
  modified_base (501)..(501): a, c, t, g, unknown or other
  misc_feature (501)..(501): n is a, c, g, or t
tcagagctcacgtacacgaccggtgctcgatttagactcatctacagggaaaggggtctgagagaggagcccagccctgggattttcaggtgttttcatttggtgatcaggactgaaccgagacgaacctcaaccctagtgggtaggttttgggccttggagcgttgggcttccgtttttcgttggttaggttactttttttaaaaagggcgttccgtaggttggtaggaggttgacgtaacgttggttgggagttcggtggggggaagtacgtttacggtaccgtacccgggttcggggggtccctaggacgtaccttcctccgtggtcgactacgtcctcgtcggtaccttaccgtaaccgtttagaccgtactcgttcgtcgtagtccgggcgttcggtcccgtacgacggggtccgggtaccggggggaagggtcggtaggggtagggtcgggtactacgtaagttgttggagttgaaggtagtagggtacggaacncgtaacgttacgttacggtacgtacggtccgtaccggtacgggtaccgggttccctacgtacctacgtccgtaaccgagtaaccgtaactacgttaggaacgtacggaccgtacggtacgttagttactaacgttaaagtaacgtaacgtaactaccggtacgtacggacggaccggaccggaacggtaccgtaaccggtttaccgtagtttcttcggtaacgtacgtaaacggtaacttacgtacgtacgtccgtacggttccccacccggtccgaccttccgtttaccgttcctttacgttccgggttccggtaaccgggg

SEQ ID NO: 84630 - DNA, 772 bp, Homo sapiens
  misc_feature: GYAE6OF01BMYJW.47.46.E02.1.454.CMB.1.raw
  modified_base (196)..(196): a, c, t, g, unknown or other
  misc_feature (196)..(196): n is a, c, g, or t
  modified_base (758)..(758): a, c, t, g, unknown or other
  misc_feature (758)..(758): n is a, c, g, or t
  modified_base (765)..(765): a, c, t, g, unknown or other
  misc_feature (765)..(765): n is a, c, g, or t
tcagagctcacgtacacgaccggtgctcgatttagactcatctacagggaaaggggtctgagagaggagcccagccctgggattttcaggtgttttcatttggtgatcaggactgaaccgagagactcaccatggagtttggctgagctggcttctttcgttgtggtactttttaaaggtgtccagtgtgaggtgntactgtggagtcggtggggatacttacgtaccgtacccggtcgggggtccctagacgtacctccgtccgtgtcgcgtacgtccctcgtacggaccttaccgtaacctttacgacctaaccgttcgttaggtacctaggttcggggtaccgttccgggggtccccaaccggtacgggtccggggtaccggggggaacgggtcgttacggggacggttcgggttccacggtaggacgttggttcggggtggttagtcggtacgacggacggacctaacgttaagttaaccgaccgttccgaggcgtacggtaccttagttttaccttacgacctaccgaagtaaccaacctttaaagaccgtaacgtaaacctacgtacgttacgttagttccgtaggactttaggaccgaacgttaggacgtaagtacggaggtaccgaaggtacccgtaacgggttaccgttaatttacgtaaggtttacgtaaggttaaggtcgggttatcggtacgtacgttccgtacggttcccgggtacgggtacccggaccgttacgaccgttaccncgtttcncgtaccg

SEQ ID NO: 84631 - DNA, 776 bp, Homo sapiens
  misc_feature: GYAE6OF01EOTN3.47.46.E02.1.454.CMB.1.raw
  modified_base (220)..(220): a, c, t, g, unknown or other
  misc_feature (220)..(220): n is a, c, g, or t
  modified_base (308)..(308): a, c, t, g, unknown or other
  misc_feature (308)..(308): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggcttctttcttgtggtacttttttaaaaggtgtccagtgtgaggtgcaactgtggagtcgtggggganacttagtacacccgtgggggtccctgagactctcctgtgcagcctctggactcacctttagctaactctgtcagtcggctcgggtccnccgaggccgtaccgggggaagggtcgtgggaggtgggtactacgtaaggtattgattggaaggagttgggtaggaaacgtcgtaactacgtttaccgtacggtagggtacccgtccggtagggtaaaccgggggtcccggtttaaccaacccgtaagtcccgtaacccgaaggtaaccgtaacctaaagtttcgaagggacgtaccgaacgtcgttagtaacttcctaaaacgaaacgtacgaacgtacgtaccggtaggaacggtaaccggacccggtaaggaaccgtacccgggtacctttaagttaacgtttaccggtaggttacggtaaaccggtaaacgttacgttaaacgtaaccggtaccggtaacggttccccccggtaccccccgttaaggaccccgttaccttaaacccgtttttcccggtttaaccggttacccggtttcggggtaaccccgggggg

SEQ ID NO: 84632 - DNA, 808 bp, Homo sapiens
  misc_feature: GYAE6OF01AQLE9.47.46.E02.1.454.CMB.1.raw
  modified_base (199)..(199): a, c, t, g, unknown or other
  misc_feature (199)..(199): n is a, c, g, or t
  modified_base (213)..(213): a, c, t, g, unknown or other
  misc_feature (213)..(213): n is a, c, g, or t
  modified_base (240)..(240): a, c, t, g, unknown or other
  misc_feature (240)..(240): n is a, c, g, or t
  modified_base (268)..(268): a, c, t, g, unknown or other
  misc_feature (268)..(268): n is a, c, g, or t
tcagagctcacgtacacgaccggtgctcgatttagactcatctacagggaaagggggaggaactgctcagttaggacccagacggaaccatggaacgccccagcgcagcttctcttcctcctgctactctggcctcccagacgaccacgtggaagaaatagtgaatggacgctagtcctccagccacctgtctgtctcnccgaaggggaaacncgccacatcctcctggtacgggccgtnagtagtatgcatcaacttgccttgaccngcagcgaccgtggacacggccctacccgaggtcccttccctacgaacgtttccgtaagtcggaacctttcggacccgttacccggaacccggtacggggtaccccccttacggttttccgggtttaacccccaagggttaccccggtaaggggttttaccgaagggttccgggtaacgtacgggtttccggtccggttttacgggaacccggggtaaataacggggtttacccgtttaccaacccggtttacccgttacccgaaacccgttaacttaacccgaaaaccggtccgtaccgttcgggtaaccttacggttcgtaaggtaaacgtttacgttttcgaacttttaagttttacgtccgtagtaccgtagtaccgttaagttataccgtaacgttacgtccgggccttacgtaccccgtaccgttacgggaacccgacggtacccgtaacgtacggttaacgggtaaattaaacccggttaacgacgttaccgggtcgtaacccgtcggaacccttaccgtacgttcgtttaccc

SEQ ID NO: 84633 - DNA, 884 bp, Homo sapiens
  misc_feature: GYAE6OF01BIASH.47.46.E02.1.454.CMB.1.raw
  modified_base (201)..(201): a, c, t, g, unknown or other
  misc_feature (201)..(201): n is a, c, g, or t
  modified_base (320)..(320): a, c, t, g, unknown or other
  misc_feature (320)..(320): n is a, c, g, or t
tcagagctcacgtacacgaccggtgctcgatttagactcatctacaggggaaagggggaggaactgctcagttaggacccagacggaaccatggaagccccagctcagcttctcttcctcctgctactctggctcccagattccaccggagactattgtttgacacagtctccagccacctgtctttgtctcgaggggaanacgccacctctcctgcacgggccagtcagagtgtgcagctactagcctaggtaccaacagaaacctcggacacggcctaccgaggctcctcatctaagtgatgacacgtaccgaaacgngggaccctacgtcggacctaacgtacccgaagtaaccgtaacggtttccaacggggttggaccgttaaggggttcggggtaccgttagggggaacctaacgggtaacctttaccacccgtttaccgttaacccgaaacccctaaggttacccgaacggtccgaaaaccgggtccccgtttaaagggaacccggttaaccccggttaaagggtaaaacggttttaccgtttttaacgggttaaacctttttaacgtttaaccggttacggttacccgttaaagggaccccgttaagggttaccgggttttaaacgggttacgtttaccgggtccgggttaacccccgttcccggttaaacccgtttaccccggttaaccggggttttaccgggggaccggggtaaacggggtaaccccggttaagggggttaacgggtaaaaccgtaaccgttaaaccgggaaaaaccgggttactttaccgggggtacggggtaacccttacggaaaccccgggttacctaaaccggggttttccttaacccggggttttcttaaacccccggg

SEQ ID NO: 84634 - DNA, 664 bp, Homo sapiens
  misc_feature: GYAE6OF01A177C.47.46.E02.1.454.CMB.1.raw
  modified_base (213)..(213): a, c, t, g, unknown or other
  misc_feature (213)..(213): n is a, c, g, or t
  modified_base (239)..(239): a, c, t, g, unknown or other
  misc_feature (239)..(239): n is a, c, g, or t
  modified_base (627)..(627): a, c, t, g, unknown or other
  misc_feature (627)..(627): n is a, c, g, or t
  modified_base (653)..(653): a, c, t, g, unknown or other
  misc_feature (653)..(653): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggcctcccagacgacccacgtggaagaaatgtgaatggaccgcagtcctccagcccaccctgtctcgtctcgtcggaagggaancgccacatctcgtggtacgggccgtnagtagtatcgacatactaactcgccgtaggtaccaggacagacgtccgtgggacacggcctcccggacggtcctccgtatacttacgtagtgtacgtcggacccgtaccgaccggaccggtccgtacggttccgttacccgacgtccgtacggttcgagtcggtacgtacggtcggtcgtacggtacgggactacggtacgtccgacgttccgtaccaaccgtactacccgaacgtccgctacgtacgtagttacgagtaacgtttgttacgtagtttaagtttcgtacgtcgttacagtacttagtctaacgtacgtacgtccggtacctctacccgtacgtacggaccgtaggaccgtacggacgtagtaacgtaacgttaacggngtcggacgtacaccggtaccacgttntccgttaaccg

SEQ ID NO: 84635 - DNA, 537 bp, Homo sapiens
  misc_feature: GYAE6OF01EYMW7.47.46.E02.1.454.CMB.1.raw
  modified_base (251)..(251): a, c, t, g, unknown or other
  misc_feature (251)..(251): n is a, c, g, or t
  modified_base (509)..(509): a, c, t, g, unknown or other
  misc_feature (509)..(509): n is a, c, g, or t
  modified_base (513)..(537): a, c, t, g, unknown or other
  misc_feature (513)..(537): n is a, c, g, or t
tcagagctcacgtacacgaccggtgctcgatttagactcatctacaggggaaagggccaccatctcctgtagggccggtcagagtattagcatcaacttagcctggtaccagcagagacctgggcaggcctcccaggctcctcatctatgatgcgtccaccagggccactggttcccagccaggttcagtggcagtgcgtctggggacagtagttcactctcaccatccaacagcctgcagtctagaagtnttttgactagttttattactgtcagacagttatctaacgtaacgtcgggcccgtcttcccacccggtttccgggacccgaaacggggtaccaacgtaccgtaggaagttaaacgttaaaacgacgtaggtacggctacgacaacctatcgttagttcccttactacttccccgttacccgcttactcgtagtacgtacggtcgtacgtcgttcggtaggtcgggtccggtcggtacggccgggaacggcgtacgtagngcgnnnnnnnnnnnnnnnnnnnnnnnnn

SEQ ID NO: 84636 - DNA, 841 bp, Homo sapiens
  misc_feature: GYAE6OF01EEV4G.47.46.E02.1.454.CMB.1.raw
  modified_base (200)..(200): a, c, t, g, unknown or other
  misc_feature (200)..(200): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggcttctttcttggtggttacttttttaaaaggtgtccagtgtgaggtncactggttggagtcggtggggatacttagaccgccggtgggggtccctagacgtactcgtctgtacgcgacgtccttctcggtacctaccgtacccttttacgacctaacttcgtcggtacctaggtcgggtccggtacgggtccccgaccggtacgggtccgggtaccggggggaacggggtcggtcggggtaggttcggggtacctacgtaagttcgttaggagtaggaagtaggtggggtaagaacgctaactcttacggtacggttacggtaccgtcgggtagggtaacccgggtccggtaaccaccgtacttccgtaacgtaaggaacgttaaccgttaagttccggaagggtaccgacctacggtgttacggttaactaaccgtaaactaaacgtaggtaacccgtaggttaccacgggacgaaccgggtaaccggaacggtacccggtaaccggttacgtttaacgttacgtttacggttaacggtacgggtaaaccgtttaacggtaacgttaacggtaccggaacccggtttaccggtccccccgttaaccccccggttaggaccccgttttaacccgttaccggtttttcccgttacggttaaccccggtttccgggggtaaacccggggg

SEQ ID NO: 84637 - DNA, 787 bp, Homo sapiens
  misc_feature: GYAE6OF01DMU0W.47.46.E02.1.454.CMB.1.raw
  modified_base (685)..(685): a, c, t, g, unknown or other
  misc_feature (685)..(685): n is a, c, g, or t
tcagagctcacgtacacgaccggtgctcgatttagactcatctacagggaaaggggtctgagagaggagcccagccctgggattttcaggtgttttcatttggtgatcaggactgaaccgagagactcaccatggagttgggctgagctggtctctttcgttgtggttactttttaaaaggtgtccagtgtggtaggtgacaacgtgttggagttcgtgggggacgtacgttacgtaccgtacccggtcggggggtccctaggaacgccttcctccgtggttcgccgacgccttacgtcggaccttcctaaccgtttagacctaacgtcgttgtaccgtagtcgggtcgtcgggtcccgacggcggtaccgggtaccgggggggtaaggtccggtagggtacgggttggtaccgtacgtaagttagttagtagtagtaagtagttgggaacggtacgactacgttacgttaccgtacggtacggtaccgtcggtaacgggtacggggttacccgtaccgaccgtacgttacccgtacgtaacggaacgtaaccgttacgttacggacggtaacgcgtaccgtgtaacgttactaacgtaactaaaggtacggtactaacggtcgtaacggaacgacggtaaccggtaacggaccggtaccggttacgttaacttacgtttacggngttaacggtaacgtaacgttaccgtagtaccggtacgtaccgtccccgtacccccgttcgaccgttctaccgtttgtttacgtccggtttcgggacccgggg

SEQ ID NO: 84638 - DNA, 786 bp, Homo sapiens
  misc_feature: GYAE6OF01EPCFT.47.46.E02.1.454.CMB.1.raw
  modified_base (154)..(154): a, c, t, g, unknown or other
  misc_feature (154)..(154): n is a, c, g, or t
  modified_base (213)..(213): a, c, t, g, unknown or other
  misc_feature (213)..(213): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggcctcccagactaccacgtggaanaaaatagagtatgacgcagtcctccagcccacctgtctggtgtctaccgaagggaaacncgcccaccctctccgtgcgagggccagtcgaagagttatagcagactaaacttgccgtacgtaccagacaacgaaaccgtcggacgacggccgtaccacggggggtcctcctacgtactacgtagtacgtacgtcgtactaaccgtacccgaaaccggaacgggacccgtaaccgtacggtaccgtaaccgtacccgaacggaacgtaacggttaccgtagggtacggtacgtacgggttcgggttacggtaacgggtaccgtaacggtaaccttaccggttaacctaccgttaaccctaacctacttaaccgacgtacgaaccggtacctaacgtaacgtacgttaacgtaaaccggtttacgtttaacggtttaaccgttttaacggtttaccgttacgttaccgtaacgtacggtaccggtaacggttacgtacggtttccgttacggttacccgtcccgtaccgttacgttaccggttacgggtaccgggacgggtaccgggtagggtacgaacggtacgaaacgtaaacgtacggtcggtacggtacggtacgccgtaccgttaaccg

SEQ ID NO: 84639 - DNA, 953 bp, Homo sapiens
  misc_feature: GYAE6OF01D4U5G.47.46.E02.1.454.CMB.1.raw
tcagagctcacgtacacgaccggtgctcgatttagactcatctacagggaaagggggctctgagagaggagcccagccctgggattttcaggtgttttacatttggtgatcaggactgaaccgagagaactcaccagtggagtttgggctgagcgtggctctttcgttgtggtacgttttttaaaaggtgttcctagttgtgaggtgcaactgttggacgtcgtgggggataacgttagtaccgacccggttgggggtacccctggacgtaccttctccgttggtcgacgacgtcctcgtaggtaccttccgttaaccgttttagaccgtaacttccgttgtactaaggtcgggcgtttcggggtccccggaccgtagggtccggtaacccggggggaaggggtccgttagggtaacgggttgggtaccttacgaaaaggtttaggtttaggagttaacgggaagttaagggtacggggtaccggaaagtaccgtaaaccgttaacgtttacgtaacccggggtacggtaacccgttacccgggtaacgggtaaacggggtaccccggtttaacaaaccccggttagttaccccgttaaccgaaccggttaaacgtaaaccgttaacgtttacgggaacgggtaaccgtaccgtaacggtaccgtttaacggttaaacgtaccgttaaaacggtaaacgttacggtaaaaccgtaaccggtcccggtttaaaggaaccggttaaccggggaccccgggtaaacggggtaacccggtaacccgggttaacccggtttaaactttaccgggttttacggtacggtttaaacgggtaaccgtttaaaacggttaaccgtacggttaaccggaccgttaaccggtccccgtaacccccgttaccgggtacccgttacccttaaccggttttccctttacgggtacccgttaccgggg

SEQ ID NO: 84640 - DNA, 721 bp, Homo sapiens
  misc_feature: GYAE6OF01DFRCN.47.46.E02.1.454.CMB.1.raw
tcagagctcacgtacacgaccggtgctcgatttagactcatctacagggaaagggggctctgagagaggagcccagccctgggattttcaggtgttttcatttggtgatcaggactgaaccgagagaactcaccatggagtttgggctgagctggcttctttcttgtggtacttttttaaaaggtgtcctagtgtgaggtgctaacgtgtggagtcggtgggggagacttagtaccacccggtcgggggtccctgacgtactctcctgtcgcacgtcctcgtaggaccttcctacctttacgacctaacttcgtgtctaggtcggtcgtcgggccccgcgacgggccggtaccgggggagggcgtgggaggtcggtctacgtaagttgttagagtagaagtaagtagggtagaacgtcaactacgttacgtacggtcggtaccgttccgggaggtaaccgggtccgttaccgaccgtactccgtacgaaggtacgtaaaccttaacgttacggaaggaaccgtccgaacgttctacgttaacttacccgaaataaacggtacgaaacacggtacctaggaacgacggtacccgggaaacggtccggaccgttaccgttatttacgttcgtacgtaggtaaccgtaaattcgtaaagtccgtacggtccgtccccgacccctacggtccgtacctttcgtttacgtcggtccgttaccgggg

SEQ ID NO: 84641 - DNA, 751 bp, Homo sapiens
  misc_feature: GYAE6OF01CXALU.47.46.E02.1.454.CMB.1.raw
  modified_base (188)..(188): a, c, t, g, unknown or other
  misc_feature (188)..(188): n is a, c, g, or t
  modified_base (230)..(230): a, c, t, g, unknown or other
  misc_feature (230)..(230): n is a, c, g, or t
  modified_base (369)..(369): a, c, t, g, unknown or other
  misc_feature (369)..(369): n is a, c, g, or t
tcagagctcacgtacacgaccggtgctcgatttagactcatctacagggaaagggggagaactgctcagttaggacccagacggaaccagtggaacgccccagcgcagcttctcttccgtcctgactctcgtcggacctccagacgaccacgtagggaagaaatgtagatacggaacgtctacgtccnccacgccctaccttgttctgtcctcgaccgggaagggaaacnccgaccactactccgtcgtaggggacgcggtacaaggtacttaatcgactactcgtaaacggttcgaccggttacggtacacgacgtaacggacggtacggtcgggaccaccggtcccgtacgtaccggtcctaccttntaacgtcttagtcgtacgtcgacccgtacgaccgtcggtaccctacgttccggtacctagccggttagtccgtaggtacgcgtaggtcgacggtcgacggagttacggtctacctacgtctaacctacgtaactaccacggaccttcgacgtcgtagttacggtacgttaagtttacgttagttaacgtttacgttaatttccgtacggtaacttaggactttaacggtaaccttcggtaaaccgtcggtaccgaccgttctaacccgtaccggtaccggtaacgtaccggtaaacgaacgtacgggtaaaccgtaacgttaaacggttaacgtacgggttaacggtccgaaccggtcctacgtaacttcgttccgttacgg

SEQ ID NO: 84642 - DNA, 632 bp, Homo sapiens
  misc_feature: GYAE6OF01E09OS.47.46.E02.1.454.CMB.1.raw
  modified_base (151)..(151): a, c, t, g, unknown or other
  misc_feature (151)..(151): n is a, c, g, or t
  modified_base (204)..(204): a, c, t, g, unknown or other
  misc_feature (204)..(204): n is a, c, g, or t
  modified_base (230)..(230): a, c, t, g, unknown or other
  misc_feature (230)..(230): n is a, c, g, or t
tcagagctcacgtacacgaccggtgctcgatttagactcatctacaggggaaagggggaggactgctcagttaggacccagacggaaccatggaagccccagcgcagcttctcttcctcctgctactctggcctccagagaccactggaanaaatgtgatgacgcagtctaccagcccacctgtctgtctcgtacgaagggaancgccactatctctggtacgggccgtnagagtatagcatcaacttcgcctagtaccagacagacgaccgtgggcacgcctccgaggcctcctcatctatgatcgaccgtccaccggacgggtaccacggttcgttcccgacgtcctaggttccaaggtggacgtaggtcgtcgtcggtacgggatagtacgtcactctacacctatacaacacgcctagctagttgagtaattacgtttagactttagtttactcgtgtacgatagtattaactacgtaacgttacgtccggaccgttacctaccgtaacccggttccgggaaaccggtaaggtaccctaacggtaacggtaacgggtaaattaaacggttaaaacgacggttacggtacggtaccttacccggaacgttaccttaagtccggtttacg

SEQ ID NO: 84643 - DNA, 651 bp, Homo sapiens
  misc_feature: GYAE6OF01AQ6QW.47.46.E02.1.454.CMB.1.raw
  modified_base (213)..(213): a, c, t, g, unknown or other
  misc_feature (213)..(213): n is a, c, g, or t
  modified_base (248)..(248): a, c, t, g, unknown or other
  misc_feature (248)..(248): n is a, c, g, or t
  modified_base (379)..(379): a, c, t, g, unknown or other
  misc_feature (379)..(379): n is a, c, g, or t
  modified_base (392)..(392): a, c, t, g, unknown or other
  misc_feature (392)..(392): n is a, c, g, or t
  modified_base (407)..(407): a, c, t, g, unknown or other
  misc_feature (407)..(407): n is a, c, g, or t
tcagagctcacgtacacgaccggtgctcgatttagactcatctacagggaaagggggagaactgctcagttaggacccagacggaaccatggaagccccagcgcagcttctcttcctcctgctactctggcctcccagacgaccacgtggaagaaatagtgatgacgctagtcctccacgcccaccctgtctgtcctctaccgaaggggaaanacgcccaccgtatcctccgtaggtacgggccgtanagtagtattacgctatactaacgttcgccgtacggtaccagactaggacgtacgtcgggacacggcctccgagtcctacctcactctatgactcgccgacctacgacggtcctacgttcgtacccagtccnggtcacggtgacnggtcgcgtgaggtanacggtactaccgctcgacctactatacactcgtcctagtactagtacgtagttaagttcgttactaagtttacttacgtacgtctacgacgttactagtactacgtacgttcgtacctaccgtactacccgtaccgttaccggaaccggttacgaaccgtacggacggtaacggtaactaaacggttaaaccgttacggtacgttacccggtacgttaccgaccgttactcgttccggtttacc

SEQ ID NO: 84644 - DNA, 711 bp, Homo sapiens
  misc_feature: GYAE6OF01B0XS7.47.46.E02.1.454.CMB.1.raw
  modified_base (262)..(262): a, c, t, g, unknown or other
  misc_feature (262)..(262): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggtctttttaaaaggtgtccagtgtgaggtgcaactgtggagtcgtgggggagtacgttagtaccacccggtgggggtccctgagactctcctgtgcngcctcgtgacctacctaccgttacactactctcgtcgtagtcggtcggtcggtccgccggcggccgggtaccggggacgggtcgtgggtggtcggtacgtacgtagtagtagagtagagtaggtaggtaggacgacgtactacgttcgtacggtcggtaccgtacggtacgggtaccggtccgtacaccgtactccgtacgacgtacgtaactacgtacgacggacgtaccgtacgtacgttacgtactaacgtaactaacgtacgaacgtacgtacgtacgacggaccggaaccggaccggtaaccgtaccggtaccgtttaacgttacgttacgtacgtacggtaacgttaacgtacgttaacgtccgtacgtaccggtccccgtacccccgtacggtacccgttaccttaccgtttccggtttaccgttccggttcgggtaccggg

SEQ ID NO: 84645 - DNA, 633 bp, Homo sapiens
  misc_feature: GYAE6OF01E4FO0.47.46.E02.1.454.CMB.1.raw
  modified_base (203)..(203): a, c, t, g, unknown or other
  misc_feature (203)..(203): n is a, c, g, or t
  modified_base (329)..(329): a, c, t, g, unknown or other
  misc_feature (329)..(329): n is a, c, g, or t
  modified_base (347)..(347): a, c, t, g, unknown or other
  misc_feature (347)..(347): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccgaggggaaangccaccatctccgtgtaggggccgtcagacgtattagcatcaacttgcctggtaccagcagagacctgggcaggctccaggcctcctcatctatgatgccgtccaccgagggccactcggtttccngccgtaggttcagtcggnaggtgcgtcgtgggacaggtacgttccgactcctaccacctataccgaacacgtcctagcctagttctaggaagttattttgacttaaatttttacgttacgttcgtactacgtacgaagtttaacgttaaacttaacgtcgggtacccttcgtacccgtttccggaaccgaacggggtaaccacggttaacggtacgggaaacggttaattaaaacccgggtaacgtcgggttacggtacgttacggtaccctaacccgttattcgttacccgttactttacccg

SEQ ID NO: 84646 - DNA, 643 bp, Homo sapiens
  misc_feature: GYAE6OF01C87V9.47.46.E02.1.454.CMB.1.raw
  modified_base (154)..(154): a, c, t, g, unknown or other
  misc_feature (154)..(154): n is a, c, g, or t
  modified_base (212)..(212): a, c, t, g, unknown or other
  misc_feature (212)..(212): n is a, c, g, or t
  modified_base (245)..(245): a, c, t, g, unknown or other
  misc_feature (245)..(245): n is a, c, g, or t
  modified_base (415)..(415): a, c, t, g, unknown or other
  misc_feature (415)..(415): n is a, c, g, or t
  modified_base (461)..(461): a, c, t, g, unknown or other
  misc_feature (461)..(461): n is a, c, g, or t
  modified_base (467)..(467): a, c, t, g, unknown or other
  misc_feature (467)..(467): n is a, c, g, or t
  modified_base (628)..(628): a, c, t, g, unknown or other
  misc_feature (628)..(628): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggcctcccagacgaccacgtggaanaaatggtgatcgacgctagtcctccagcccacctgtctcgtctctacggaagggaaanccgaccactatccgtcgtgggtacgggccgtanagtaggttatgactatactaaacgttcgccgtacggtaaccaacgtaacgaaccggttggcaacggtccctaccggcggttaccctacctcgtactacctaagtgaacttcgacctactaccgaacggcggaccctagcgactacgtaccgacggtacgtgtaccgaggngtcgtagggtggtccgtagggactgtacctcgactcgaaccacgtntcgacncgtacgcgtcgacgtagtacagtaagttgttactacgttactttatagtacgtagtacgatagtaccgtataccgtacggtgtccgtacgtacccgtacggttaccggacggtaacgggactaaccggtaggaagtacgtaacgtaacgacgtacgtcggntaccacgtctgttcg

SEQ ID NO: 84647 - DNA, 846 bp, Homo sapiens
  misc_feature: GYAE6OF01ET9PP.47.46.E02.1.454.CMB.1.raw
  modified_base (181)..(181): a, c, t, g, unknown or other
  misc_feature (181)..(181): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctggagctggctctttcttgtgtactttttaaaaggngtcagtgtgaggtgcactgtggagtcgtggggatacttagtacacccggtgggggtcctgacgactctccgtgtcgcacgcctcgtcggtacctcctaccgtttacgactaaccgttcctagtccgtagtcggggtccgttacggggtccccgacccggacgggtcccggtaccgggggggggtaacggggtccttgggggacgggtttccggggtaccttacgtaaaagggtttagtttacggaagttaggaaggtaacggttaggggtaacggaaacgtccgtaaacgttactttacggtaaccggttaccgggaaccttccggggtaagggttaaacccggggtcccggtttaacccgaacccgtaacgttccctacccgtaaggtaaccggttaaaccttaaggtttaccggaaacgggtaaccggtaaccgtaccgtcaaaaagttttcgtaaacctaaccgtaaaacctagaaaccccgtaagtacccgtaggaacggaacgggacccggtaacgggaacccgtaaccggtacccgtttaattacggtttacgtcggttaaggtaccgtaaaagtaccgtgtaaccgtacgaccgttaccggacccccctagtcccgtacgtttaccgttacctttcggaaccggttttcggaccgggg

SEQ ID NO: 84648 - DNA, 701 bp, Homo sapiens
  misc_feature: GYAE6OF01BH4Y2.47.46.E02.1.454.CMB.1.raw
  modified_base (145)..(145): a, c, t, g, unknown or other
  misc_feature (145)..(145): n is a, c, g, or t
  modified_base (148)..(148): a, c, t, g, unknown or other
  misc_feature (148)..(148): n is a, c, g, or t
  modified_base (156)..(156): a, c, t, g, unknown or other
  misc_feature (156)..(156): n is a, c, g, or t
  modified_base (174)..(174): a, c, t, g, unknown or other
  misc_feature (174)..(174): n is a, c, g, or t
  modified_base (177)..(177): a, c, t, g, unknown or other
  misc_feature (177)..(177): n is a, c, g, or t
  modified_base (195)..(195): a, c, t, g, unknown or other
  misc_feature (195)..(195): n is a, c, g, or t
tcagagctcacgtacacgaccggtgctcgatttagactcatctacagggaaagggtctgagagaggagcccagccctgggtattttcaggttgttttctatttggtgatcaggactgaaccgagagaactcacatggtagttggntgngcgtgctnttgtgtgtattttaaggntcngtgtgagtgctatgtggngtgtgggatacgtagtaccgtccggtcggggtcctgacgtctcctccgtgtacgcacgtccttcgtacgtacctaccttaacctttacgtacctacgttcgtcgtacgtggtcgggtcgtccggggtcccgaccgtacgggaccgggtaccggggaggtccggtggtacggtcggtactacgtagttagtaggagttaggaagtaggtacggtaagacgtactacgtacgttcgaacggttcggtacgtacggtagggtaaccgggtccgtactaccgtacgttcaacgaacgtaactaacgttacttacgagtcgtacacgtactagtactaacgtaataagacgtacgtagtcgagacggacgtacgggaacgtccggtaacgttcgtttaagttcgtttacgtaacgtcggtaacgtaagttacgtagtacctaggtacccggttccctaacccggtcgcccgtttctaccgttttaccgtacgttcgttccgggtaacgggg

SEQ ID NO: 84649 - DNA, 641 bp, Homo sapiens
  misc_feature: GYAE6OF01CDBB3.47.46.E02.1.454.CMB.1.raw
  modified_base (187)..(187): a, c, t, g, unknown or other
  misc_feature (187)..(187): n is a, c, g, or t
  modified_base (200)..(200): a, c, t, g, unknown or other
  misc_feature (200)..(200): n is a, c, g, or t
  modified_base (269)..(269): a, c, t, g, unknown or other
  misc_feature (269)..(269): n is a, c, g, or t
  modified_base (292)..(292): a, c, t, g, unknown or other
  misc_feature (292)..(292): n is a, c, g, or t
  modified_base (306)..(306): a, c, t, g, unknown or other
  misc_feature (306)..(306): n is a, c, g, or t
  modified_base (401)..(401): a, c, t, g, unknown or other
  misc_feature (401)..(401): n is a, c, g, or t
  modified_base (558)..(558): a, c, t, g, unknown or other
  misc_feature (558)..(558): n is a, c, g, or t
  modified_base (583)..(583): a, c, t, g, unknown or other
  misc_feature (583)..(583): n is a, c, g, or t
  modified_base (609)..(609): a, c, t, g, unknown or other
  misc_feature (609)..(609): n is a, c, g, or t
  modified_base (614)..(614): a, c, t, g, unknown or other
  misc_feature (614)..(614): n is a, c, g, or t
  modified_base (630)..(630): a, c, t, g, unknown or other
  misc_feature (630)..(630): n is a, c, g, or t
tcagagctcacgtacacgaccggtgctcgatttagactcatctacagggaaagggggcgtctgagagaggagcccagccctgggtattttctaggtgtttttctattttggtgatcaggactgaaccgagagaactcaccatggagtttgggctgagcggtgtgtcttagtgtcgtattttaaagtntcagtgtgagtcncgacttgttggagtcgtggggatacttagtcgtacccggtggggtccctgagtaccttctccgtgtgcnctctcgtcgctacctcgttaacncctaactctcgtancgtcggtcgccggttccgcgtaggccggtaccgggggagggtcgtaggtcggtggtctacgaagtagttcgagtgtaagtagtaggtacgaagtntaacccgtagttacccgtaacgggtccgtaaccggttacgggacggtaaccgggttccgttaccaccctaacgtcgtaccgataacggtaacttaaccgttacgacgacgcgtaacgtcttagtaacttacgtaataacgagtaaacgtgttaaccncggagaaccgcgagtaccgacgttnttagtctgtgtagtagtatacgtcgnacgcncccgcctcgactcttnttcttgcgtcg

SEQ ID NO: 84650 - DNA, 651 bp, Homo sapiens
  misc_feature: GYAE6OF01A5P4J.47.46.E02.1.454.CMB.1.raw
  modified_base (184)..(184): a, c, t, g, unknown or other
  misc_feature (184)..(184): n is a, c, g, or t
  modified_base (468)..(468): a, c, t, g, unknown or other
  misc_feature (468)..(468): n is a, c, g, or t
  modified_base (608)..(608): a, c, t, g, unknown or other
  misc_feature (608)..(608): n is a, c, g, or t
  modified_base (615)..(615): a, c, t, g, unknown or other
  misc_feature (615)..(615): n is a, c, g, or t
  modified_base (618)..(618): a, c, t, g, unknown or other
  misc_feature (618)..(618): n is a, c, g, or t
  modified_base (621)..(621): a, c, t, g, unknown or other
  misc_feature (621)..(621): n is a, c, g, or t
  modified_base (623)..(624): a, c, t, g, unknown or other
  misc_feature (623)..(624): n is a, c, g, or t
  modified_base (626)..(627): a, c, t, g, unknown or other
  misc_feature (626)..(627): n is a, c, g, or t
  modified_base (629)..(630): a, c, t, g, unknown or other
  misc_feature (629)..(630): n is a, c, g, or t
  modified_base (632)..(632): a, c, t, g, unknown or other
  misc_feature (632)..(632): n is a, c, g, or t
  modified_base (634)..(635): a, c, t, g, unknown or other
  misc_feature (634)..(635): n is a, c, g, or t
  modified_base (637)..(639): a, c, t, g, unknown or other
  misc_feature (637)..(639): n is a, c, g, or t
  modified_base (641)..(648): a, c, t, g, unknown or other
  misc_feature (641)..(648): n is a, c, g, or t
  modified_base (650)..(651): a, c, t, g, unknown or other
  misc_feature (650)..(651): n is a, c, g, or t
tcagagctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctganagccgagacacggccgtatatttctgtgacgaaagttctatacgcacgtccgcccccttaagccgactactttcgtttcgaaccgtttcgcggggccgaagggaacttccgttcggtcctaacccggttcctcccaaccgagtcccccttacccgaaccgaaccgggcccctaaggttcccggttcccttccccgtgggcccctccccgttcgcccgttccgaacggacgtacccgaccgttaccgaacggtaccgaccaacccgcggggtccccggtcccggnggggttaccctccgggtccccgttaggtaaccgaacgggttcccttaacccgtttacccggtaccggttaggacctcccggtttacacggggaacggtccggggtcgtaccggacggaccgggcctacgtagacgtgacnccgtagngcntgncnncnncnncngnngnnncnnnnnnnngnn

SEQ ID NO: 84651 - DNA, 807 bp, Homo sapiens
  misc_feature: GYAE6OF01B322K.47.46.E02.1.454.CMB.1.raw
  modified_base (192)..(192): a, c, t, g, unknown or other
  misc_feature (192)..(192): n is a, c, g, or t
tcagagctcacgtacacgaccggtgctcgatttagactcatctacaggggaaagggtctgagagaggagcccagccctgggattttcaggtgtttcatttggtgatcaggactagaaccgagagaactcaccatggtagtttgggctgagcgtggctctttctgtgttactttttaaaggctcgagtgtagnggtgctaacgtgtggagtcggtggggaatacgttagtaccgacccggtcgggggtccctaggacgtactcgtaccgtgtcgacgtacgccttcggtacgtaacttacccgtaccgtttagaccttaaactccgttgtaccgtaaggtccgggtcggtaccgggaccccgtaccggtaaccgggtccggggtaaccgggggaagggttccgtacgggaaggttccgggtacttaacgtaaaggttcgtacgaacgtacggtaagtaaccggtggtaacggaaactccggtaaacgttacgtttacccggtaaggtacccgtaaccgggtacggtaaacgggaccgggttacccgttaacaaccgtaactttcccgaaccgtaacggtaaccgttaaccgtaacgttaccggaaggttacccgaccggtacgtacttaagtaaccgtaaacctaaaggttaaacacgtaacgtagtacggtaggaaacgccggtaacgaccggtagtaccggtacttaattccggtatacgtaaccgtaggtaacctaggtaccgtaggcccgtaagccccgtaaccgttacgcttacgtacttaccgttgtcccgttcgggaacgg

SEQ ID NO: 84652 - DNA, 844 bp, Homo sapiens
  misc_feature: GYAE6OF01DM2KU.47.46.E02.1.454.CMB.1.raw
  modified_base (178)..(178): a, c, t, g, unknown or other
  misc_feature (178)..(178): n is a, c, g, or t
  modified_base (204)..(204): a, c, t, g, unknown or other
  misc_feature (204)..(204): n is a, c, g, or t
  modified_base (283)..(283): a, c, t, g, unknown or other
  misc_feature (283)..(283): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcacatggagtttgggctgagcgtgtcgtcttacgtgtgtattttaaaggngtccagtgtgagtgactaactgtggngtcgtggggatactacgtacgaccgtgggggtcctgacgactctccgtgtgcacgccttgacggactactacgtttaanacctaactccgtagtacaggtcggactcggtacccgaccgaggtccggtaaccgggggaaggcgtagggtaggtacgggtcttagaaggttacgttgaacgtggaaagtaggttggaaccggtagacctagttaaagtacccgtaagggtaccgtaacggttcggacgggaaccgggtttacccggttaacccgaaaccgtttcaaccccggttagaaaacggttaaccggtaccttaaaaggtttccccggaaaagggttaacgccccggttaaaggtaacgttacccggtttaattaaacccgaaaccgtaaagtaaccgtaacggtacccgtttaacggtaggaaacccggtaaccgaacgggaaaccccgtaacccgggtaaccgttaaggttttaaaccttcggttttacgaaccggtaaggtttaaaacgggttccgttaaacttaccggaaaaacgtcgggttaacccggtttacccccggaacccgttaacggtaccctaccctttaaaggtttcccgtttaaaccgttccgggtttaccggaaacccggggg

SEQ ID NO: 84653 - DNA, 760 bp, Homo sapiens
  misc_feature: GYAE6OF01B5OV2.47.46.E02.1.454.CMB.1.raw
  modified_base (309)..(309): a, c, t, g, unknown or other
  misc_feature (309)..(309): n is a, c, g, or t
  modified_base (555)..(555): a, c, t, g, unknown or other
  misc_feature (555)..(555): n is a, c, g, or t
  modified_base (590)..(590): a, c, t, g, unknown or other
  misc_feature (590)..(590): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggtagtttgggctgagctggcttctttcttgtgtactttttaaaggtgtccagtgtgaggtgcactgtggagtcggtgggggatacgttagtaccgtaccggtcggggggtccctagacgtacctctccgtagtcgctacgtcctcgtggtactcctacctttagactactcgtntcgtagtcgggcgtccgggtccgaccggagggtccgggtaccggggggaaggggtcgtacggggtacgggttcgggtactacgtaaggttattacggaggttacggaaggtaggttagggtacgaacgaccgtaacttacgttaccgtacgggttacggtacccgtacggtacggggtaaaccggggtcccgttaaccgaccgtacttcccggactaaggaactaacgttagttacgaacgggtancccgtaacgttgtactaacttcgtaaaacagttanaacggtccgtacgaggtcggaacgtaccgggaacgtacggtacccggtcgtttacgtagtttacgtagggtaacctaaggtaaacttcgtagaaccgttcggtacggtcccccggtaccccgtgtccctacgtttacgtttacgtttaccggtcgtacccgggtaacggg

SEQ ID NO: 84654 - DNA, 847 bp, Homo sapiens
  misc_feature: GYAE6OF01BQHST.47.46.E02.1.454.CMB.1.raw
  modified_base (96)..(96): a, c, t, g, unknown or other
  misc_feature (96)..(96): n is a, c, g, or t
  modified_base (176)..(176): a, c, t, g, unknown or other
  misc_feature (176)..(176): n is a, c, g, or t
  modified_base (189)..(189): a, c, t, g, unknown or other
  misc_feature (189)..(189): n is a, c, g, or t
tcagagctcacgtacacgaccggtgctcgatttagactcatctacagggaaaggggtctgagagaggagcccagccctgggattttcaggtgtttnatttggtgatcaggactgaaccgagagaactcaccatggtagtttgggctgagcgtgctcttctgtgtactttttaaagngtcagtgtgagtncactgtggagtcgtggggatacgttagtaccgacccggttgggggtaccctgacgtacttcctccgttggtcgaccgcgtcctcgtacggtaccttccgtaaccgttttacgacctaaccgttcttcggttaactacggttcggggtccgttaaccggggttccccgaccggtaaggggtcccccgggggtaaccggggggtaacggggtcggtttaggggacggttcggtaaccgtacgtaaggttgttaggtagtaggtaaccgtaggtgggtacgaacgctaacgtacttaccggtacggtggtaccgttccgggtaaggaacccgggttcccggttacaaccgttacttccgtaacccgtaaggtactaaacttacgggttcgaacgggtacgacccgttaaggctttaacggtaacttaacccggttaaaagaaaccgttaaccgggaacttcgtaaccggacgtaacgggtaccggaaccggaaacgggccgtaaaaccgggttcttttaacgttacggttacccgtaagggtaccctaaagggttaaaccctttcgtaaacggtcgtaccgggtaacccgtccccttaaccccggaacgtttccgttaccgtttaccgttaggtttacgaccccgtttgggggaaacccgg

SEQ ID NO: 84655 - DNA, 689 bp, Homo sapiens
  misc_feature: GYAE6OF02IMZ7X.47.46.E02.1.454.CMB.1.raw
  modified_base (327)..(327): a, c, t, g, unknown or other
  misc_feature (327)..(327): n is a, c, g, or t
tcagagctcacgtacacgaccggtgctcgatttagactcatctacagggaaaggaggctctgagagaggagcccagcccctgggatttttcgaggttgttttctatttggtgatcgaggactgaaccgagagaactcaccatggtagtttggctgagcgtggtcttctttcgttggtgttaactttttaaaggtgtccagtgtgagtgcatgtggagtcgtggggatacgttagtaccacccggtcgggggtccctgacgactcctcctgtgcacgcctgtggacctctacctttagcctaactctgtcagtggtcgtcgggtcccncgacggccggtaccgggggaagggcgtggaggttgggtctacgaagttattgagtgaagtagtggtagaagcactatttcgtaggtcggtactccggtaggaacgggtcccgtacaccgtatcccgtacgaagactaaccgtaagttacgaggtacacgacgtcttagtactacaataaagtacaacgacgtcgtaggaacgacgaccggaaggaaccgaccgggtaaccgtttattacgttttcgtaggtacgaacgggttaaactttcgtaaacgtaggtacccgttaacgggtcccccgtacccccgttaacgggccccgttacctttaacccgttttttccgttacgtttaaccccgg

SEQ ID NO: 84656 - DNA, 434 bp, Homo sapiens
  misc_feature: GYAE6OF02HSSVD.47.46.E02.1.454.CMB.1.raw
  modified_base (422)..(434): a, c, t, g, unknown or other
  misc_feature (422)..(434): n is a, c, g, or t
tcagagctcacgtacacgaccggtgctcgatttagactcatctacagggaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctagcgcacttcttgacttctggggccagggaatcctggtcaccgtctccacagcctccaccaagggcccatcggtcttccccctggcgccctgctccaggagcacctccgagagcacagcggccctgggctgcctggtcaaggctacttcctacgtgagctctgagcgggctggcaaggcgcatagnnnnnnnnnnnnn

SEQ ID NO: 84657 - DNA, 600 bp, Homo sapiens
  misc_feature: GYAE6OF02HQ5U3.47.46.E02.1.454.CMB.1.raw
  modified_base (570)..(600): a, c, t, g, unknown or other
  misc_feature (570)..(600): n is a, c, g, or t
tcagagctcacgtacacgaccggtgctcgatttagactcatctacaggggaaagggccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtcgtgggacagagttcactctcaccatcaacagcctgcagtctagaagtattttgctagtttattactgtcagcagtatcaataacgtcggccgtcctcctaacccgttccggaccgaaacggggaccaaccggaaccgtgggaagtaaacgtttaaaaccgaaacgttggtacggtccgttacggaccaaccccgtaatttcccgttcggtttaccctttacctaacctttccccgtttacccccggtaccctaactttcccgtaggtaacgtttaacccggttgggaacgttccttaccgttagggaaccgggtccgggggtcgtttacggggaaccgtaaacggggccggtaccgaagttacggatcnnnnnnnnnnnnnnnnnnnnnnnnnnnnnnn

SEQ ID NO: 84658 - DNA, 495 bp, Homo sapiens
  misc_feature: GYAE6OF02H6MEE.47.46.E02.1.454.CMB.1.raw
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagatttttgctagttttattactgtcagcagtatcataactggccgctcaccttcgccaagggacacgactggagattaaacgaactgtgctgcacctatctcg

SEQ ID NO: 84659 - DNA, 494 bp, Homo sapiens
  misc_feature: GYAE6OF02IGH7B.47.46.E02.1.454.CMB.1.raw
  modified_base (202)..(202): a, c, t, g, unknown or other
  misc_feature (202)..(202): n is a, c, g, or t
  modified_base (464)..(464): a, c, t, g, unknown or other
  misc_feature (464)..(464): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaanagccaccatctcctgtagggccggtcagagtattagcatcaattgcctggtaccagcagagacctgggcaggctcccaggctcctcatctatgatgcgtccaccagggccactggtttcccagccaggttcagtggcagtgcgtctgggacagagttcgactctcaccatcaacagcctgcagtctgaagtattttgctagtttattacttgtcagcagtatcataactggccgctcaccttcgaccaagacacgactgganataaacgactgtagcgtagcactatctacg

SEQ ID NO: 84660 - DNA, 528 bp, Homo sapiens
  misc_feature: GYAE6OF02GAHF4.47.46.E02.1.454.CMB.1.raw
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggctttttaaaaggtgtccagtgtgaggtgcaactgttggagtctgggggagacttagtacaccctggggggtccctgagactctcctgtgcagcctctggactcacctttagcaactctgtcatgggctgggtccgccaggctccgggggaaggggctgggagtgggtctcaagtattgatgagaatggtggaagcacattctacgtggactccgtgaagggccggttcaccgatctccagagacaatttcaggagcacgctgtatctacaaatgaacagcctgagagccgaggacacggccgtatatttctgtgcgaagtctagtagcagtcgcccctagcgcacttctttgacttgtcggg

SEQ ID NO: 84661 - DNA, 481 bp, Homo sapiens
  misc_feature: GYAE6OF02GWRT5.47.46.E02.1.454.CMB.1.raw
  modified_base (202)..(202): a, c, t, g, unknown or other
  misc_feature (202)..(202): n is a, c, g, or t
  modified_base (376)..(376): a, c, t, g, unknown or other
  misc_feature (376)..(376): n is a, c, g, or t
  modified_base (432)..(432): a, c, t, g, unknown or other
  misc_feature (432)..(432): n is a, c, g, or t
  modified_base (478)..(478): a, c, t, g, unknown or other
  misc_feature (478)..(478): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaanagccaccatctcctgtagggccggtcagagtattagcatcaacttagcctggtaccagcagagacctgggcaggctcccaggctcctcatctatgatgcgtccaccagggccactggttcccagccaggttcagtgcagtgcgtctgggacagagttcactctcaccatcaacngcctgcagtctgaagtattttgctagtttattactgtcagcagtatcatactggcnctcacctcgccaagggcagactggacataacgatgtgctgcacatntcg

SEQ ID NO: 84662 - DNA, 544 bp, Homo sapiens
  misc_feature: GYAE6OF02F8POO.47.46.E02.1.454.CMB.1.raw
  modified_base (301)..(301): a, c, t, g, unknown or other
  misc_feature (301)..(301): n is a, c, g, or t
  modified_base (339)..(339): a, c, t, g, unknown or other
  misc_feature (339)..(339): n is a, c, g, or t
  modified_base (420)..(420): a, c, t, g, unknown or other
  misc_feature (420)..(420): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggctttttaaaaggtgtccagtgtgaggtgcaactgttggagtctgggggagacttagtacaccctggggggtccctgagactctcctgtgcagcctctggactcacctttagcaactctgtcatgggctgggtccnccaggctccgggggaagggctggagtgggtctcaagtnttgatgagaatggtgaagcacattctacgtgactccgtggaacgggccggttcaccatcctccagagacaatttcgaggancacgctgtatctaacaatgaacagtctgagagccgaggaccacggccgtaattactttcgtgtcgacgtaaagtctaataggcaggtcgccccctagccgctactttcttcgacttcgtcgggg

SEQ ID NO: 84663 - DNA, 507 bp, Homo sapiens
  misc_feature: GYAE6OF02GAVI9.47.46.E02.1.454.CMB.1.raw
  modified_base (201)..(201): a, c, t, g, unknown or other
  misc_feature (201)..(201): n is a, c, g, or t
  modified_base (225)..(225): a, c, t, g, unknown or other
  misc_feature (225)..(225): n is a, c, g, or t
  modified_base (374)..(374): a, c, t, g, unknown or other
  misc_feature (374)..(374): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccacctgtctgtctctccaggggaaangccaccatctcctgtagggccgtnagagtattagcatcaacttgcctggtaccagcagagacctgggcaggctcccaggctcctcatctatgatgcgtccaccagggccactggtttcccagccaggttcagtggcagtgcgtctgggacagagttcactctcaccatcaacngcctgctagtctagaagtatttgacttagtttattactgtcagctagttataataacgtgcctcgcgttcgacaaggacacgtacaggagtaagttaaacgagtagtgtacgtgctaccattccgtgtcttac

SEQ ID NO: 84664 - DNA, 510 bp, Homo sapiens
  misc_feature: GYAE6OF02F4122.47.46.E02.1.454.CMB.1.raw
tcagagctcacgtacacgaccggtgctcgatttagactcatctacagggaaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagtactttggactttattacttgtcagcagcgtgagttctggtcctccgctctacgtttcggcggacgggaccgagggtggagagtcgaaacgaacgtgtggctgcaccatctgtcttc

SEQ ID NO: 84665 - DNA, 562 bp, Homo sapiens
  misc_feature: GYAE6OF02HGXRZ.47.46.E02.1.454.CMB.1.raw
  modified_base (155)..(155): a, c, t, g, unknown or other
  misc_feature (155)..(155): n is a, c, g, or t
  modified_base (157)..(157): a, c, t, g, unknown or other
  misc_feature (157)..(157): n is a, c, g, or t
  modified_base (180)..(180): a, c, t, g, unknown or other
  misc_feature (180)..(180): n is a, c, g, or t
  modified_base (210)..(210): a, c, t, g, unknown or other
  misc_feature (210)..(210): n is a, c, g, or t
  modified_base (297)..(297): a, c, t, g, unknown or other
  misc_feature (297)..(297): n is a, c, g, or t
  modified_base (351)..(351): a, c, t, g, unknown or other
  misc_feature (351)..(351): n is a, c, g, or t
  modified_base (358)..(358): a, c, t, g, unknown or other
  misc_feature (358)..(358): n is a, c, g, or t
tcagagctcacgtacacgaccggtgctcgatttagactcatctacagggaaagggggctctgagagaggagcccagccctgggattttcaggtgttttcatttggtgatcaggactgaaccgagagaactcaccatggagtttgggctgagcggngngtctagtcgtcgattttaaaggntcagtgtgagtgcaatgtgagtctgggganacttagtacacccgtggggggtccctgagactctcctgtgcagcctcgtggactcacctttagctaactctgtcatggcttgggccnccaggctccggggaagggcctggagtggtcgtcgagtagttgatgagaagtggngagacanatctacgtgacgtcgtgacggcggtcgacactctccagagactaattacaggagacacgacgtgtatacttaaactaatacgaacgacgacgagagacgacgacgacgacgtacgtacttagttacgtgtacgtacgtaagtacgtagtacgtacgacgtaccgtacccgtaccgtaccgtaccgtacttcgttcgtacgtcgg

SEQ ID NO: 84666 - DNA, 545 bp, Homo sapiens
  misc_feature: GYAE6OF02GTN3T.47.46.E02.1.454.CMB.1.raw
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcgtggctctttcgttgtggctattttaaaagtgtccagtgtgaggtgcagctggtggagtctgggggaggcttagtacagcctgggggtccctgagactctcctgcgcagcctctggattctcctttagtagttatgccatgacttgggtccgccaggctccgaggggagggctggagtgggtctcgaggcagttggtggtagtggtgccaggacacattacgtaaagtccctgcagggccatttcttatctaccagtagacaattccaaggaacatactgacttctagctagttcgacctagactgagagtcgaggacacggcgtatattattgtagttaagtgggtatggtgcgtacgacgtcgttcggggaccggtacccgtggtccacgtcg

SEQ ID NO: 84667 - DNA, 599 bp, Homo sapiens
  misc_feature: GYAE6OF02IPH4Q.47.46.E02.1.454.CMB.1.raw
  modified_base (156)..(156): a, c, t, g, unknown or other
  misc_feature (156)..(156): n is a, c, g, or t
  modified_base (181)..(181): a, c, t, g, unknown or other
  misc_feature (181)..(181): n is a, c, g, or t
  modified_base (216)..(216): a, c, t, g, unknown or other
  misc_feature (216)..(216): n is a, c, g, or t
  modified_base (353)..(353): a, c, t, g, unknown or other
  misc_feature (353)..(353): n is a, c, g, or t
  modified_base (421)..(421): a, c, t, g, unknown or other
  misc_feature (421)..(421): n is a, c, g, or t
  modified_base (455)..(455): a, c, t, g, unknown or other
  misc_feature (455)..(455): n is a, c, g, or t
tcagagctcacgtacacgaccggtgctcgatttagactcatctacagggaaaggggctctgagagaggagcccagccctgggattttcaggtgttttcatttggtgatcaggactgaaccgagagaactcaccatggagtttgggctgagcggtgngtcttagtcgtgactttttaaaggngtcagtgtgaggtgcaatgttggagtctggggganacgttagtacaccgtgggggtccctgagctctcctgtgcagcctctggactcacctttagcaactctgtcatggctggtccgccaggcgtccgggggaagggctaggcgtgggtctcgaagtattgatgagtatggngaagcacattctacgtgactccgtagaacgggtcggtacaccgatccgtccagagacaatttcaggancgtacgctgtactctacaaatgaaacctgacccngacgacgaccgaggaccgacggtaccgttactagtttaccgtggtacgtacggtaaaggtttcctaaagtaggcctaacgtcccggtaccccccgtaggaccccggtaccttaaccgtttccgttttacggaccgtttccgggg

SEQ ID NO: 84668 - DNA, 593 bp, Homo sapiens
  misc_feature: GYAE6OF02GSCZW.47.46.E02.1.454.CMB.1.raw
  modified_base (153)..(153): a, c, t, g, unknown or other
  misc_feature (153)..(153): n is a, c, g, or t
  modified_base (175)..(175): a, c, t, g, unknown or other
  misc_feature (175)..(175): n is a, c, g, or t
  modified_base (180)..(180): a, c, t, g, unknown or other
  misc_feature (180)..(180): n is a, c, g, or t
  modified_base (186)..(186): a, c, t, g, unknown or other
  misc_feature (186)..(186): n is a, c, g, or t
  modified_base (194)..(194): a, c, t, g, unknown or other
  misc_feature (194)..(194): n is a, c, g, or t
  modified_base (203)..(203): a, c, t, g, unknown or other
  misc_feature (203)..(203): n is a, c, g, or t
  modified_base (347)..(347): a, c, t, g, unknown or other
  misc_feature (347)..(347): n is a, c, g, or t
  modified_base (353)..(353): a, c, t, g, unknown or other
  misc_feature (353)..(353): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcggngtgctagtgcgattttaaaggntcatntgagtncatgttgntctgggganacttagtacaccgtgggggtccctgagactctcctgtgcagcctctgactcacctttgctaactctgtcagtgggctgggtccgccgaggccgtccgggggaagggcgtgggacgtgggtctcgaagtattgatgaagattggnggaacncactagttcgtacgtcgacgtcgtaggacggtccgttacgactatccgacgagacgtactacttacgaggacaccgacgtacgtacgtactactaacgtaatagaacgtacgtagtagagacgacgacgacgacgtacgttacgttacgttcgtcgtacgtacgtacgtacgtacgtacgtacgtacgtaccgtcccgtaccgtaccgtacgtaccttactttacgttacgttcgtacgg

SEQ ID NO: 84669 - DNA, 519 bp, Homo sapiens
  misc_feature: GYAE6OF02HTN4I.47.46.E02.1.454.CMB.1.raw
tcagagctcacgtacacgaccggtgctcgatttagactcatctacagggaaagggggaggaactgctcagttaggacccagacggaaccatggaagccccagcgcagcttctcttcctcctgctactctggctccagagaccactggagaaatagtgatgacgcagtctccagccaccctgtctgtctctccaggggaaagagccaccatctcctgtagggccggtcagagtgttggcagctacttagcctggtaccaacagaaacctggccaggctcccaggctcctcatctatgatgcatccaacagggccactggcactcccagccaggttcagtgcagtgagtctgggacagacttcactctcaccatcagcacgcctagacgcctagaagtattttgacttaactttatttactgtacagtcagtcgtagactaacgtcggtcctccgtctacgtttcggcggtagggaccgtagggtggagatcgaagacgaacgtggtggctgcctactacg

SEQ ID NO: 84670 - DNA, 599 bp, Homo sapiens
  misc_feature: GYAE6OF02ISTA8.47.46.E02.1.454.CMB.1.raw
  modified_base (202)..(202): a, c, t, g, unknown or other
  misc_feature (202)..(202): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaagttgtgttgacacagtctccagccaccctgtctttgtctccaggggaaangccaccctctcctgcagggccagtcagaatattcactcctacttagcctggtaccaacagaacctggtcaggctcccaggctcctcatctatgatgcatccaacgacggggcccacgtcggaccactccccgagacgacggttcaggtggcagggtgggtcgtggggacaggtacttcactctaccaccatcagcacgtcctagacgccgtagaacgtacgtttacggtactttattacttgttcagtcacgtcgtgtagttcgtcggtcccttccgtccttccgtaccgtttccgggccggtacggggtaccgaggggttaggacggtacgtaaccgaaaccggtacgtacggtacggtcgtacggccgtaccgtacgtaccgttcgttccttacg

SEQ ID NO: 84671 - DNA, 539 bp, Homo sapiens
  misc_feature: GYAE6OF02GO87W.47.46.E02.1.454.CMB.1.raw
  modified_base (481)..(481): a, c, t, g, unknown or other
  misc_feature (481)..(481): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcgtggcgtcttacgtgtggctttttaaaaggtgtccagtgtgaggtgcaactgttggagtctgggggagacttagtacacccctggggggtccctgagactctcctgtgcagcctctggactcacctttagcaactctgtcatgggctgggtccgccaggctccggggaaggggctgggagtgggtctcaagtattgatgagaatggtggaagcacattctacgtggactccgtgaacgggccgttcaccgatctccagagacaatttcaggagcacgctgtatctaacaatgaacagtctagagagaccgagacgacggccgttatattcngtgacgtaagtctagtagcagtcgcccctagccgctactttcttgtacttcgtacggg

SEQ ID NO: 84672 - DNA, 501 bp, Homo sapiens
  misc_feature: GYAE6OF02FMYYB.47.46.E02.1.454.CMB.1.raw
  modified_base (202)..(202): a, c, t, g, unknown or other
  misc_feature (202)..(202): n is a, c, g, or t
  modified_base (498)..(498): a, c, t, g, unknown or other
  misc_feature (498)..(498): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaangccaccatctcctgtagggccggtcagagtattagcatcaacttgcctggtaccagcagagacctgggcaggctcccaggctcctccatctatgatgcgtccaccagggccactggtttcccagccaggttcagtggcagtgcgtctgggacagagttcactctcaccatcaacagcctgcagtctgaagtattttgcttagtttattactgtcagcagtatcatactggccgctctaccttcggaccaagggacacgacgtggagtaacttaaacgactggtggctgacactatntcg

SEQ ID NO: 84673 - DNA, 486 bp, Homo sapiens
  misc_feature: GYAE6OF02I0JMA.47.46.E02.1.454.CMB.1.raw
  modified_base (207)..(207): a, c, t, g, unknown or other
  misc_feature (207)..(207): n is a, c, g, or t
  modified_base (291)..(291): a, c, t, g, unknown or other
  misc_feature (291)..(291): n is a, c, g, or t
  modified_base (326)..(326): a, c, t, g, unknown or other
  misc_feature (326)..(326): n is a, c, g, or t
  modified_base (331)..(331): a, c, t, g, unknown or other
  misc_feature (331)..(331): n is a, c, g, or t
  modified_base (344)..(344): a, c, t, g, unknown or other
  misc_feature (344)..(344): n is a, c, g, or t
  modified_base (352)..(352): a, c, t, g, unknown or other
  misc_feature (352)..(352): n is a, c, g, or t
  modified_base (361)..(361): a, c, t, g, unknown or other
  misc_feature (361)..(361): n is a, c, g, or t
  modified_base (453)..(486): a, c, t, g, unknown or other
  misc_feature (453)..(486): n is a, c, g, or t
tcagagctcacgtacacgaccggtgctcgatttagactcatctacagggaaaggggctggagtgggtctcaagtattgatgagaatggtggaagcacattctacgtggactccgtgaagggccgttcaccatctccagagactaatttcaggagcacgctgtatctacaatgaacagcctgagagccgaggaacggcgtatatttcngtgcgtaaagtctatagcagtcgccccctagcgcacttctttgacttctggggtccagggaactccgtggtccaccgtctccancgccctccaccgagggcccagtccggtctccccgnggccncctgctcgaggcncacgtcgngacgcaacngccgccctgggcctcgccgtaggtacaaacggtccttaccttcctaacgtgacgctacgtggacgcgggctcggacaacggcgtacagtagnnnnnnnnnnnnnnnnnnnnnnnnnnnnnnnnnn

SEQ ID NO: 84674 - DNA, 412 bp, Homo sapiens
  misc_feature: GYAE6OF02F822Y.47.46.E02.1.454.CMB.1.raw
  modified_base (405)..(412): a, c, t, g, unknown or other
  misc_feature (405)..(412): n is a, c, g, or t
tcagagctcacgtacacgaccggtgctcgatttagactcatctacaggggaaagggccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctagagcctgaagacttggactttattactgtcagcagcgtgagttctggcctccgctcactttcggcggagggaccagggtggagatcaaacgaactgtggctgcaccatctgtcttcatcttcccgccatctgatacgtgagctctgagcgggctggccaaggcgcatagnnnnnnnn

SEQ ID NO: 84675 - DNA, 550 bp, Homo sapiens
  misc_feature: GYAE6OF02G1OC2.47.46.E02.1.454.CMB.1.raw
  modified_base (410)..(410): a, c, t, g, unknown or other
  misc_feature (410)..(410): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagagatgacgcagtctccagccaccctgtctgtgtctccaggggaaagagccaccctctcctgcagggccagtcagagtattagcagcaacttagcctggtaccagcagaaacctgggcaggctcccaggcctcctcatctatggtgcatcccaccgagggcccacgtggtactccccagccaggttcagtcggctaggtgggtctggggacaggtacgttcactctcaccatcagcagcctgctagtctgaagtntttgactaatttattacttgtactagtctagttaataatacgtggtacctcgtcttcggaccgtaacgggactacgacgtaggaagtaacgttaacgaacgttaggtacggacgttcgacctaccgtacttcgtagtccg

SEQ ID NO: 84676 - DNA, 589 bp, Homo sapiens
  misc_feature: GYAE6OF02HRY1U.47.46.E02.1.454.CMB.1.raw
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcgtggcgtcttacgtgtggctttttaaaaggtgtccagtgtgaggtgcaactgttggagtctgggggagacttagtacaccccgtggggggtccctgagactctcctgtgcagcctctggactcacctttagcaactctgtcgtgggctgggtccgcaggcgtccggggagggctggagtggtctcaagtattgatgagaatgggtagaagcacgattctacgtggactccgtggaagggccggtttcaccatcgtccagagactatttcgaggagcacgctgtactctaacaatgaacagtacgtgacgagccggaaggaccgacgggtaccgtaattacgtttcctggttacgacgtaaagttcgtaagtacgactacggtccgtccccctaacgccgtacctacgttttcgtttacgacctttcggcgggtacccgg

SEQ ID NO: 84677 - DNA, 564 bp, Homo sapiens
  misc_feature: GYAE6OF02IAEA4.47.46.E02.1.454.CMB.1.raw
  modified_base (346)..(346): a, c, t, g, unknown or other
  misc_feature (346)..(346): n is a, c, g, or t
tcagagctcacgtacacgaccggtgctcgatttagactcatctacagggaaagggggctctgagagaggagcccagccctgggattttcaggtgttttcatttggtgatcaggactgaaccgagagaactcaccatggagtttgggctgagctggctctttcttgtggcttttttaaaaaggtgtccagtgtgaggtgcaactgttggagtctgggggagacttagtacaccctggggggtccctgagaccctcctgtgcagcctctggactcacctttagcaactctgtcatgggctgggtccgccaggcgtccggggaaggggctgggagtgggtctcgaagtnttgatgagaatggtggaagcacattctacgtggactccggtgaagggccgttacaccatcctccagacgacaatttcgaggagcacgctgtactactaacaaatgaaacagaccgtgaagacgaccggaggaccgaacggccgttattagtttctgtgacgtaagtctaagtagctagtcgaccccctagccgctaccttctttcgtaccttgtcggg

SEQ ID NO: 84678 - DNA, 569 bp, Homo sapiens
  misc_feature: GYAE6OF02IB8Y2.47.46.E02.1.454.CMB.1.raw
  modified_base (353)..(353): a, c, t, g, unknown or other
  misc_feature (353)..(353): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggtcttttttaaaaggtgtccagtgtgaggtgcaactgttggagtctgggggagacttagtacacccgtgggggtccctgagactctcctgtgcagcctctggactcacctttagcaactctgtcatgggctgggtccgccaggcctccgagggatcggggcctgggagtggggttggccgtgtcaagngcagaactgatggtgcgacatctagaatacgctgccacccggtagaacggcagacttcacatctccagagatgattacaaataaatatagtcaatactactaacaataggaacttagacctaagaaactagaagatacgtaggttagtttaattacgttcgttaccgacgtaagggtactacggtaccggttcgtcggttcgggaccggtaacggg

SEQ ID NO: 84679 - DNA, 537 bp, Homo sapiens
  misc_feature: GYAE6OF02HXGR4.47.46.E02.1.454.CMB.1.raw
  modified_base (307)..(307): a, c, t, g, unknown or other
  misc_feature (307)..(307): n is a, c, g, or t
  modified_base (362)..(362): a, c, t, g, unknown or other
  misc_feature (362)..(362): n is a, c, g, or t
tcagagctcacgtacacgaccggtgctcgatttagactcatctacagggaaagggggctctgagagaggagcccagccctgggattttcaggtgttttcatttggtgatcaggactgaaccgagagaactcaccatggagtttgggctgagcgtggcgtcttacgttgtggcttttttaaaaggtgtccagtgtgaggtgcaactgttggagtctgggggagacttagtacaccctggggggtccctgagactctcctgtgcagcctctggactcacctttagcaactctgtcatgggctgggtccnccaggctccgggggaaggggctgggagtgggtctcagtatgatgagatggtggancacattctacgtgactcgtgaagggccgttcaccgatctcagagacatttcaggagcacgctgtatctaacaaatcgaacacgcctagacgagccgaggacacggctatattcgtgtgacgtaagtctagtagacacgtcgccccctagccgacctactttcttcgacgttccgg

SEQ ID NO: 84680 - DNA, 726 bp, Homo sapiens
  misc_feature: GYAE6OF02HYZ9P.47.46.E02.1.454.CMB.1.raw
  modified_base (215)..(215): a, c, t, g, unknown or other
  misc_feature (215)..(215): n is a, c, g, or t
  modified_base (267)..(267): a, c, t, g, unknown or other
  misc_feature (267)..(267): n is a, c, g, or t
  modified_base (290)..(290): a, c, t, g, unknown or other
  misc_feature (290)..(290): n is a, c, g, or t
  modified_base (383)..(383): a, c, t, g, unknown or other
  misc_feature (383)..(383): n is a, c, g, or t
tcagagctcacgtacacgaccggtgctcgatttagactcatctacagggaaaggggtctgagagaggagcccagccctgggatttcaggtgttttcatttggtgatcaggactgaacgagagaactcaccatggagtttgggctgagctggctctttcttgtggcttttttaaaaggtgtccagtgtgaggtgcaactgttggagtctggggganacgttagtacaccccgtggggggtccctgagactcgtcctgtgcagcctcgnggacctccaacctttagcaactntgtcagtgggctgggtcccacgaggccgtaccgggggaagggtccgtggaggttcgggtcctagaaaggttattgagtaggagaaagttgggnggaaacgcaactagttctacggtgactccgggtagaacgggtccgttacaaccattcccacaagaacgactaaacgtttcgaaggacgtacaaccggcttaggtataaccgtaaacttaaaagcggtaaacacgttcaacggaaggaacggacccgggacgggaaacccgaacccggggtacccggttaaatttcccggtttagtcgttagaaccggtaaaacgggtttcccttaaaggtaacggtaccgtaacgggttaccccggtaacccccccctaggtcccccggtacctaaacccggtttttccctttttacggaccctttcggggttacccgggggg

SEQ ID NO: 84681 - DNA, 548 bp, Homo sapiens
  misc_feature: GYAE6OF02GAURF.47.46.E02.1.454.CMB.1.raw
  modified_base (202)..(202): a, c, t, g, unknown or other
  misc_feature (202)..(202): n is a, c, g, or t
  modified_base (447)..(447): a, c, t, g, unknown or other
  misc_feature (447)..(447): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgaagcagtctccagccaccctgtctgtctctccaggggaaangccaccatctcctgtagggccggtcagagtattagcatcaacttagcctggtaccagcagagacctgggcaggcctcccaggcctcctcatctatgatgccgtccaccgagggccacgttcggtttcccagcctaggttcagtggcagtgcgtcgtgggacagtacgttcactctcacatcagcagacgtggagcctagaagtatttgcgtagtgttattacttgtacagctagtagtaggaacncctacccgtattctacgtttccggcccgttacgggaccgtaaggtggtaagttcgtaacgaaacgtacgtaggtcggtccgtcggactaccgtatcgttcg

SEQ ID NO: 84682 - DNA, 637 bp, Homo sapiens
  misc_feature: GYAE6OF02JNXK2.47.46.E02.1.454.CMB.1.raw
  modified_base (630)..(631): a, c, t, g, unknown or other
  misc_feature (630)..(631): n is a, c, g, or t
tcagagctcacgtacacgaccggtgctcgatttagactcatctacaggggaaagggggaggaactgctcagttaggaccagacggaaccatggaagcccagcgcagcttctcttcctcctgctactctggctccagagaccactggagaaatagtgatgacgcagtctccacgccaccctcgtctcgtctctccgagggaagagaccaccactctcctgtacgggccggtacgagagtagttagcactactaacttacgtaccgttacgggttaaccgtaacggtaccgaacggtaacggtaacccggtacggggaccggtaacggggtacccgtaccccggtaaccgggtacccgttacccgttaccgtaacgttaccttaacgttacggtaacgttacggtaccgttacccgaacccgtaaccgggacccgtaccgttaccggtttacccgtacggtaccgtacggttacgtacggtacggtacgtacggtacgtacggtacgtacgggtacgtacggtacgttacgtacgtacgtacctacctactacaacgtacgtaccgtacgtaccgtacgtacgtacgtaacgttacgtttacgtacgttacgtttacgttacgttacgtacnnatacgg

SEQ ID NO: 84683 - DNA, 535 bp, Homo sapiens
  misc_feature: GYAE6OF02I1CFW.47.46.E02.1.454.CMB.1.raw
  modified_base (391)..(391): a, c, t, g, unknown or other
  misc_feature (391)..(391): n is a, c, g, or t
  modified_base (394)..(394): a, c, t, g, unknown or other
  misc_feature (394)..(394): n is a, c, g, or t
  modified_base (397)..(397): a, c, t, g, unknown or other
  misc_feature (397)..(397): n is a, c, g, or t
  modified_base (429)..(429): a, c, t, g, unknown or other
  misc_feature (429)..(429): n is a, c, g, or t
  modified_base (473)..(473): a, c, t, g, unknown or other
  misc_feature (473)..(473): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcgtggctctttctgtggcttttttaaaaggtgtccagtgtgaggtgcaactgttggagtctgggggagacttagtacaccctggggggtccctgagactctcctgtgcagcctctggactcacctttagcaactctgtcatgggctgggtccgccaggctccgggggaagggctgggagtgggtctcgaagtattgatgagaatggtggaagcacattctagtgactcgtgaagggccgttnacntcncagagacaattcaggagcacgctgtatctaanaaatgaacagcctgagagccgaggaccacggccgtattatttcngtgacgaagtctaagtgacaggtccgacccctagcgctacctttcttacgactttcgcgggg

SEQ ID NO: 84684 - DNA, 509 bp, Homo sapiens
  misc_feature: GYAE6OF02G4TVB.47.46.E02.1.454.CMB.1.raw
  modified_base (203)..(203): a, c, t, g, unknown or other
  misc_feature (203)..(203): n is a, c, g, or t
  modified_base (310)..(310): a, c, t, g, unknown or other
  misc_feature (310)..(310): n is a, c, g, or t
  modified_base (349)..(349): a, c, t, g, unknown or other
  misc_feature (349)..(349): n is a, c, g, or t
  modified_base (380)..(380): a, c, t, g, unknown or other
  misc_feature (380)..(380): n is a, c, g, or t
  modified_base (400)..(400): a, c, t, g, unknown or other
  misc_feature (400)..(400): n is a, c, g, or t
  modified_base (430)..(430): a, c, t, g, unknown or other
  misc_feature (430)..(430): n is a, c, g, or t
  modified_base (497)..(497): a, c, t, g, unknown or other
  misc_feature (497)..(497): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagattccaccggagacattgttttgacacagtctccagccaccctgtctttgtctccagggggaaanagccaccctctcctgcagggccagtcagagtgtggcagctacttagcctggtaccaacagaaacctggtcaggctcccaggctcctcatctatgatgcatccaacgngggccactggttcccagccaggttcagtgcagtgcgtcngggacagagttcactctcgaaccatcaaacncgcctgcagtctagaacgtntttgctagtttattacttgtcagcagtatnataacgtggcctctcaccttcgaccaaggacacgacgtggacgtaagtaacgactggtgctgacacntcgtctctctac

SEQ ID NO: 84685 - DNA, 504 bp, Homo sapiens
  misc_feature: GYAE6OF02GQPH7.47.46.E02.1.454.CMB.1.raw
  modified_base (202)..(202): a, c, t, g, unknown or other
  misc_feature (202)..(202): n is a, c, g, or t
  modified_base (437)..(437): a, c, t, g, unknown or other
  misc_feature (437)..(437): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaanagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctagaagtattttgctagtttattactgtcagcagtatcataactggccnctctaccttcggaccaagggacacgactggaagagttaaacgaactgtaggctcgcacctatctacg

SEQ ID NO: 84686 - DNA, 534 bp, Homo sapiens
  misc_feature: GYAE6OF02ICUZF.47.46.E02.1.454.CMB.1.raw
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggctttttaaaaggtgtccagtgtgaggtgcaactgttggagtctgggggagacttagtacaccctgggggtcccctgagactctcctgtgcagcctctggactcacctttagcaactctgtcatgggctgggtccgccaggctccgggggaaggggctgggagtgggtctcgaagtattgatgagaatggtggaagcacattctacgtggactccgtggaaggccggttcaccatctccagagacaattcaggagcacgctgtatctacaaatgaacagtctagagacgacgaggacacggctatattctgtgacgaagtctagtagacagtcgcccctagccgctaccgttctttcgacttgtcgggg

SEQ ID NO: 84687 - DNA, 549 bp, Homo sapiens
  misc_feature: GYAE6OF02I5CEB.47.46.E02.1.454.CMB.1.raw
  modified_base (202)..(202): a, c, t, g, unknown or other
  misc_feature (202)..(202): n is a, c, g, or t
  modified_base (329)..(329): a, c, t, g, unknown or other
  misc_feature (329)..(329): n is a, c, g, or t
  modified_base (387)..(387): a, c, t, g, unknown or other
  misc_feature (387)..(387): n is a, c, g, or t
  modified_base (408)..(408): a, c, t, g, unknown or other
  misc_feature (408)..(408): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaangccaccatctcctgtagggccggtcagagtattagcatcaacttagcctggtaccagcagagacctgggcaggcctcccaggcctcctcatctatgatgccgtccaccgagggcccagttggtttcncagcctaggttcaggtggcagtgcgtctggggacagacgttcactctcaccatcaacncgcctgctagtctagaacgtntttgcttagtttattactgtcagtctagttactctaacttaacgtcggtacctctacctaccgttccgaccgtacggaccacggtacgtaggaagtaacgttaaacgacgttacggtcggtacgtcgaccgtacctagtcg

SEQ ID NO: 84688 - DNA, 592 bp, Homo sapiens
  misc_feature: GYAE6OF02GZ7CF.47.46.E02.1.454.CMB.1.raw
  modified_base (466)..(466): a, c, t, g, unknown or other
  misc_feature (466)..(466): n is a, c, g, or t
  modified_base (495)..(495): a, c, t, g, unknown or other
  misc_feature (495)..(495): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcgtggctcttcttgtggtctttttaaaaggtgtccagtgtgaggtgcaactgttggagtctgggggagacttagtacaccctggggggtccctgagactctcctgtgcagcctctggactcacctttagcaactctgtcatgggctgggtccgccaggcgtccggggaaggggctggagtgggtctcgaagtattgatgagaagtggtggaagcacattctacgtgactccgtgaacgggccggttacaccatcctccgagacgactaaatttcaggtacgcaacggctagtatcctaacaaatgaacagtctaganagaccgaggacacggccgtattactttcngtagacgaaagtccttaagtagtacctaaggtccgaccccccttaacggcccgtccgtaaccgttttccgtttacggtaccgtttccggtaccgggg

SEQ ID NO: 84689 - DNA, 598 bp, Homo sapiens
  misc_feature: GYAE6OF02I872E.47.46.E02.1.454.CMB.1.raw
  modified_base (205)..(205): a, c, t, g, unknown or other
  misc_feature (205)..(205): n is a, c, g, or t
tcagagctcacgtacacgaccggtgctcgatttagactcatctacagggaaagggggaggtaacgtgctcagttaggacccagacggaaccatggaagccccagcgcagcttctcttcctcctgctactcgtggcctcccagagaccactggagaaatagtgatgacgcagtctccagccacctgtctgtctctccaggggaacncgccaccatctcctgtagggccggtcagagtattagcatcaacttgcctggtaccagcagagacctgggcaaggcttacccgaggcctcctcatctatgatgccgtccaccgagggccactcggtttcccagcctaggttccagtggtacaaggtcgcgtcgtgggactagtagttccgaaccttctaccaacctactacgaaaccacgtcccttagcctagttcctaggtaaagtacttttcgcttaacgttttacttacgttgtacagtctaagttatacaattaacctggtccctactcctaccttcggaccgaacgggtacaacgtaccgtacggacgtaacgttaaaccgaacgttggtacggctacggtaccaaccgtattcgtacg

SEQ ID NO: 84690 - DNA, 438 bp, Homo sapiens
  misc_feature: GYAE6OF02HUQ3J.47.46.E02.1.454.CMB.1.raw
  modified_base (424)..(424): a, c, t, g, unknown or other
  misc_feature (424)..(424): n is a, c, g, or t
  modified_base (429)..(438): a, c, t, g, unknown or other
  misc_feature (429)..(438): n is a, c, g, or t
tcagagctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtcgccccctagcgcacttctttgacttctggggccagggatcctggtcaccgtctccacagcctccaccaagggcccatcggtcttccccctggccgccctgcctccaggacgccacctccgagagcacagccggccctgggctgcctggtcaagggctacttcctacgtgagctctgagcgggctggcaggcgnatagnnnnnnnnnn

SEQ ID NO: 84691 - DNA, 717 bp, Homo sapiens
  misc_feature: GYAE6OF02I83PP.47.46.E02.1.454.CMB.1.raw
  modified_base (306)..(306): a, c, t, g, unknown or other
  misc_feature (306)..(306): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggtctttttaaaggtgtccagtgtgaggtgcaactgttggagtcgtgggggagacttagtacacccgtgggggtccctggagactctcctgtgcagcctctggactcacctttagctaactctgtcagtgggctcgggtccnccgaggcgtccgggggaagggcgtgggaggtcgggtctcgaagtattgatgagaagtggtgaagcactattctaacggtggaactcgtaggaacgggtcccggttacaacccgtagtccgtaccgaggaacgtactaaagtttcgaggtacgccaacggtcttacggttaactaccgttaaactaaacgttacggaaacctcgtaccctagggaacggtaaccggacccggtaaacgggaccgaacccgggtacccgttaaagtttaccggtttacgttaggtacgtaccggtaaacgttaccgttaacgtaacggtaccgttacggtacccggtacccccccgttaaagggtccctaaccgttaaccgttttacccgttttacggttaccgtttcccgggttaaccgggg

SEQ ID NO: 84692 - DNA, 567 bp, Homo sapiens
  misc_feature: GYAE6OF02GZ2SH.47.46.E02.1.454.CMB.1.raw
  modified_base (202)..(202): a, c, t, g, unknown or other
  misc_feature (202)..(202): n is a, c, g, or t
  modified_base (261)..(261): a, c, t, g, unknown or other
  misc_feature (261)..(261): n is a, c, g, or t
  modified_base (312)..(312): a, c, t, g, unknown or other
  misc_feature (312)..(312): n is a, c, g, or t
tcagagctcacgtacacgaccggtgctcgatttagactcatctacagggaaagggggaggaactgctcagttaggacccagacggaaccatggaagccccagctcagcttctcttcctcctgctactctggctcccagattccaccggagacattgttttgacacagtctccagccaccctgtctttgtctccaggggaaanagccaccctctcctgcagggccagtcagagtgttggcagctacttagcctggtaccaanagaaacctggtcaggcctcccgaggcctcctcatctatgatgcatccaagngggccagtggcactcccagacaggttcaggtggctaggtgggtctaggggacaggtacttcgacttcacacatcagcagtcctagacgctagaacgtacgtttggacttttagttacgttgtacagccagtcgtgtacgttcgtcggtcctccgctcgtacgtttcgggcggtacgggaccgagggtaggacgacgtaacgaaacggtacgtggtacggcttacggacctaccgtagttcgttcgtaccttaccg

SEQ ID NO: 84693 - DNA, 542 bp, Homo sapiens
  misc_feature: GYAE6OF02GNBH6.47.46.E02.1.454.CMB.1.raw
  modified_base (304)..(304): a, c, t, g, unknown or other
  misc_feature (304)..(304): n is a, c, g, or t
tcagagctcacgtacacgaccggtgctcgatttagactcatctacagggaaagggggctctgagagaggagcccagccctgggattttcaggtgttttcatttggtgatcaggactgaaccgagagaactcaccatggagtttgggctgagctggctctttcttgtggcttttttaaaaggtgtccagtgtgaggtgcaactgttggagtctgggggagacttagtacaccctggggggtccctgagactctcctgtgcagcctctggactcacctttagcaactctgtcatgggctgggtccnccaggctccgggggaagggctgggagtgggtctcaagtattgatgagaatggtggaagcacattctacggtggactccggtgaacgggtcccggttcaccatcctccagagacaatttcaggagcacgctagtatctaacaaatgaacagcctgagagccgaggacacggccgtatattctgtgacgaagtctaatagcacgtcgccccctacgccgcctactttctttcgacttcgg

SEQ ID NO: 84694 - DNA, 507 bp, Homo sapiens
  misc_feature: GYAE6OF02ISPEQ.47.46.E02.1.454.CMB.1.raw
  modified_base (202)..(202): a, c, t, g, unknown or other
  misc_feature (202)..(202): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaanagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggactagagttcactctcaccatcaacagcctgcagtctagaagtattttgcttaagtttattactgtcagctagtatcataactggccgctcaccttacgaccgtaaggccacgactggagagttaaacgaacttggtggctgaccacgatctcg

SEQ ID NO: 84695 - DNA, 666 bp, Homo sapiens
  misc_feature: GYAE6OF02GPG5H.47.46.E02.1.454.CMB.1.raw
  modified_base (153)..(153): a, c, t, g, unknown or other
  misc_feature (153)..(153): n is a, c, g, or t
  modified_base (155)..(155): a, c, t, g, unknown or other
  misc_feature (155)..(155): n is a, c, g, or t
  modified_base (362)..(362): a, c, t, g, unknown or other
  misc_feature (362)..(362): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcggngngtcttagtgtgactttttaaaggtgtcagtgtgaggtgcaactgttggagtctgggggagacttagtacacccgtggggggtccctgagactctcctgtgcagcctctggactcacctttagctaactctgtcatgggctgggtccgccaggcgtccgggggaagggctggagtgggtctcgaagtattgatgagatggtagagcanttcgacgtgactcgtagagggtccgttcaccagtcctacgagagactaatttcgaggacgtccgaacgtctacggtactacctaaactaaagttagaaactacgtacctaggaacgaaccggaccggaacgggtaaccgaaccggggtaccctttaaagtttaaccgtttttccgtaggttaaccggtaacgttaaacggtttaccttaaagttaaccggaccgttaacggttccccgtaccccccgttaaggacccggtcctttaacccgtttcgtttacggtacctttccgggtaaccgggg

SEQ ID NO: 84696 - DNA, 416 bp, Homo sapiens
  misc_feature: GYAE6OF02FLS1F.47.46.E02.1.454.CMB.1.raw
  modified_base (375)..(375): a, c, t, g, unknown or other
  misc_feature (375)..(375): n is a, c, g, or t
  modified_base (400)..(400): a, c, t, g, unknown or other
  misc_feature (400)..(400): n is a, c, g, or t
  modified_base (406)..(416): a, c, t, g, unknown or other
  misc_feature (406)..(416): n is a, c, g, or t
tcagagctcacgtacacgaccggtgctcgatttagactcatctacaggggaaagggccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgctcaccttcggccaagggacacgactggagattaaacgaactgtggctgcaccatctgtcttcattccttccccgccatctgactacgnagctctgagcgggctgggcaaggcncatagnnnnnnnnnnn

SEQ ID NO: 84697 - DNA, 546 bp, Homo sapiens
  misc_feature: GYAE6OF02JBODR.47.46.E02.1.454.CMB.1.raw
  modified_base (202)..(202): a, c, t, g, unknown or other
  misc_feature (202)..(202): n is a, c, g, or t
  modified_base (392)..(392): a, c, t, g, unknown or other
  misc_feature (392)..(392): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaangccaccatctcctgtagggccggtcagagtattagcatcaacttagcctggtaccagcagagacctgggcaggctccaggctcctcatctatgatgcgtccaccagggccactggttcccagccaggttcagtgcagtgcgtctgggacagagttcactctcaccatcaacagcctgcagtctagaagtnttttgacttagttttattacttgtctagctagttatactataacgtcggccgtctccgtaccgttccgggaccaagggaccacggtacgtcgggaacgtaacgttaaacggaacgttaggtacggtacttcggacctacccgtattccgttacg

SEQ ID NO: 84698 - DNA, 566 bp, Homo sapiens
  misc_feature: GYAE6OF02IOB7B.47.46.E02.1.454.CMB.1.raw
  modified_base (284)..(284): a, c, t, g, unknown or other
  misc_feature (284)..(284): n is a, c, g, or t
  modified_base (520)..(520): a, c, t, g, unknown or other
  misc_feature (520)..(520): n is a, c, g, or t
tcagagctcacgtacacgaccggtgctcgatttagactcatctacagggaaaggggtctgagagaggagcccagccctgggattttcaggtgttttcatttggtgatcagcactgaacacagaggactcaccatggagtttgggctgagcgtggttttcgcgttaggctctttaaagaggtgtccagtgtcaggtgcgcctggtggagtcgggggagcgtggtccagcctgggactccctgagactctcctgtgcagcctcgtggcttcaccttcaataattangctatgcagtcgggtccgccaggctccgaggcgaaggggctagaggtggtggcggtcatatcgtcagtggacatcgttcagttactacgctaaggacctcccgtggaggggccacttacacctactctaccgaagacgaacaacgttcccaagaactaccggtctaactcgtgaccactacgacctagcctagacgaactcgaacgacgtactcctcctacgtacctacgttacgngtaccgtaaggagtacggttacgtacggaagttctacgtagtacgg

SEQ ID NO: 84699 - DNA, 528 bp, Homo sapiens
  misc_feature: GYAE6OF02IM2YM.47.46.E02.1.454.CMB.1.raw
  modified_base (261)..(261): a, c, t, g, unknown or other
  misc_feature (261)..(261): n is a, c, g, or t
  modified_base (434)..(434): a, c, t, g, unknown or other
  misc_feature (434)..(434): n is a, c, g, or t
  modified_base (487)..(488): a, c, t, g, unknown or other
  misc_feature (487)..(488): n is a, c, g, or t
  modified_base (490)..(496): a, c, t, g, unknown or other
  misc_feature (490)..(496): n is a, c, g, or t
  modified_base (498)..(498): a, c, t, g, unknown or other
  misc_feature (498)..(498): n is a, c, g, or t
  modified_base (501)..(502): a, c, t, g, unknown or other
  misc_feature (501)..(502): n is a, c, g, or t
  modified_base (505)..(505): a, c, t, g, unknown or other
  misc_feature (505)..(505): n is a, c, g, or t
  modified_base (507)..(511): a, c, t, g, unknown or other
  misc_feature (507)..(511): n is a, c, g, or t
  modified_base (513)..(518): a, c, t, g, unknown or other
  misc_feature (513)..(518): n is a, c, g, or t
  modified_base (520)..(520): a, c, t, g, unknown or other
  misc_feature (520)..(520): n is a, c, g, or t
  modified_base (522)..(527): a, c, t, g, unknown or other
  misc_feature (522)..(527): n is a, c, g, or t
tcagagctcacgtacacgaccggtgctcgatttagactcatctacaggggaaagggccgaccatctcctgtagggccggtcagagtattagcatcaacttagcctggtaccagcagagacctgggcaggcctcccaggctcctcatctatgatgcgtccaccgagggcccacttggtttccccagccctaggttcaggtggcagtgcgtcgtgggacagagttcactctcaccataccaacagcctgctagtctagaagtnttttgctagtttattactgtcagcagtactactataacgtggtcccgctccaccgttcggaccgaacgggaccacggtacgtgggaagtaactttaaaacggactggtcggctgaccaacctattcgtgttccttcacttcccttccccgcctatctacggacttaccgggtnaccgtcttcgtagggacggtccggggtctagggacgtaaggccgtacagtagnngnnnnnnntntannagngnnnnngnnnnnncncnnnnnnc

SEQ ID NO: 84700 - DNA, 584 bp, Homo sapiens
  misc_feature: GYAE6OF02H4N0I.47.46.E02.1.454.CMB.1.raw
  modified_base (179)..(179): a, c, t, g, unknown or other
  misc_feature (179)..(179): n is a, c, g, or t
  modified_base (208)..(208): a, c, t, g, unknown or other
  misc_feature (208)..(208): n is a, c, g, or t
  modified_base (293)..(293): a, c, t, g, unknown or other
  misc_feature (293)..(293): n is a, c, g, or t
  modified_base (340)..(340): a, c, t, g, unknown or other
  misc_feature (340)..(340): n is a, c, g, or t
  modified_base (365)..(365): a, c, t, g, unknown or other
  misc_feature (365)..(365): n is a, c, g, or t
  modified_base (378)..(378): a, c, t, g, unknown or other
  misc_feature (378)..(378): n is a, c, g, or t
  modified_base (426)..(426): a, c, t, g, unknown or other
  misc_feature (426)..(426): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcggtgcgtcttagtgtgtacttttaaaggntcagtgtgagtgcatgtgagtctgggganacttagtacaccgtgggggtccctgagctctcctgtgcagtctctggactcacctttagctaactctgcagtggctggtccgacngcgtcggggaggtctggagtggtctagaagtatgattgagtagtggngaagcactattcgacgtgactccgngaaggtccgttanactatctaccaggacactaattgacgagcaacgtcgtgtactactaanaatagaactagtctagagagacccgagaccgtacggacctagttacttcgtagccggtaagtaaacgttcgtaagtacgtacctaggtaacccgtacccccgttaaggccggttaccttacctttccgttttaacgtccgttttacgtaacccggggg

SEQ ID NO: 84701 - DNA, 812 bp, Homo sapiens
  misc_feature: GYAE6OF02H9XLS.47.46.E02.1.454.CMB.1.raw
  modified_base (217)..(217): a, c, t, g, unknown or other
  misc_feature (217)..(217): n is a, c, g, or t
  modified_base (264)..(264): a, c, t, g, unknown or other
  misc_feature (264)..(264): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcgtgtcgtcttacgtgtgtacttttaaaggtgtcagtgtgaggtgcaactgttggagtcgtggggganactagtacacccgtgggggtccctgagactctcctgtgcacgcctcngactcacctttagcaactctgtcagtggcgtcgggtccgccgaggtcccggtaccggggggaaagggggtccgttggggaggttgggtacccgtacggtaaaggtttagtttaggagttagggaaaggtaaggttcggggttaagggaaaacggccctaaagttaacgtttcccggttaacgggttaccgggtaaccggttaccccgggttaggggaaaaccggggttcccgggttttacccaaacccgttaccgtttacccgttaaccgaacggtaaacgtaaccgtttaaacgttttaccggaaacgggtaacgaccggtacccgtaccgttaacggttaactaaccttaaacgtaaaacgtacgtaaaccgtaggtactacggaacgtacggaccgggaacgaccggaaccggtaccgttaagttacgttacggtacgttacggaagtaaacgttcggttaatacggtaccgtaacggtccccgtaccccgtaccggacttccgttaaccgtttcgtttacgttacccggttacggtacccgggg

SEQ ID NO: 84702 - DNA, 531 bp, Homo sapiens
  misc_feature: GYAE6OF02HBRJR.47.46.E02.1.454.CMB.1.raw
  modified_base (202)..(202): a, c, t, g, unknown or other
  misc_feature (202)..(202): n is a, c, g, or t
  modified_base (310)..(310): a, c, t, g, unknown or other
  misc_feature (310)..(310): n is a, c, g, or t
  modified_base (316)..(316): a, c, t, g, unknown or other
  misc_feature (316)..(316): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaagttattttgacacagtctccagccaccctgtctttgtctccaggggaaangcccaccctctcctgcagggtcagtcagagtattagcagcaacttagcctggtaccagcagaaacctgggcaggctccgaggctcctcatctgggatgcatccaacgngggccnctggcactcccagccaggttcaggtggcaggtgggtctgggacaggacttcacttctcaccatcagcacgcctagacgcctgaagtatttgactagtttattacgtgtacagacaaagtaatacgtcggcctccgtctcgtaccgtttcggcggacggaccgagggtgacagtaggaaacgactggtcgacgtgacacgattcctgttctctacg

SEQ ID NO: 84703 - DNA, 545 bp, Homo sapiens
  misc_feature: GYAE6OF02FMU2H.47.46.E02.1.454.CMB.1.raw
  modified_base (202)..(202): a, c, t, g, unknown or other
  misc_feature (202)..(202): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaanagccaccatctcctgtagggccgtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagtattttgcttagtttattactgtcagtcagttatctaataactcggccgtctccgtaccttcgggacccgaacgggaccaacggaccgtagggaacgtaagttaaaaccgaacgttaggtacggtcttacggacctaacccgtattcttacgg

SEQ ID NO: 84704 - DNA, 826 bp, Homo sapiens
  misc_feature: GYAE6OF02J3CMZ.47.46.E02.1.454.CMB.1.raw
tcagagctcacgtacacgaccggtgctcgatttagactcatctacagggaaagggggaggaacgtgctcagttaggaccagacggaaccatggaagcccagctcagcttctcttcctctgctactctggctccagacttccaccggagactagtttgttttacgaccacacgtcctccacgtccctacccttggttcctttacgtccgtaccggaagggggaaacgcgcccctacccttcctcgtcggacgacggggccctaaggttccaaggtcgttcggttggccaacggtccttaccgtttacggccccgttaggtaaaccccgaaaccgtaacggtaaacccgtcgggacccgtaagggtccccttaccccgaaggtccctaacccttcgtaacttccgttatacggaactccggtaccaacgtaacccggaacggccggggtacccttaaccggcggtacctaaccggttaccccgcggtaccccggtttaggttaaccgaacggtcggtaccgtaggtaaccgtcggtaccggtagggaacctcgtacctaaccgtcttccgacacgacctgacgtcacgtacctacgacgtccgttaagtaacgtttctttacgtaccttaacgttttactaacgtcgtaccagggtcctacggtaaccgttaccgactacggtttccgacgttaccgtttaaccgcgggtttacccgggaagggttccggaaacgttcggggtacgttaaccgccggttaacgaacggttaaccggtacggtttcggccggttacacccggttacaacccgttgggtaccctttccgg

SEQ ID NO: 84705 - DNA, 517 bp, Homo sapiens
  misc_feature: GYAE6OF02G0QEQ.47.46.E02.1.454.CMB.1.raw
  modified_base (202)..(202): a, c, t, g, unknown or other
  misc_feature (202)..(202): n is a, c, g, or t
  modified_base (310)..(310): a, c, t, g, unknown or other
  misc_feature (310)..(310): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctttgtctccaggggaaanagccaccctctcctgcagggccagtcagagtgttggcagctacttagcctggtaccaacagaaacctggccaggctcccaggctcctcatctatgatgcatccaacgngggccacgtggcactccccagcctaggttcaggtggcaggtgagtcgtgggacagtacttcactctacaccatcagcagcctagacgcctagaagtagtttcgacttacttttattactgtcagtcagtcgtagcacgtcgccttctctacgtttcggcggtacgggccgagggtgagagtacgagacgacgtggtgctgcactacg

SEQ ID NO: 84706 - DNA, 551 bp, Homo sapiens
  misc_feature: GYAE6OF02GYCHT.47.46.E02.1.454.CMB.1.raw
  modified_base (202)..(202): a, c, t, g, unknown or other
  misc_feature (202)..(202): n is a, c, g, or t
  modified_base (379)..(379): a, c, t, g, unknown or other
  misc_feature (379)..(379): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaanagccaccatctcctgtagggccgtcagagtattagcatcaacttgcctggtaccagcagagacctgggcaggctcccaggctcctcatctatgatgcgtccaccagggccactggttcccagccaggttcaggtggctagtgcgtctggggacagagttcactctcaccatacaacncgcctgctagtctagaagtattttgcttagttttattactgtctagactagtatactagtaacctggccctactccgtaccgttacggaccgtaacgggaccgtaacgtacgtaggaacgtaacgttaaaccggaacgttggtacggtactacgacctaccgtatccgttcg

SEQ ID NO: 84707 - DNA, 423 bp, Homo sapiens
  misc_feature: GYAE6OF02G5WZ4.47.46.E02.1.454.CMB.1.raw
  modified_base (402)..(402): a, c, t, g, unknown or other
  misc_feature (402)..(402): n is a, c, g, or t
  modified_base (407)..(423): a, c, t, g, unknown or other
  misc_feature (407)..(423): n is a, c, g, or t
tcagagctcacgtacacgaccggtgctcgatttagactcatctacaggggaaagggccaccatctcctgtagggccggtcagagtattagcatcaacttagcctggtaccagcagaaacctgggcaggctcccaggctcctcatctatggtgcatccaccagggccactggtatcccagccaggttcagtggcagtgggtctgggacagagttcactctcaccatcagcagcctgcagtctgaatattttgctaatttattactgtcagcagtataataactggcctcgcttcggcctaacgggacacgactggagattaaacgaactgtggctgcacatctgtctcactctcccgctatctcgtatacgtgacgtctcgtgacggcgggctgggcaggcgnatagnnnnnnnnnnnnnnnnn

SEQ ID NO: 84708 - DNA, 629 bp, Homo sapiens
  misc_feature: GYAE6OF02G6LF2.47.46.E02.1.454.CMB.1.raw
  modified_base (203)..(203): a, c, t, g, unknown or other
  misc_feature (203)..(203): n is a, c, g, or t
  modified_base (227)..(227): a, c, t, g, unknown or other
  misc_feature (227)..(227): n is a, c, g, or t
  modified_base (292)..(292): a, c, t, g, unknown or other
  misc_feature (292)..(292): n is a, c, g, or t
  modified_base (444)..(444): a, c, t, g, unknown or other
  misc_feature (444)..(444): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccgaggggaaangccacatctcctgtacgggccgtnagtagtattgcatcaacttgcctggtaccagcagacgaccgtgggcaggcctccgaggcctcctnactctatgatcgccgtccaccgagggccctacgttcggttcccagtcccgtaggttcaggtggctaggtcggcgtcgtgggactaggtacgtttcacgttcctaccgaacctataccaaaccgacgtcctacgctacgtctaggtaaagttnttttacgactttaagttttacttacgttgtacgtacgtactacgttatcttaacgtacgttcggacccgtccttaccgtaccggttccggaaccgaacggggtacaaccggtacgtaacgggaacttaaacgttaaaccgtaacgttggtacggtactacggacctaccgtacgttaccgttcgg

SEQ ID NO: 84709 - DNA, 536 bp, Homo sapiens
  misc_feature: GYAE6OF02FRUR1.47.46.E02.1.454.CMB.1.raw
  modified_base (400)..(400): a, c, t, g, unknown or other
  misc_feature (400)..(400): n is a, c, g, or t
  modified_base (482)..(482): a, c, t, g, unknown or other
  misc_feature (482)..(482): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggcttttttaaaaggtgtccagtgtgaggtgcaactgttggagtctgggggagacttagtacaccctggggggtccctgagactctcctgtgcagcctctggactcacctttagcaactctgtcatgggctgggtccgccaggctccgggggaaggggctgggagtgggtctcgaagtattgatgagaatggtggaagcacattctacgtggactccgtgaagggccggttcaccntctccagagacaatttcaggagcacgctgtatactaacaaatgaacagtctgagagaccgaggacacggccgtaatatttcngtgacgaagtctagtagcagtcgcccctagccgctacttcttgacttgtcgggg

SEQ ID NO: 84710 - DNA, 511 bp, Homo sapiens
  misc_feature: GYAE6OF02IHXJ0.47.46.E02.1.454.CMB.1.raw
  modified_base (203)..(203): a, c, t, g, unknown or other
  misc_feature (203)..(203): n is a, c, g, or t
  modified_base (359)..(359): a, c, t, g, unknown or other
  misc_feature (359)..(359): n is a, c, g, or t
  modified_base (433)..(433): a, c, t, g, unknown or other
  misc_feature (433)..(433): n is a, c, g, or t
  modified_base (445)..(445): a, c, t, g, unknown or other
  misc_feature (445)..(445): n is a, c, g, or t
tcagagctcacgtacacgaccggtgctcgatttagactcatctacaggggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaanagccaccatctcctgtagggccggtcagagtattagcatcaacttagccctggtaccagcagagacctgggcaggctccaggctcctcatctatgatgcgtccaccagggccacgtggtttcccagccgaggttcagtggcagtgcgtctgggacngtagttcacgtctcaccatcaacacgcctgcagtctagaagtattttgcttagtttattactgtcagcagtatnataacgtggccnctcaccgttcggaccgaaggaccacgacgtggaagtaataaacgactagtggctgacactatctcg

SEQ ID NO: 84711 - DNA, 563 bp, Homo sapiens
  misc_feature: GYAE6OF02IG23L.47.46.E02.1.454.CMB.1.raw
  modified_base (479)..(479): a, c, t, g, unknown or other
  misc_feature (479)..(479): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttctgtggctttttaaaaggtgtccagtgtgaggtgcaactgttggagtctgggggagacttagtacaccctggggggtccctgagactctcctgtgcagcctctggactcacctttagcaactctgtcatgggctcgggtccgccgaggcgtccgggggaagggctgggagtgggtctcaagtattgatgagaatgggtgaagcacattctagtggactccgtgaaggccgtcaccgatctcagagaactaagttcaggagcacgctgatctacaaatgaaccagcctagagagccgagacgacggacctattactttcgngtagaccgtaattcgtacgtagtcacggttccgacccccgttaaggccgtacctaaccttcgtttacgtaccgttcgtacgggg

SEQ ID NO: 84712 - DNA, 542 bp, Homo sapiens
  misc_feature: GYAE6OF02F9F39.47.46.E02.1.454.CMB.1.raw
  modified_base (202)..(202): a, c, t, g, unknown or other
  misc_feature (202)..(202): n is a, c, g, or t
  modified_base (377)..(377): a, c, t, g, unknown or other
  misc_feature (377)..(377): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaangccaccatctcctgtagggccgtcagagtattagcatcaacttagcctggtaccagcagagacctgggcaggctcccaggctcctcatctatgatgcgtccaccgagggccactggttcccagccaggttcagtgcagtgcgtctgggacagtagttcactctcaccatacaacngcctgcagtctagtaagtattttgcttagtttattactgtcagctagttatcataacgtcggccgtcttccgtaccgttccggaccgtaacggggccaacggtacgtaggtaacgtaacgtttaaaccggaacttggtacggtctcggacaaccgtatcgttacg

SEQ ID NO: 84713 - DNA, 773 bp, Homo sapiens
  misc_feature: GYAE6OF02H82E0.47.46.E02.1.454.CMB.1.raw
  modified_base (304)..(304): a, c, t, g, unknown or other
  misc_feature (304)..(304): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcgaccatggagtttgggctgagcgtgcgtcttacgtgtgactttttaaaggtgtccagtgtgaggtgcaactgttggagtcgtgggggagacttagtacacccgtggggggtccctgagactctcctgtgcagcctctggactcacctttagcaactctgtcagtggctgggtccncgaggccgtccgggggaagggctgggagtgggtctcgaggcagttggtggtagtggtgccgaggactacgtattacggtaaatcccctgacgagggtccattttcgtttactcttcccgaagtacgaactaaacgtttcccgaaaggtaaactaacgttacgtaggtaacttttccgttacggaccttaaggttttcggaaaccctaagggttaacccgttaggaaagggtacggttaaccgggaaacggggaaccctaacccgggggtacccggtttaattaaaccgtttttaacgtttacggttttaaaacggtttaaacgggttgggttaaggtttacggggttacgtacggtttaaaacccgggtgttaacccggggttttcccgggggggaacccccgggggttaacccttcccggggttacccgtaacccccggttttcgtttaccccggttccgtaacccgg

SEQ ID NO: 84714 - DNA, 722 bp, Homo sapiens
  misc_feature: GYAE6OF02HRJ98.47.46.E02.1.454.CMB.1.raw
  modified_base (315)..(315): a, c, t, g, unknown or other
  misc_feature (315)..(315): n is a, c, g, or t
tcagagctcacgtacacgaccggtgctcgatttagactcatctacagggaaaggggtctgagagaggagcccagcactagaagtcggcgttgtttccattcggtgatcagcactgaacacagaggactcaccatggagtttgggctgagctgggttttcctcgttgctcttttaagaggtgtccagtgtcaggtgcagctgggtggagtctgggggagcgtggtccagcctggggaagtccctgagacctctcctgtgctaacgtctggacttcaccttcacgttacctacggcatcgactacgtcggggtcccnccgaggcctccgagggcgaagggggcctggggagttggggtagcgttaattttagagttgggtaacgagtagggtaaaatttaagtttaatttaacgtatgactaaggtacctccgggtagggaacggggtcctagtttccaaccgtacttcctaccgtaagaacgaacctaaacttaccgaaagtaaaccgtacggtagttaactacgtggtaaacaaagttaacgtaaataacggtcccgtaaggaacggtaccgaacccgggtaaacggaaccgaccgggtacgttacgtttaacggttaacgtttaaaccggttggttaggttaaggaacggttaaggttaacgtttaagggggttaaacgttttaacggggttaaaccccgttccgggtaacccgttaaacg

SEQ ID NO: 84715 - DNA, 665 bp, Homo sapiens
  misc_feature: GYAE6OF02JPLN3.47.46.E02.1.454.CMB.1.raw
  modified_base (228)..(228): a, c, t, g, unknown or other
  misc_feature (228)..(228): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccagggaagagccaccatctcctgtagggccggtcgnagagtatagacactactaacttacgtaccgtacggtaccgacgacgagacgacgtcggacgacggcgtcccgacggtccgtcctactactactatacgtacgtcgtcgtaccgaccgacggaccgtaccgtacggttaccgtacgtacgtacggtacgtacgtacggtcgtacgtcgtcgtcggtcggtacgtagtacgtacgtacgtactactactactactaacgacgtaccgtcgtacgtacgtacgtagtaagttacgtttacgttacgttagtttacgttacgttacgtacgtacgtacgtacgtacgtactaacgtaacgtacgtaccgtcgtaccgtaccgtaccgtaccgtacggtacgtaaccggtaacgtacgtaacgtaacgttaacgtaacgtacgtacggtacgtacgtacgtacgtacgtacg

SEQ ID NO: 84716 - DNA, 607 bp, Homo sapiens
  misc_feature: GYAE6OF02HDYX0.47.46.E02.1.454.CMB.1.raw
  modified_base (443)..(443): a, c, t, g, unknown or other
  misc_feature (443)..(443): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggcttttttaaaaggtgtccagtgtgaggtgcaactgttggagtctgggggagacttagtacacccgtggggggtccctggagactctcctgtgcagcctctggactcacctttagcaactctgtcatgggctgggtccgccgaggcgtccgggggaaggggctgggaggtgggtctcgaagtattgatgagaagtggtggaagcactattctacggtggactccggtaggaacggggtccggttacaccgatcctccgagacgactaatttcgaggancacgctagtatactaacaaatcgaacagtcaggagacgaccggaggaccacggtaccgttattacgttctggtacgaacgtaacgttctaagtcgaccgtaacggtcccgaccccccgtaaggcccgtactaccttttcgtttacgtaccgttcgtaccggggg

SEQ ID NO: 84717 - DNA, 628 bp, Homo sapiens
  misc_feature: GYAE6OF02JGSUM.47.46.E02.1.454.CMB.1.raw
  modified_base (450)..(450): a, c, t, g, unknown or other
  misc_feature (450)..(450): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcgtgtcgtcttacgtgtgactttttaaaaggtgtcagtgtgaggtgcaactgttggagtctggggagacttagtacaccctgggggtccctgagactctcctgtgcagcctctggactcacctttagcaactctgtcatgggctgggtccgccaggcgtccgggggaaggcgtggacggtggtctcgaagtattgatgagatggtgaagtcactattcgtacgtggactcgtagacgggtccggttacacctatccgtcagagactaatttcgaggtacgcacgctagtacgttacctaanaaagttgaaacctagttaccgtaggaacggacgccggaagggaccgaacgggtcccgttaattagtttaccgtagggtaccgtacgtaacggttactaaggttacggaactacggttcccgacccccgttaacggcgttaccctacgttttacgttccgttacgttccggtaccgggg

SEQ ID NO: 84718 - DNA, 543 bp, Homo sapiens
  misc_feature: GYAE6OF02HFOJ3.47.46.E02.1.454.CMB.1.raw
  modified_base (202)..(202): a, c, t, g, unknown or other
  misc_feature (202)..(202): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacacagtctccagccaccctgtctttgtctccaggggaaanagcccaccctctcctgcagggccagtcagaatattcactcctacttagcctggtaccaacagaaacctggtcaggctcccaggctcctcatctatgatgcatccaacagggccactggcatcccagacaggttcagtggcaggtgggtctgggacaggacttcactctccacatcagcagcctagacgcctgaagtactttggtactttattacttgtcagcagtcgtgtagttcgtggcctccgtctcgtacgtttcggcggtacgggaccgtaggggtcggaggtagtaccgaaacggtacgtcgtaggcgtacggacctaccgtacttcgtagttccg

SEQ ID NO: 84719 - DNA, 637 bp, Homo sapiens
  misc_feature: GYAE6OF02GSFM5.47.46.E02.1.454.CMB.1.raw
  modified_base (156)..(156): a, c, t, g, unknown or other
  misc_feature (156)..(156): n is a, c, g, or t
  modified_base (181)..(181): a, c, t, g, unknown or other
  misc_feature (181)..(181): n is a, c, g, or t
  modified_base (310)..(310): a, c, t, g, unknown or other
  misc_feature (310)..(310): n is a, c, g, or t
  modified_base (390)..(390): a, c, t, g, unknown or other
  misc_feature (390)..(390): n is a, c, g, or t
  modified_base (422)..(422): a, c, t, g, unknown or other
  misc_feature (422)..(422): n is a, c, g, or t
tcagagctcacgtacacgaccggtgctcgatttagactcatctacagggaaagggggctctgagagaggagcccagccctgggattttcaggtgttttcatttggtgatcaggactgaaccgagagaactcaccatggagtttgggctgagcgtgngtcttacgtgtcgacttttaaaggngtcagtgtgaggtgactaactgttggagtctgggggagacttagtacacccgtggggggtccctgagactctcctgtgcagcctctaggctctaccttagctaactctgtacagtgggctcgggtaccnccgagggccgtccggggggtaaggcgtggcgtgggtctacaggttattgatgagtagtggtagaagcatagttccgtagnggtctaccggtagaacggccgtacaccattcncgagagactacttacgaggagtacacggattagtacttacgaactaagtacgaaacgcgtacgtaggaacgacggaccggaacgaccgtaccggtacgttaacgttacgtttcggtagtaaccggtacgtaacgtaccgtaagtacgtacgtaccgtcccgtaccccgtacgcccgttaaccgttaccgtttcgtttaccggtaccgttaccggg

SEQ ID NO: 84720 - DNA, 612 bp, Homo sapiens
  misc_feature: GYAE6OF02GE7PF.47.46.E02.1.454.CMB.1.raw
  modified_base (450)..(450): a, c, t, g, unknown or other
  misc_feature (450)..(450): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggcttttttaaaaggtgtccagtgtgaggtgcaactgttggagtctgggggagacttagtacacccgtggggggtccctgagactctcctgtgcagcctctggactcacctttagcaactctgtcatgggctgggtccgcaggcgtccggggaagggctgggaggtggctcgaagtattgatggagaagtggtggaagcactattcgtacgtgactcggtaggaaggccggttacaccactctccagacgtactaatttcgaggacacgacgctagtatacctaanaaacttagaactacgcctaggacgtacggacgaacggaccgacgggtaccgttaagttactttcgtagtcgtaacgtaagtcgttaagtacggccgtacggtcccgacccccgttaggcccgtactacccgttttacgtttcgtaccgtttcggtaccgggg

SEQ ID NO: 84721 - DNA, 563 bp, Homo sapiens
  misc_feature: GYAE6OF02FQOLC.47.46.E02.1.454.CMB.1.raw
  modified_base (202)..(202): a, c, t, g, unknown or other
  misc_feature (202)..(202): n is a, c, g, or t
  modified_base (286)..(286): a, c, t, g, unknown or other
  misc_feature (286)..(286): n is a, c, g, or t
  modified_base (373)..(373): a, c, t, g, unknown or other
  misc_feature (373)..(373): n is a, c, g, or t
  modified_base (379)..(379): a, c, t, g, unknown or other
  misc_feature (379)..(379): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaangccacatctcctgtagggccggtcagagtattagcatcaacttagcctggtaccagcagagacctgggcaggctccaggctccncatctatgatgcgtccaccgagggccacgttcggttcccagccaggttcagtggcagtcgcgtcgtgggacagtattcactctcacntcaacncgcctgctagtctagaagtatttgcttagttttacttactcgtctagtactagttatactattaacgtcggtacctcttccgtacccgttccgggaccgtaacgggaccacggtaccgtagggtaacgtaaacgttaaaccggtaacgttggttacggactacgacctaccgtattccgttacg

SEQ ID NO: 84722 - DNA, 585 bp, Homo sapiens
  misc_feature: GYAE6OF02HYLQW.47.46.E02.1.454.CMB.1.raw
  modified_base (346)..(346): a, c, t, g, unknown or other
  misc_feature (346)..(346): n is a, c, g, or t
  modified_base (353)..(353): a, c, t, g, unknown or other
  misc_feature (353)..(353): n is a, c, g, or t
  modified_base (367)..(367): a, c, t, g, unknown or other
  misc_feature (367)..(367): n is a, c, g, or t
  modified_base (376)..(376): a, c, t, g, unknown or other
  misc_feature (376)..(376): n is a, c, g, or t
  modified_base (389)..(389): a, c, t, g, unknown or other
  misc_feature (389)..(389): n is a, c, g, or t
  modified_base (402)..(402): a, c, t, g, unknown or other
  misc_feature (402)..(402): n is a, c, g, or t
tcagagctcacgtacacgaccggtgctcgatttagactcatctacagggaaagggggctctgagagaggagcccagccctgggattttcaggtgttttcatttggtgatcaggactgaaccgagagaactcaccatggagtttgggctgagcgtggctctttcgttgtggcttttttaaaaggtgtccagtgtgaggtgcaactgttggagtcgtggggagacttagtacaccgtggggggtccctgagactctcctgtgcagcccctggactcacctttagccaactctgtcatgggctcgggtcccgccaggccgtccggggaaggggcgtgggaggtgggtcncgaagtnttgatgagaatggngaagcactntcagtgactccgngaacggcgtcacntctccagacgactaagttcaggagcacgctgtatactaaacaatacgaacagcctagagacgcgagacgacgccgtattacttcgtgtacgacgtaagttcgtaagtacgaccgtacggtacccgaccccccgtaggtcccgtacctacccgtttcctttacgtaccgtttacggtaccgggg

SEQ ID NO: 84723 - DNA, 510 bp, Homo sapiens
  misc_feature: GYAE6OF02I4NG8.47.46.E02.1.454.CMB.1.raw
  modified_base (289)..(289): a, c, t, g, unknown or other
  misc_feature (289)..(289): n is a, c, g, or t
  modified_base (386)..(386): a, c, t, g, unknown or other
  misc_feature (386)..(386): n is a, c, g, or t
  modified_base (438)..(438): a, c, t, g, unknown or other
  misc_feature (438)..(438): n is a, c, g, or t
  modified_base (449)..(449): a, c, t, g, unknown or other
  misc_feature (449)..(449): n is a, c, g, or t
  modified_base (486)..(486): a, c, t, g, unknown or other
  misc_feature (486)..(486): n is a, c, g, or t
  modified_base (507)..(507): a, c, t, g, unknown or other
  misc_feature (507)..(507): n is a, c, g, or t
tcagagctcacgtacacgaccggtgctcgatttagactcatctacagggaaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctccncatctatgatgcgtccaccagggccacgtcggttcccagccaggttcaggtgcagtgcgtcgtgggacaggacgtttcacttctcaccatacaaacncgcctgctagtcgtagaagtatttgctagtttattactgtctagctagtatnatactggaccnctcaccttcgcgaaggacacgactgagataacgatgngctcgcacatctcgtcttctntcc

SEQ ID NO: 84724 - DNA, 579 bp, Homo sapiens
  misc_feature: GYAE6OF02GWVHA.47.46.E02.1.454.CMB.1.raw
  modified_base (353)..(353): a, c, t, g, unknown or other
  misc_feature (353)..(353): n is a, c, g, or t
  modified_base (407)..(407): a, c, t, g, unknown or other
  misc_feature (407)..(407): n is a, c, g, or t
  modified_base (431)..(431): a, c, t, g, unknown or other
  misc_feature (431)..(431): n is a, c, g, or t
  modified_base (461)..(461): a, c, t, g, unknown or other
  misc_feature (461)..(461): n is a, c, g, or t
tcagagctcacgtacacgaccggtgctcgatttagactcatctacagggaaagggggctctgagagaggagcccagccctgggattttcaggtgttttcatttggtgatcaggactgaaccgagagaactcaccatggagtttgggctgagcgtggcgtctttacgttgtggtacttttttaaaaggtgtccagtgtgaggtgcaactgttggagtcgtgggggagacttagtacacccgtgggggtccctgagactctcctgtgcagcctctggactcacctttagcaactctgtcagtgggctcgggtccgccaggccgtccggggaagggccgtggagtggtctcaagtntgatgagatggtgaagcacattcacgtgactcgtgaacggccgttacacagtcnccgagacactaagttcgaggtacncacgtctagtatactaacaaagtcgaaacncgtacctagacgacgaccggagaccgacggtaccgttaattcttagtgtacgacgtaagtcgtaagtacgcgacgtccaccccgtacgccgtacctaccgtttcttagtacttccggg

SEQ ID NO: 84725 - DNA, 686 bp, Homo sapiens
  misc_feature: GYAE6OF02JXIJ1.47.46.E02.1.454.CMB.1.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccacctgtctgtctctccgaggggaanagccaccatctcctgtagggccgtnagagtattagcatcaacttgcctggtaccagcagagacctgggcaggcctccgaggcctcccgtcagtcctatcgagttcgccgtaccaccgacgggcctacgttcgggtttaccccagtccgtaaggttcaggtcggactaggtcgcgtcgtcgggactaggtacgttccacgttcctaccgacctacgtaccgaaaccgtacgtcccgttaggacccgtaaacggttccgttaagggtaaacgtttacgttttacggactttaaacgggtttttacttaaccgttcgtacgtagtaccgttaagttacttacgtaaacgttaaccggtcggtcccgtacttacccgtaccggttacggaacccgtaagggacctaacggtaccgtaacgggtaacgtaaacgttaaacccggaagttcggtacggtctaccgtaccgtaccgtacgttcccgttaacg

SEQ ID NO: 84726 - DNA, 571 bp, Homo sapiens
  misc_feature: GYAE6OF02JPYBI.47.46.E02.1.454.CMB.1.raw
  modified_base (227)..(227): a, c, t, g, unknown or other
  misc_feature (227)..(227): n is a, c, g, or t
  modified_base (362)..(362): a, c, t, g, unknown or other
  misc_feature (362)..(362): n is a, c, g, or t
  modified_base (436)..(436): a, c, t, g, unknown or other
  misc_feature (436)..(436): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccagggaagagccaccatctcctgtagggccggtcngacgtattagcagcaacttagcctggtaccagcagaaacctggacaggctcccaggctcctacatctagtggtgcatcccacgagggcccacgtcggtactcccagccaggttcagtggcaggtgggtctggacngtacgttcactctacaccatcagcacgccgtgcgagtcgtagaaagttcttttgacttaagtttacttaacgtnttacgagcagtacgtagctaacgtggccttactcgtacgtttaccggacgggtacgggaccgtagggtacgggagtacgtacgaacggtacggtaacgttacggacggtacgtacggaccgtacgtacttaccgg

SEQ ID NO: 84727 - DNA, 571 bp, Homo sapiens
  misc_feature: GYAE6OF02F90H2.47.46.E02.1.454.CMB.1.raw
tcagagctcacgtacacgaccggtgctcgatttagactcatctacagggaaagggggctctgagagaggagcccagccctgggattttcaggtgttttcatttggtgatcaggactgaaccgagagaactcaccatggagtttgggctgagctggctctttcttgtggctttttaaaaggtgtccagtgtgaggtgcaactgttggagtctgggggagacttagtacacccgtggggggtccctgagactctcctgtgcagcctctggactcacctttagcaactctgtcatgggctgggtccgccaggcgtccggggaaggggctggagtgggtctcaagtattgatgagaatggtggaagcacattctacgtggactccggtagaacggggtccggttcaccgtatcctccaagagactaatttcgaggagcacgctagtatctaacaaatgaacagcctagacgagccgaggaccacggccgtatactttcgtgtagacgaaagtccgtaagtacgcgtacgtccgaccccctacggccgtacctacctttctttcgacctttccggg

SEQ ID NO: 84728 - DNA, 648 bp, Homo sapiens
  misc_feature: GYAE6OF02FKC67.47.46.E02.1.454.CMB.1.raw
  modified_base (305)..(305): a, c, t, g, unknown or other
  misc_feature (305)..(305): n is a, c, g, or t
  modified_base (441)..(441): a, c, t, g, unknown or other
  misc_feature (441)..(441): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcgtggcgtctttcttgtggcttttttaaaaggtgtccagtgtgaggtgcaactgttggagtctgggggagacttagtacacccgtggggggtccctgagactctcctgtgcagcctctggactcacctttagcaactctgtcatgggctgggtccnccgaggcgtccgggggaaggggctgggagtgggtctcaagtatgatgagaatggtggaagcactattctagtggactccggtgaacggggtcccgttacacccgtatcctaccagagaactaatttccaagggacnccaacggcttacggtacttcgtaaacaaagttcgaaaccagtaccctagggaacgacggacccggtaaggaccggaccggtcccgttaattacgtttactgggttacgacggtaaacgtcgtaagttaacggcctaacgggtcccgtaccccccgtaaggcccgtaccctaaccgttttcctttcggtacctttcggtaccgggggg

SEQ ID NO: 84729 - DNA, 652 bp, Homo sapiens
  misc_feature: GYAE6OF02HOKD3.47.46.E02.1.454.CMB.1.raw
  modified_base (202)..(202): a, c, t, g, unknown or other
  misc_feature (202)..(202): n is a, c, g, or t
  modified_base (226)..(226): a, c, t, g, unknown or other
  misc_feature (226)..(226): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagcccacctgtctgtctctcgaggggaaancgccacatctcctgtagggccgtnagtagtattagcatccaattcgcctaggtaccagcagacgaccgtggggcggctccaggcctcctcactctatcgatcgccgtccacccgagggtcccaccgttcggtttaccccgacgtcccgtaggttcgagtcggcgtacgtggccggtcgttgggacaggtagtacctactccgacacctacgtaccaacaccggtcctcgtacgtactcgtaagaacgttagtttcgtacttacgtttaacttactgtacagtactatagtacctagtaaccgtcggcccttaccgtccgttacccgttacgggaacccgtaacgggtaccgaccggttacgtacgggtaaacgtaacggtttaaaaccggacgttaacggtcggtaaccggtcgtaaccctaaccggtctttacccggttgtttaacccg

SEQ ID NO: 84730 - DNA, 551 bp, Homo sapiens
  misc_feature: GYAE6OF02GEZZF.47.46.E02.1.454.CMB.1.raw
  modified_base (206)..(206): a, c, t, g, unknown or other
  misc_feature (206)..(206): n is a, c, g, or t
  modified_base (298)..(298): a, c, t, g, unknown or other
  misc_feature (298)..(298): n is a, c, g, or t
  modified_base (310)..(310): a, c, t, g, unknown or other
  misc_feature (310)..(310): n is a, c, g, or t
  modified_base (340)..(340): a, c, t, g, unknown or other
  misc_feature (340)..(340): n is a, c, g, or t
  modified_base (389)..(389): a, c, t, g, unknown or other
  misc_feature (389)..(389): n is a, c, g, or t
  modified_base (545)..(545): a, c, t, g, unknown or other
  misc_feature (545)..(545): n is a, c, g, or t
tcagagctcacgtacacgaccggtgctcgatttagactcatctacagggaaagggggagggaactgctcagttaggacccagacggaaccatggaagccccagcgcagcttctcttcctcctgctactctggctcccagataccactggagaaatagagatgacgcagtctccagccaccctgtctgtgtctccgaggggaaaagngcccaccctctcctgcagggccagtcagagtatgcagacaattagccttgaccagcaacgaaaccgtgggacaggctcccgaggtcctcctnatctatgggtcncactccacgagggccacgtgtactcccgancctaggttcaggtcgcaggttggactgggatagtgttcacgtctacacntcagcagcctgctagtctagatatttgactaattttactagtgtactagactagtaattaacgtacgtcgtaccgttacgtcctacggacgacggacctacgtagtagggaactaagttaacgtaactggtacgcgtcaccgtacgtacttccgtnttaccg

SEQ ID NO: 84731 - DNA, 653 bp, Homo sapiens
  misc_feature: GYAE6OF02HBDEL.47.46.E02.1.454.CMB.1.raw
  modified_base (182)..(182): a, c, t, g, unknown or other
  misc_feature (182)..(182): n is a, c, g, or t
  modified_base (220)..(220): a, c, t, g, unknown or other
  misc_feature (220)..(220): n is a, c, g, or t
  modified_base (310)..(310): a, c, t, g, unknown or other
  misc_feature (310)..(310): n is a, c, g, or t
tcagagctcacgtacacgaccggtgctcgatttagactcatctacagggaaagggggctcgtgagagaggagcccagccctgggattttcaggtgttttcatttggtgatcaggactgaaccgagagaactcaccatggagtttgggctgagctggctctttctgtggcttttttaaaaggngtccagtgtgaggtgcaactgttggagtcgtggggganacttagtacacccgtggggggtccctggagactctcctgtgcagcctctggactctactttagcaactctagtcagtgggctgggtcccnccgagggccgtaccgggggaagggtccgtgggaggttggggtcctacgaaagtagtttggataggaggtaatggggaggaacgtccgtaactagtttccgtaacggtggtaaccgttccggtagggaacgggtcccgtttacaacctattccgtaccagacgtaactaagtttcgaaggacgcacggtctagtacttacgtaaactaaagtgaaacctgacccgtggaacgtacgaccggtagaaccgacgggtaccttagttacttcgtgtacgacgtaaagtctaagtaagcgaacgtccgaccccgtagccggtactaccgttctttcggacctttcggg

SEQ ID NO: 84732 - DNA, 692 bp, Homo sapiens
  misc_feature: GYAE6OF02HUVFP.47.46.E02.1.454.CMB.1.raw
  modified_base (371)..(371): a, c, t, g, unknown or other
  misc_feature (371)..(371): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggtcttttttaaaaggtgtccagtgtgaggtgcaactgttggagtctgggggagacttagtacacccgtggggggtccctgagactctcctgtgcagcctctggactcacctttagcaactctgtcagtgggctcgggtccgcaggccgtaccggggaaggggctgggagtcgggtctacgaagtattgatgagagtggtaggaacnctactattcacggtcggacttccggtaggtaacggggtcccgtttaccaacctacgtccctaccgacgaacgtacctaaattttacgaggtacgcgaaccgtcgttgtatacctaaccaaagtacgaaacgtagtcgtacggacggaacgaccggtaaggaccgtaaccgggtaccgttaacgttttaacgtttcgttaggttacgtaaccgtaagtttaccgtaagttaacgtaccgtaacggtacccgtaccccccgtaccggtcccgtacccgttaaccgttttaccgttttacgttacccggtttaggtacccgggg

SEQ ID NO: 84733 - DNA, 569 bp, Homo sapiens
  misc_feature: GYAE6OF02G6SD9.47.46.E02.1.454.CMB.1.raw
  modified_base (202)..(202): a, c, t, g, unknown or other
  misc_feature (202)..(202): n is a, c, g, or t
  modified_base (262)..(262): a, c, t, g, unknown or other
  misc_feature (262)..(262): n is a, c, g, or t
  modified_base (427)..(427): a, c, t, g, unknown or other
  misc_feature (427)..(427): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagcccacctgtctttgctccgaggggaaangccaccctctcctgcagggccagtcagagtgttggcagctacttagcctggtaccaacanaacctggccaggctcccgaggcctcctctatttagtggtacatacaacgagggccagtggcatcccagacagtatcaggcgacagtggatcgtagggactagacttcactctcactatacagcagacgtggacgtctagtaagtatttgactagtatacctactntacagactagtagttaggttacgggactacgtaagtccgggtacggttccggaccggtaagggaccgtaggggtacggtaaacgtcggaacggacggtaacgtggtacggctacggtaccgaacctacgtcgttcgttaccg

SEQ ID NO: 84734 - DNA, 578 bp, Homo sapiens
  misc_feature: GYAE6OF02FGMI0.47.46.E02.1.454.CMB.1.raw
  modified_base (201)..(201): a, c, t, g, unknown or other
  misc_feature (201)..(201): n is a, c, g, or t
  modified_base (331)..(331): a, c, t, g, unknown or other
  misc_feature (331)..(331): n is a, c, g, or t
  modified_base (411)..(411): a, c, t, g, unknown or other
  misc_feature (411)..(411): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaangccaccatctcctgtagggccgtcagagtattgcatcaacttgcctggtaccagcagacgacctgggcaggcctcccaggcctcctcatctatgatgccgtccaccgagggcccacgttcggttaccccngcctaggttcaggtggctaggtcgcgtcgtggggacaggtcgttcactctcaccatacaacagcctgctgtctaggaatntttgcttagtttacttacgtgtacagtctaagttatacctaagtaaccgtcggtacccgtcctaccgtacccgttccggacccgtaacgggaccaccggtacgtacgggaacgttaaacgttaaaccgacgttaggtacggctacggacctaccgtattccgttacg

SEQ ID NO: 84735 - DNA, 696 bp, Homo sapiens
  misc_feature: GYAE6OF02H46W3.47.46.E02.1.454.CMB.1.raw
  modified_base (217)..(217): a, c, t, g, unknown or other
  misc_feature (217)..(217): n is a, c, g, or t
  modified_base (344)..(344): a, c, t, g, unknown or other
  misc_feature (344)..(344): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggcttttttaaaaggtgtccagtgtgaggtgcaactgttggagtctggggganacttagtacaccctggggggtccctgagactctcctgtgcagcctctggactcacctttagcaactctgtcatgggctgggtccgccaggccgtccgggggaagggctggaggtgggtctcgaagtnttgatgagaatgggtaggaagcacgtattcgtacggttcggaccttcccggtaggaaacgggggtcccggtttaccaacccagtttacccttacccgaaggtaacgtaacgtaaattttccgaaagggtagccgaacggccttggttaaactccgttaacgtaaaattcggaaacctaacgcccgttaggaacggaacggacccggtaaagggacccgaaccgggtaccgttaattacgtttcgtagttcgacggtaaacgttcttaagtaacggtccaacgggttccgccccccgttaaggcccgtaccgttaaccttttccggttttagacccgtttcggtacccggggg

SEQ ID NO: 84736 - DNA, 584 bp, Homo sapiens
  misc_feature: GYAE6OF02H1395.47.46.E02.1.454.CMB.1.raw
  modified_base (513)..(513): a, c, t, g, unknown or other
  misc_feature (513)..(513): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggcttttttaaaaggtgtccagtgtgaggtgcaactgttggagtctgggggagacttagtacacccgtggggggtccctgagactctcctgtgcagcctctggactcacctttagcaactctgtcatgggctgggtccgccgaggctccgggggaaggggcgtgggaggtgggtctcgacgtatccaatcctgagtggcagttgttattaaattagtgacggactccggtggagggggccattcgagcatctccagacgacaacggcaaagagtaatacttagtatcgtagaaatgaaacaatctagagagtcgaacgagtacggcttgtactatctatttgtttacgngttcgtcccgttcgggtcccgcgggtactttccggtcggggacccacggggtaaccctcgggtactaccgg

SEQ ID NO: 84737 - DNA, 681 bp, Homo sapiens
  misc_feature: GYAE6OF02H1BOS.47.46.E02.1.454.CMB.1.raw
  modified_base (471)..(471): a, c, t, g, unknown or other
  misc_feature (471)..(471): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcgtggcgtcttacgtgtggtactttttaaaaggtgtccagtgtgaggtgcaactgttggagtcgtgggggagacttagtacacccgtggggggtccctgagactctcctgtgcagcctctggactctacctttagctaactcctgtcagtgggctgggtccgccgaggcgtacgggggaagggcgtggaggtgggtctcgaaagttattgatgaagtaagtggtaggaagccaatagttctaggttcggactccggtaggaacggggcccggtttacacccgtaatcctaccgaagtacgaactaagtttacgaagggtacncgaacgtcttaggtaacttacgttaaactaaaacgtgaaaaccgtagtacctaggaacggacggacccggaaggtaccgaaccggggtaccttaacgtttacgtttcgtaggtcggaacgtaaagttcctaagtacggtactaacggtcccgtaacccccgtacgtccggtaccttacgtttcttttacggtaccttcggtaaccggggg

SEQ ID NO: 84738 - DNA, 597 bp, Homo sapiens
  misc_feature: GYAE6OF02GJMYA.47.46.E02.1.454.CMB.1.raw
  modified_base (343)..(343): a, c, t, g, unknown or other
  misc_feature (343)..(343): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggcttttttaaaaggtgtccagtgtgaggtgcaactgttggagtctgggggagacttagtacaccctggggggtccctgagactctcctgtgcagcctctggactcacctttagcaactctgtcatgggctgggtccgccaggcgtccgggggaagggcgtggaggtgggtctcaagtntgatgagaatggtgaagcacattcgtacgtggactcggtagaagggtccggttcaccatctcgagagactaatttcgaggacgcacgctagtactactaacaaatacgaacagtctaggagacggaccggaaggaccgaaccgggtaccgttaagttactttcgtggttacgacgtaagttctaagtacgtacgacggtccgtaccccccgtagccgaccttaccgtttcgtttcgtaccgttcggtaccgggg

SEQ ID NO: 84739 - DNA, 682 bp, Homo sapiens
  misc_feature: GYAE6OF02HVQH5.47.46.E02.1.454.CMB.1.raw
  modified_base (351)..(351): a, c, t, g, unknown or other
  misc_feature (351)..(351): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtgtctttttaaaaggtgtccagtgtgaggtgcaactgttggagtcgtgggggagacttagtacacccgtggggggtccctggagactctcctgtcgcacgcctctggactctacctttagcaactctgtcagtggatcgggtccgccaggcgtccggggaaggggcgtgggaggtgggtctcgaagtnttgatgaagaagtgggtacggaagcactaattacgtacggttcggaacttccggtaggtaacgggcccgtttcaaccctatccctaccgtagacgtaactaactttacgaggacgtacacgtacttaggtaacttaccttaaacgtaaaacgtacgaaacctacgacccttaggaacgtaacgggacccggtaacgggacccgtaaccggtaccgttaattacgttttcgtaggttacgacgttaaacgtacgttagtaagtccgtaacgtccggtaccccctacggtccgacgttaccctttcgttttacgtaccgtttcggtaccgggg

SEQ ID NO: 84740 - DNA, 574 bp, Homo sapiens
  misc_feature: GYAE6OF02HKEQI.47.46.E02.1.454.CMB.1.raw
  modified_base (204)..(204): a, c, t, g, unknown or other
  misc_feature (204)..(204): n is a, c, g, or t
  modified_base (228)..(228): a, c, t, g, unknown or other
  misc_feature (228)..(228): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagcccaccctgtctgtctctccgaggggaaanagccacatctcctgtagggccgtnagagtattagcatcaacttgcctaggtaccaacagaaacctggtcaggctccaggctcctcatctatgatgcatccaacgacgggccacgtggcactccccaagacaggttcaggtggcaggtgggtctagggacagacttcactctcacctatcagcagcctaggacgtcctagaagtattttgacttagtttattactgtacagtactaaacgttaattacgtacggtcctccgtcttaccgtacggtttcggacgggtacgggtacccgaggggtacggacgtagtacggaaacgtaacgttggtacggtcgtacgaccgtacctacgttccgtacgttaccg

SEQ ID NO: 84741 - DNA, 556 bp, Homo sapiens
  misc_feature: GYAE6OF02HEQMX.47.46.E02.1.454.CMB.1.raw
  modified_base (203)..(203): a, c, t, g, unknown or other
  misc_feature (203)..(203): n is a, c, g, or t
  modified_base (229)..(229): a, c, t, g, unknown or other
  misc_feature (229)..(229): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccacctgtctgtcctctccgaggggaaanagccaccatctcctggtagggccgtnagagtatagcatcaacttagcctggtaccagcagagacctgggcaggctccgaggctcctcatctatgatgcgtccaccgaggccacgtcggtttccccagccctagggttcaggtcggctaggtcgccgtacgtggggaacaggtagtttccacgttctcaaccacgtaccaacacgcctcgcagtcgtagaagtattttgacttagttttattacgtgtcagtcagttatactaagtacgtggacctctccgtacctcggaaccgaagggaccaacgcgtaggacgtaacttaaacgacgtgtacgcgtcgaccactacgtctcg

SEQ ID NO: 84742 - DNA, 694 bp, Homo sapiens
  misc_feature: GYAE6OF02HMNY9.47.46.E02.1.454.CMB.1.raw
  modified_base (345)..(345): a, c, t, g, unknown or other
  misc_feature (345)..(345): n is a, c, g, or t
tcagagctcacgtacacgaccggtgctcgatttagactcatctacagggaaagggggctctgagagaggagcccagccctgggattttcaggtgttttcatttggtgatcaggactgaaccgagagaactcaccatggagtttgggctgagctggctctttcttgtggctttttaaaaggtgtccagtgtgaggtgcaactgttggagtctggggagacttagtacaccctggggggtccctgagactctcctgtgcagcctctggactcacctttagcaactctgtcatgggctgggtcccgccgaggcgtccgggggaagggctgggagtgggtctcgaagtnttgatgagaatggtgaagcacattcgtacgtggactccggtaggaacggggtccggttacaccgtactccaccaaggaagaacctaatttccgaagggacgaccgaccgtcgtagttaacttacctaaacaaagttacgaaacagtacccgtagaaacggacggtacccggaaacgggaccgtaaccgggtaccgtttaaagttaccgttttacgtcgttacggtaccgttaaaacggttcgttaaaggttaacggtaccgtaaccgggttacccggtaccccccccttaagggtccccgtacgtttaaccccgttttaccggttttaccggtacccgttttcccgggg

SEQ ID NO: 84743 - DNA, 623 bp, Homo sapiens
  misc_feature: GYAE6OF02H0EOC.47.46.E02.1.454.CMB.1.raw
  modified_base (153)..(153): a, c, t, g, unknown or other
  misc_feature (153)..(153): n is a, c, g, or t
  modified_base (178)..(178): a, c, t, g, unknown or other
  misc_feature (178)..(178): n is a, c, g, or t
  modified_base (373)..(373): a, c, t, g, unknown or other
  misc_feature (373)..(373): n is a, c, g, or t
  modified_base (468)..(468): a, c, t, g, unknown or other
  misc_feature (468)..(468): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcggngtgcttagtcgtcgattttaaaggngtcagtgtgagtgcaacgtgttggagtcgtgggggatacttagacgcccgtgggggtccctgagctcgtcctgtgacagcctctggactactacctttagctacgtctgactgtggctggtccacgagcgtaccgggaggcgtggcgtggactcagtatgatgagagtggagagcacgtatcctagtcgactcgngaacggtcgtcacgtatccgacgtacgacgtactaagttcgagacgtacgaacggtctaaggtactactaaccgtaaagtcgaaacacccgttanacggaacggtaccgtaccgggaacgaccgttttacgacccgttattttaacgtcggtttacgacgggtaacctacgttagtacgtagtaccgtaacgccggtaccccgtacgcgttaacctccgtttacgtacgttacccgttggtaaccccggg

SEQ ID NO: 84744 - DNA, 739 bp, Homo sapiens
  misc_feature: GYAE6OF02IR8NC.47.46.E02.1.454.CMB.1.raw
  modified_base (218)..(218): a, c, t, g, unknown or other
  misc_feature (218)..(218): n is a, c, g, or t
  modified_base (266)..(266): a, c, t, g, unknown or other
  misc_feature (266)..(266): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctcttcttgtggtctttttaaaaggtgtccagtgtgaggtgcaacgtgttggagtcgtggggganacgttagtacacccgtgggggtccctgagactctcctgtgcagcctcnggactcacctttagcaactctgtcatgggtagtgggtccgccgaggccggtaccgggggaagggtccgtagggtacggtgggtcctacgaaggttatggacgttggaagtaagtgggtaggaacgtacgacgtagtttacgtacggtcggtaaccgtccggtagggaaaccggggtcccggtttacgaacccgttacgttacccgtacccgaaggtaaccgtaacgttaaacgttttaaccggaacgggtaacgtacccgaaacgtccgttaaggtaacttaccgtaaacgaaaagttacgaaaccgacgtacctaggaacggacgaccggacggtaaccgacggtaccgtattaacgtttcgacgtacgaccgtaacgttcgtaacgtaacggacgtaacggttcccgtacccccgtaaggacccgtacgttaacccgttttcgttacggtacccgtttcggtaaccggggg

SEQ ID NO: 84745 - DNA, 559 bp, Homo sapiens
  misc_feature: GYAE6OF02FV3N9.47.46.E02.1.454.CMB.1.raw
  modified_base (203)..(203): a, c, t, g, unknown or other
  misc_feature (203)..(203): n is a, c, g, or t
  modified_base (228)..(228): a, c, t, g, unknown or other
  misc_feature (228)..(228): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccgaggggaaangccacatctcctggtacgggccgtnagagtatagcatcaacttagcctggtaccagcagacgaccgtgggcaggcctcccgaggcctcctcatctatgatgccgtccacgacgggccacgttcggttcccagtcctaggttcaggtggctagtcgcgtcgagggacagtcttcgactctacacctatcgagcacgtctagacgctagaacgtacgtttaggtactttatactcgtcagcagtcgtgtagttcgtacggtcctccgtctccgtacgttcgggacggtacgggacgagggtacggaacgtacgtaacgaacgtacgtggtacggtctacgacctaccgtatcgttacg

SEQ ID NO: 84746 - DNA, 170 bp, Homo sapiens
  misc_feature: GYAE6OF02HFWEJ.47.46.E02.1.454.CMB.1.raw
  modified_base (169)..(170): a, c, t, g, unknown or other
  misc_feature (169)..(170): n is a, c, g, or t
tcagagctcacgtacacgaccggtgctcgatttagactcatctacagggaaagggtctgagagaggagcccagccctgggattttcaggtgttttcatttggtgatcaggactgaaccgagagaactcaccatggagtttgggctgagcgggctggcaaggcgcatagnn

SEQ ID NO: 84747 - DNA, 734 bp, Homo sapiens
  misc_feature: GYAE6OF02HDVKY.47.46.E02.1.454.CMB.1.raw
  modified_base (178)..(178): a, c, t, g, unknown or other
  misc_feature (178)..(178): n is a, c, g, or t
  modified_base (208)..(208): a, c, t, g, unknown or other
  misc_feature (208)..(208): n is a, c, g, or t
  modified_base (254)..(254): a, c, t, g, unknown or other
  misc_feature (254)..(254): n is a, c, g, or t
  modified_base (287)..(287): a, c, t, g, unknown or other
  misc_feature (287)..(287): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcggtgtggtctagtgtcgattttaaaggngtcagtgtgagtgcatgtggagtctggganacttagtcacccgtgggggtccctggagactctccgtgtgcagccngtaggactcaacctttagccaactcgttgtacngtggtcggtcggtccggccgacggcgggtaccggggacgggtcggtggtacggtcggtcgtagtaagttagttagtagtagtaggtaagtaggtaggaacgacgtactacgttacgtacggtacggtaccgtacggtacggtacgggtaccgtaccgtaccgtacgtaccgtaccgtacgtaacgtaacgttaacgttaacgtacggacgacgtacgtacgtacgtaacttaacgttaaacgtaaacgtaacgtaacgtacgtacgtacggtacgacggtaccggaacggaacgtaaccggtaaccgttacgttacgtttacgttacggtacggtacgtaacgttaacgtaacgtaacggtaaccgtaaccggtacccgtaccccgtacccggtacccgttaccgttaccgtttaccgtttaccggttaccggttaccggtaccggg

SEQ ID NO: 84748 - DNA, 686 bp, Homo sapiens
  misc_feature: GYAE6OF02GXKN6.47.46.E02.1.454.CMB.1.raw
  modified_base (201)..(201): a, c, t, g, unknown or other
  misc_feature (201)..(201): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagcccacctgtctgtctctccaggggaangccaccatctcctggtacgggccggtcagagtattagcatcaacttgcctggtaccagcagacgaccgtggggcaggcctcccgaggcctcctcatctatgatcgccgtaccaccgacgggccctacgttcggttccccagtccgtaggttcaggttcgggccgtaggtcggtccggttcggtacggggaacacgggtacgtttccaccgtttcctaccaaccctataccaacgaccgtccctgacgtacgttcgtaggtaacgttacttttcggacgtttaagtttttaacttacgttcggttacgtacgtacgtagttaacttacctaacgttaaccgtcgggtacccgttccttacccgtacccgttaccgggacccgaaacgggtaccgtaaccggtacggtaacgggtaaacgttaaacgttaaaccggtacgttagggtacggtacgtaccggtacctaaccggttacttaccgttacg

SEQ ID NO: 84749 - DNA, 673 bp, Homo sapiens
  misc_feature: GYAE6OF02JWALA.47.46.E02.1.454.CMB.1.raw
  modified_base (201)..(201): a, c, t, g, unknown or other
  misc_feature (201)..(201): n is a, c, g, or t
  modified_base (224)..(224): a, c, t, g, unknown or other
  misc_feature (224)..(224): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctcgagggaagngccacatctcctggtaggccgtnagagtatagcatcaacttagcctgtacagcagagacgtgggcaggctcccgaggtctccgtcacgtctatgatggccgtaccaccgacgggccctacgttcggtttcccagtccgtaggttctacggtggcgtaggtacgtcggtccgtacggggcgtaggtacgttcgaccgttctacctaccgtaactacctaaaccgacgtcccgttcgtacgtaccgtttacgtaacggtaacgttaagtttttactaccggttaacgttttaactttacgttcgttacgtacgtacttacggttacttaccgtaacgttaaaccgtcgggtaccctaccgttccctacccgttaccggtaccgtaacggtacgtaccgtaaccgtagggtaacgtaacgttaaaccggtacgtacgttacggtccgtacgacccgtaccggtacttaccgttcg

SEQ ID NO: 84750 - DNA, 418 bp, Homo sapiens
  misc_feature: GYAE6OF02IOY38.47.46.E02.1.454.CMB.1.raw
  modified_base (402)..(402): a, c, t, g, unknown or other
  misc_feature (402)..(402): n is a, c, g, or t
  modified_base (408)..(418): a, c, t, g, unknown or other
  misc_feature (408)..(418): n is a, c, g, or t
tcagagctcacgtacacgaccggtgctcgatttagactcatctacaggggaaagggccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagacttcactctcaccatcagcagcctagagcctgaagactttggactttattactgtcagcagcgtgagttctggcctccgctcactttcggcggagggccagggtggagatcaaacgactgtggctgcaccatctgtcttcattccttcccgcctatctgactacgtgagctctgagcgggtctggcaaggcncatagnnnnnnnnnnn

SEQ ID NO: 84751 - DNA, 465 bp, Homo sapiens
  misc_feature: GYAE6OF02HQNDX.47.46.E02.1.454.CMB.1.raw
  modified_base (454)..(465): a, c, t, g, unknown or other
  misc_feature (454)..(465): n is a, c, g, or t
tcagagctcacgtacacgaccggtgctcgatttagactcatctacagggaagggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtcgccccctagcgcactttcttgacttctggggccagggatcctggtcaccgtctccacagcctccaccaagggcccatcggtccttcccccgtggccgccctgcctccaggacgccacctccgagacgcacgaggccggccctggggctggccctgggtcaaagggtaccttaccttcccgtacgtggacgtctcgtgacggcgggcgtggcgaaggcgcgatagnnnnnnnnnnnn

SEQ ID NO: 84752 - DNA, 540 bp, Homo sapiens
  misc_feature: GYAE6OF02GM0P0.47.46.E02.1.454.CMB.1.raw
  modified_base (203)..(203): a, c, t, g, unknown or other
  misc_feature (203)..(203): n is a, c, g, or t
  modified_base (228)..(228): a, c, t, g, unknown or other
  misc_feature (228)..(228): n is a, c, g, or t
  modified_base (310)..(310): a, c, t, g, unknown or other
  misc_feature (310)..(310): n is a, c, g, or t
  modified_base (342)..(342): a, c, t, g, unknown or other
  misc_feature (342)..(342): n is a, c, g, or t
  modified_base (358)..(358): a, c, t, g, unknown or other
  misc_feature (358)..(358): n is a, c, g, or t
  modified_base (379)..(379): a, c, t, g, unknown or other
  misc_feature (379)..(379): n is a, c, g, or t
  modified_base (397)..(397): a, c, t, g, unknown or other
  misc_feature (397)..(397): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagcccaccctgtctgtctctccaggggaaanagccaccatctcctgtagggccgtnagagtattagcatcaattgcctggtaccagcagagacctgggcaggctcccaggcctcctcactctatgatgcgtccaccgngggccactcggttccagccaggttcagtggcngtgcgtcgtggacagngttcactctcacactacaacngcctgcagtctagaactntttgacttagtttattactgtcagtctagtatactagtaacgtcggcctactcctaccgttcggaccgtaagggacacggtacgtacggaacgtaacttaaaacggacgttaggtacggtcttacgaccacctagtccttacg

SEQ ID NO: 84753 - DNA, 609 bp, Homo sapiens
  misc_feature: GYAE6OF02GAG9K.47.46.E02.1.454.CMB.1.raw
  modified_base (151)..(151): a, c, t, g, unknown or other
  misc_feature (151)..(151): n is a, c, g, or t
  modified_base (202)..(202): a, c, t, g, unknown or other
  misc_feature (202)..(202): n is a, c, g, or t
  modified_base (226)..(226): a, c, t, g, unknown or other
  misc_feature (226)..(226): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagacccactgganaaatagtgatgacgcagtctccagcctacctgtctgtctctcgagggaaangccacatctcctggtagggccgtnagagtatagcatcaacttgcctggtaccagcagagacctgggcaggcctccaggctcctcagtctagtgagtgccgtccacgacgggaccacgttcggtttcccagtccaggttccaggtggcaggtcgacgtcgtagggacaggtacgttcacttctacaccgataccaacacgccgtcgactagtctaggaagtattttcggacgttaagttttacttaacgttcgttaccagtacgtaacgttactacgtaactttaaccgtcggacccgtacctaccgtacccgttaccggacccgtaagggaccaccggtacgtacgggaacggtaacgttaaaccgacgttaggtacggacgtacggacctaccgtattccgttacg

SEQ ID NO: 84754 - DNA, 660 bp, Homo sapiens
  misc_feature: GYAE6OF02GXX7F.47.46.E02.1.454.CMB.1.raw
  modified_base (204)..(204): a, c, t, g, unknown or other
  misc_feature (204)..(204): n is a, c, g, or t
  modified_base (229)..(229): a, c, t, g, unknown or other
  misc_feature (229)..(229): n is a, c, g, or t
  modified_base (281)..(281): a, c, t, g, unknown or other
  misc_feature (281)..(281): n is a, c, g, or t
  modified_base (299)..(299): a, c, t, g, unknown or other
  misc_feature (299)..(299): n is a, c, g, or t
  modified_base (339)..(339): a, c, t, g, unknown or other
  misc_feature (339)..(339): n is a, c, g, or t
tcagagctcacgtacacgaccggtgctcgatttagactcatctacaggggaaagggggaggaactgctcagttaggacccagacggaaccatggaagccccagcgcagcttctcttcctcctgctactctggctcccagagaccactggagaaatagtgatgacgcagtctccagccaccctgtctgtctctccgaggggaaangccaccatctcctggtagggccgtnagagtattagcatcaacttgcctggtaccagcagagacctgggcaggctccngcgtctcatctactgagngtcgtcctaccaacgggccgtacctaggtttcccgtaccncgtacggttacggtacgtagggtcgacgtacggtcgtccggttcgggaacggtactaagggttaccgttacctacgttcctaaacccaactaccgtaaccaaacgaccgtaccgtacgtacgtacgttacgtaaggtaacgttttgttacgtaacgttttaagttttacttacgttacgtacgtacgtaccttaaggtacctataacgtacgtcggtccgtctaccgtaccgtaccggttacgaacgggtacgacgtacggtaggaacgtaacgttaaacgtaacgttacggtcggtacgtacggactaccgtacttaccg

SEQ ID NO: 84755 - DNA, 695 bp, Homo sapiens
  misc_feature: GYAE6OF02JGUZ3.47.46.E02.1.454.CMB.1.raw
  modified_base (303)..(303): a, c, t, g, unknown or other
  misc_feature (303)..(303): n is a, c, g, or t
  modified_base (342)..(342): a, c, t, g, unknown or other
  misc_feature (342)..(342): n is a, c, g, or t
tcagagctcacgtacacgaccggtgctcgatttagactcatctacagggaaagggggctctgagagaggagcccagccctgggattttcaggtgttttcatttggtgatcaggactgaaccgagagaactcaccatggagtttgggctgagctggctctttctgtggctttttaaaggtgtccagtgtgaggtgcaactgttggagtcgtgggggagacttagtacacccgtggggggtccctgagactctcctgtgcagcctctggactcacctttagcaactctgtcatgggctgggtccncaggccgtccggggaagggctggagtgggtctcgaagtnttgatgagagtggtaggagcacattcaacggtggactcgtaggaacggtcccgggttacacccgtagtccgtaccgaggtaacgtaaccgtaacgtttaccgaaggtacgtaccaccggtactagtaacttactaaacaaaacgttgaaaccgtaacgtcccgttaaggacggaacgtacccgggaaagggtaccgaaccggggtcccgttaaagttacgttttcgtacggttacggaccgtaaaggttccgttaaagtaccggtaccggttaacggttcccggtaacccccccggttaacggtcccggacccgtttaccgtttaccgttttacggacccgttttacccgggg

SEQ ID NO: 84756 - DNA, 684 bp, Homo sapiens
  misc_feature: GYAE6OF02JBE1S.47.46.E02.1.454.CMB.1.raw
  modified_base (204)..(204): a, c, t, g, unknown or other
  misc_feature (204)..(204): n is a, c, g, or t
  modified_base (227)..(227): a, c, t, g, unknown or other
  misc_feature (227)..(227): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagcccaccctgtctgtctctccgaggggaaangccacatctcctgtagggccgtnagagtattagcatcaacttgcctggtaccagcagagaccgtgggcaggctcccgaggcctccgtcatctatgatcgcgtccaccgagggccctacgttcggtttaccccaggtccctaggttcaggttcggcgtaggtcgcggttcgtgggaactaggtacgttcacgtcctactaccattaccaacgacgtacctgacctagttcctaggaacgttagtttttacgaccgtttaagttttacttaccgttgttaaccgtagtactaacgttaactaccgttaacgttaaccgtcgggtaccccgtaccgtttaccgtacccggtttccgggaacccgtaacggggtacctaaccggtaaccggttaaggggtaaccgttaaaacgttaaaaccggtaaccgtttagggtaccggtaccgttaccgacccgttaaccgtactttacccgtttacccg

SEQ ID NO: 84757 - DNA, 608 bp, Homo sapiens
  misc_feature: GYAE6OF02I7SST.47.46.E02.1.454.CMB.1.raw
  modified_base (200)..(200): a, c, t, g, unknown or other
  misc_feature (200)..(200): n is a, c, g, or t
  modified_base (398)..(398): a, c, t, g, unknown or other
  misc_feature (398)..(398): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccacctgtctgtctctcgagggaaangccaccatcctcctgtacgggccgtcagagtattagcatcaacttagcctaggtaccagcaagacgacctgggacaggcctcccgaggtctccgtcatctatgatcgccgtccacgacggccacgttcggttcccagtccgtaggttccaggtcggcagtcgcgtcgtagggacagtagttcactctcacatacaacncgcctgctagtctaggtaattagttttcgacttaagttttacttacgttgtactaggtacctaagttactacctaacgttaaccgtcggtacccgtcttaaccgtacccggttacggacccgaaagggtaccaaccggtacggtaagggtaaactaacgttaaaaccgacgttacggacgtactacgtacccaacgtacgttacgttacg

SEQ ID NO: 84758 - DNA, 634 bp, Homo sapiens
  misc_feature: GYAE6OF02GOZAN.47.46.E02.1.454.CMB.1.raw
  modified_base (260)..(260): a, c, t, g, unknown or other
  misc_feature (260)..(260): n is a, c, g, or t
  modified_base (307)..(307): a, c, t, g, unknown or other
  misc_feature (307)..(307): n is a, c, g, or t
  modified_base (346)..(346): a, c, t, g, unknown or other
  misc_feature (346)..(346): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggtcttttttaaaaggtgtccagtgtgaggtgcaactgttggagtcgtgggggagacgttagtacacccgtggggggtccctgagactctcctgtncagcctctggactcacctttagcaactctgtcatgggctgggtcccncaggcgtccggggaagggctgggaggtggtctcgaagtntgatgagtaagtggtggaagcactattctacggtgactcggtaggaacgggtccgttacaccgtatcctaccgagaacgtaactaagtttacgagggtacacgacgtcgtacggtaattaccttaaacaaagttacgaaaccgtagtcgtaggaacgtacggacccggaagggaaccgaccgggtaccgttaattacgttcgtgtacgacgtaagtctagtaacgacgtacggtccgtacccccgtacgccgtaccgtaccttttcgttcgtaccttcggtaccgggg

SEQ ID NO: 84759 - DNA, 640 bp, Homo sapiens
  misc_feature: GYAE6OF02H7GT7.47.46.E02.1.454.CMB.1.raw
  modified_base (153)..(153): a, c, t, g, unknown or other
  misc_feature (153)..(153): n is a, c, g, or t
  modified_base (165)..(165): a, c, t, g, unknown or other
  misc_feature (165)..(165): n is a, c, g, or t
  modified_base (174)..(174): a, c, t, g, unknown or other
  misc_feature (174)..(174): n is a, c, g, or t
  modified_base (179)..(179): a, c, t, g, unknown or other
  misc_feature (179)..(179): n is a, c, g, or t
  modified_base (185)..(185): a, c, t, g, unknown or other
  misc_feature (185)..(185): n is a, c, g, or t
  modified_base (188)..(188): a, c, t, g, unknown or other
  misc_feature (188)..(188): n is a, c, g, or t
  modified_base (193)..(193): a, c, t, g, unknown or other
  misc_feature (193)..(193): n is a, c, g, or t
  modified_base (197)..(197): a, c, t, g, unknown or other
  misc_feature (197)..(197): n is a, c, g, or t
  modified_base (200)..(200): a, c, t, g, unknown or other
  misc_feature (200)..(200): n is a, c, g, or t
  modified_base (202)..(202): a, c, t, g, unknown or other
  misc_feature (202)..(202): n is a, c, g, or t
  modified_base (206)..(206): a, c, t, g, unknown or other
  misc_feature (206)..(206): n is a, c, g, or t
  modified_base (213)..(213): a, c, t, g, unknown or other
  misc_feature (213)..(213): n is a, c, g, or t
  modified_base (215)..(215): a, c, t, g, unknown or other
  misc_feature (215)..(215): n is a, c, g, or t
  modified_base (217)..(217): a, c, t, g, unknown or other
  misc_feature (217)..(217): n is a, c, g, or t
  modified_base (221)..(221): a, c, t, g, unknown or other
  misc_feature (221)..(221): n is a, c, g, or t
  modified_base (223)..(223): a, c, t, g, unknown or other
  misc_feature (223)..(223): n is a, c, g, or t
  modified_base (225)..(225): a, c, t, g, unknown or other
  misc_feature (225)..(225): n is a, c, g, or t
  modified_base (242)..(242): a, c, t, g, unknown or other
  misc_feature (242)..(242): n is a, c, g, or t
  modified_base (244)..(244): a, c, t, g, unknown or other
  misc_feature (244)..(244): n is a, c, g, or t
  modified_base (247)..(247): a, c, t, g, unknown or other
  misc_feature (247)..(247): n is a, c, g, or t
  modified_base (249)..(249): a, c, t, g, unknown or other
  misc_feature (249)..(249): n is a, c, g, or t
  modified_base (280)..(280): a, c, t, g, unknown or other
  misc_feature (280)..(280): n is a, c, g, or t
  modified_base (285)..(285): a, c, t, g, unknown or other
  misc_feature (285)..(285): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcggngtgctagtgcgntttaaaggntcagntgagtnacntgtgngtgnggntntgcncgtggcngncnctcngngncgctcgcgctctactancnctntntctgtgtgtcgtcgcgcgcggtacggacggngtggnggtgtcgtacgtagtagtagtagtagagtaggtaggtaggacgacgtacgtacgttacgtacgtacggtacgtacgtacggtacggtaccggtaccgtactacgtacgtacgtacgtaacgtaacgttaacgttaacgtacggtacgtacgtacgtacgtcgttactaacttaacgtaagtaacgtaacgtacgtacggtacgaacggacggtacggtacggtaaccgtaaccggtacgttaacgttacggttagtacgtacgtaacgtacgttacgtacggtacgtacgtcgtaaccgtacccgtaccgtaccgtaccgttaccgtttaccgtttacgttaccgtacggtacgg

SEQ ID NO: 84760 - DNA, 735 bp, Homo sapiens
  misc_feature: GYAE6OF02HFS3N.47.46.E02.1.454.CMB.1.raw
  modified_base (384)..(384): a, c, t, g, unknown or other
  misc_feature (384)..(384): n is a, c, g, or t
  modified_base (388)..(388): a, c, t, g, unknown or other
  misc_feature (388)..(388): n is a, c, g, or t
tcagagctcacgtacacgaccggtgctcgatttagactcatctacagggaaaggggtctgagagaggagcccagccttgggattttcaggtgttttcatttggtgatcaggactgaaccgagagaactcaccatggagtttgggctgagcgtgtcgtcttacgtgtggtactttttaaaaggtgtccagtgtgaggtgcaactgttggagtcgtggggagacttagtacaccgtgggggtccctggagactctcctgtgcagcctctggactctacctttagacctaactctgtctagtcgggtctcgggtccgccgacggccggtaccggggggagggctgggaggtcgggtctacgaagttattgatgaagagtggaggaancganattcgtacggtgacgtcggtaggaacgggcccgttacaccgtacgtacctaccgaaggacgtaaccttaaacgtttcgaagggcgaccaacgtcgttataacgtactaaaacgtaagtacgaacgtaccgaccgttaaggacgggaacggaccccggaagggaaacccgtaaccgggtaccgtttaacgttttaccgttttacgaacggggttacgtaaaccggtaacgtttaccgtaacggttaacggaccgttaaccgggtccccgtaaccccccgttaggacccgttacccggttacctttttaaccggtttccgttaaccggtttcccgggtaacccgggggg

SEQ ID NO: 84761 - DNA, 617 bp, Homo sapiens
  misc_feature: GYAE6OF02GQJ3M.47.46.E02.1.454.CMB.1.raw
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggcttttttaaaaggtgtccagtgtgaggtgcaactgttggagtcgtgggggagacttagtacacccgtggggggtccctgagactctcctgtgcagcctctggactcacctttagcaactctgtcagtgggctgggtccgccgaggccgtccgggggaagggctgggaggtgggtctcgaagttatgatgagaatgggtaggaagcatattcgtacggtggactcggtaggaacgggtcccgttacaacctatcctaccgagaacgaacctaagttttcgaaggagccaacgtctagtactacgtaaacaaatacgaaacacgcctaggacgacggacccggaaggaaccgaccggtaccgttaattacgtttctggtacgacgtaagttcgtaagtagctagtcccgacccctaggccgtctaccgtttcttacgtaccttcggtacgggg

SEQ ID NO: 84762 - DNA, 578 bp, Homo sapiens
  misc_feature: GYAE6OF02GHTZP.47.46.E02.1.454.CMB.1.raw
  modified_base (202)..(202): a, c, t, g, unknown or other
  misc_feature (202)..(202): n is a, c, g, or t
  modified_base (226)..(226): a, c, t, g, unknown or other
  misc_feature (226)..(226): n is a, c, g, or t
  modified_base (388)..(388): a, c, t, g, unknown or other
  misc_feature (388)..(388): n is a, c, g, or t
  modified_base (410)..(410): a, c, t, g, unknown or other
  misc_feature (410)..(410): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccgaggggaangccacatctcctggtagggccgtnagagtatagcatcaacttgcctggtaccagcagacgacctgggcaggctcccgaggcctcctcatctatgatgccgtccaccgacgggccacgttcggttcccagtcctaggttcaggtggcagtcgcgtcgtggacagtacgttcactctcactatcaacncgcctgactagtctagaagttntttgacttagtttattacgtgtacagtctaagttctactagttaccgtcggccgttctacctacccgttcgggacccgtaagggacctacggtacgtacgggtaacgtaacgttaaaccggtacgttaggtacggtaccttacggacctaccgttagtccgtttaccg

SEQ ID NO: 84763 - DNA, 592 bp, Homo sapiens
  misc_feature: GYAE6OF02GWN8Q.47.46.E02.1.454.CMB.1.raw
  modified_base (208)..(208): a, c, t, g, unknown or other
  misc_feature (208)..(208): n is a, c, g, or t
  modified_base (217)..(217): a, c, t, g, unknown or other
  misc_feature (217)..(217): n is a, c, g, or t
  modified_base (273)..(273): a, c, t, g, unknown or other
  misc_feature (273)..(273): n is a, c, g, or t
  modified_base (317)..(317): a, c, t, g, unknown or other
  misc_feature (317)..(317): n is a, c, g, or t
  modified_base (337)..(337): a, c, t, g, unknown or other
  misc_feature (337)..(337): n is a, c, g, or t
  modified_base (358)..(358): a, c, t, g, unknown or other
  misc_feature (358)..(358): n is a, c, g, or t
  modified_base (430)..(430): a, c, t, g, unknown or other
  misc_feature (430)..(430): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcggtgtgctagtgtcgacttttaaaggtgtcagtgtgagtgcaatgtgagtctggggancttagtacnccgtgggggtccctagacgtactctcctgtgcaggcctcgtcggactctaccttanctaactctgtcatggctgggtccaccgagcgccggggaaggcgnggaggtggtctgaacgtttntgagtcgagtagtggagacgngtactgtacgtacgtacgtacgtcggtagtacggtcgtacactacgtcgacacgacgtactacgttgacgcncgtacgtactagtactacgtactaaacgtcgaacgcgtacgagaacgtacgacgtacgaccgtacgtacttagttactacgtaggactaacgtagtactaaggtcgtaacgtcgtacccgtaccgtacgcgtacgttccttacgttcgtacgtcggtacggg

SEQ ID NO: 84764 - DNA, 724 bp, Homo sapiens
  misc_feature: GYAE6OF02IHIPC.47.46.E02.1.454.CMB.1.raw
  modified_base (208)..(208): a, c, t, g, unknown or other
  misc_feature (208)..(208): n is a, c, g, or t
  modified_base (365)..(365): a, c, t, g, unknown or other
  misc_feature (365)..(365): n is a, c, g, or t
tcagagctcacgtacacgaccggtgctcgatttagactcatctacaggggaaagggggaggaactgcctcgagttacggacccagacggtaaccatggaagccccagcgcagcttctcttcctcctgctactctggctccagagaccacgtggagaaatagtggtatgacgctagttactccagccacctgtctttgctcgagggaangccgacctctctgcagggtcagtccagagtgtcgacagtctacttagtctaggtaaccaagtaacgtaaacctggtacccaaggtccttaccccgaggccttaccgtcacttccgtaggggtaactcggactaccgtacccgaaacgaggggccccnctacgggcctaactcccgaggcccttagggtaccaggttccggactacgggttcgggttcctagggaacctacggtaccttccaacgttccgacctaacccgatccgaacggccaacgtaccgtaacggacgtacccgtaggtaacgttacgttttacggacgttaagttttaacgtttaccgttcgttaacctacgtaaccgtaaaccgtaattaccggtacggtacccgttaccgaccgttaccgtaccggtttacgggcgggtaaccggtaccggtaacgggtcggaagtaacggtaacgtaaaccggtacgttggtacggtctacggaccgtaccgtagtacgttcgtcgttacg

SEQ ID NO: 84765 - DNA, 718 bp, Homo sapiens
  misc_feature: GYAE6OF02GO0V2.47.46.E02.1.454.CMB.1.raw
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgacctggctttttcttgtggctattttaaaaagtgtccagtgtgaggtgcagctggtggagtcgtgggggaggcttagtacaggccgtggggggtccctggagactctcctgcgcagcctcgtggattcctcctttagtagttatcgccagtcgtacttgggtccgccgaggcctccgaggggaacgggccgtgggaggtgggtctcgaggctagttggtaggtaggtggtgccgaggacacgtagttaacgtaaacgtccctagacgacgggcctatttcgtttactctaccgagacgtaactaacttcgaaggaactattacgtagtacttcgtgctaggtttacgaaccctagtacctaggagtacggtacggaacgggtaacccgacgggtacccgtttaaagttaagttttacgttttagtttaacgggttaaagtttgggggtaagtttggggtacggtaaccgtttaaccggtaacccggttttcgggttacccggggggggtaacccccgggtaacccgtttacggggttccctaaccccgggtttccgttccgtttaacccgg

SEQ ID NO: 84766 - DNA, 564 bp, Homo sapiens
  misc_feature: GYAE6OF02FLZ2A.47.46.E02.1.454.CMB.1.raw
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggcttttttaaaaggtgtccagtgtgaggtgcaactgttggagtctgggggagacttagtacaccctggggggtccctgagactctcctgtgcagcctcgtggactcacctttagcaactctgtcatgggctgggtccgccaggcgtccggggaagggctgggagtgggtctcgaagtattgatggaagaatgggtaggaagcactattctacggtggactccggtaggaacgggtccggttcaccatcctccagagactaatttcgaaggagcacgctgtactctaacaaatgaacagtctagagagccgagacgacggtacgtatactttcgtgtgacgtaagtctagtagacagtcgacccctacgcgctacctttctttacgtacttcggtcgggg

SEQ ID NO: 84767 - DNA, 570 bp, Homo sapiens
  misc_feature: GYAE6OF02H1932.47.46.E02.1.454.CMB.1.raw
  modified_base (202)..(202): a, c, t, g, unknown or other
  misc_feature (202)..(202): n is a, c, g, or t
  modified_base (288)..(288): a, c, t, g, unknown or other
  misc_feature (288)..(288): n is a, c, g, or t
  modified_base (423)..(423): a, c, t, g, unknown or other
  misc_feature (423)..(423): n is a, c, g, or t
  modified_base (446)..(446): a, c, t, g, unknown or other
  misc_feature (446)..(446): n is a, c, g, or t
  modified_base (459)..(459): a, c, t, g, unknown or other
  misc_feature (459)..(459): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccgaggggaancgccaccatctcctggagggccgtcagagtattagcatcaacttgcctggtaccagcagagcctgggcaggctccgaggccttccnactctatgatcgtcctccaccgacgggtcccacgttcggtttacccagtcccgtaggttccaggtcggctaggtcgcggtctacgggactagagttcacttctcaccatacaacacgctcgcagtctagtagttnttttagcttagttttatacgttntcagtctagttanactatacgtcggcctactcctacggttccggaccgtaaggaccgtaacgtacggtaggaagttaaacgtaaacgaacgttggtcgtactccgacgtcctataccgtttacg

SEQ ID NO: 84768 - DNA, 674 bp, Homo sapiens
  misc_feature: GYAE6OF02IOBN8.47.46.E02.1.454.CMB.1.raw
  modified_base (391)..(391): a, c, t, g, unknown or other
  misc_feature (391)..(391): n is a, c, g, or t
  modified_base (473)..(473): a, c, t, g, unknown or other
  misc_feature (473)..(473): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttctgtggtctttttaaaaggtgtccagtgtgaggtgcaactgttggagtcgtgggggagacttagtacacccgtgggggtccctgagactctcctgtgcacgcctcgtggactctaccttagctaactctgtcagtgggcgtcgggtccgccgaggtccggtaccggggggaagggtcgtggggaggttcgggtctacgaagttagttgagtgaaggtaagtgggtaggacgnaactgttacgtacggtcggtactcggtagaacgggtccgttacaccgtatccgtaccagaactaactaagtttacgaagganacgacgtctagtactactaaactaaacgtagtaaacgtgtacgaggaagacggtaccggaacggaccggaacggtaccgttaagtttacgtttcgtacggtacgaccgtaaacgttacgtaagtacggacctacgggtaccccaccccgtacgacccgtaccttacgtttaccgttacgttacccgttgggtacccggggg

SEQ ID NO: 84769 - DNA, 575 bp, Homo sapiens
  misc_feature: GYAE6OF02H2ASI.47.46.E02.1.454.CMB.1.raw
  modified_base (260)..(260): a, c, t, g, unknown or other
  misc_feature (260)..(260): n is a, c, g, or t
  modified_base (351)..(351): a, c, t, g, unknown or other
  misc_feature (351)..(351): n is a, c, g, or t
  modified_base (449)..(449): a, c, t, g, unknown or other
  misc_feature (449)..(449): n is a, c, g, or t
  modified_base (464)..(464): a, c, t, g, unknown or other
  misc_feature (464)..(464): n is a, c, g, or t
  modified_base (565)..(565): a, c, t, g, unknown or other
  misc_feature (565)..(565): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggtctttttaaaaggtgtccagtgtgaggtgcaactgttggagtcgtgggggagacttagtacacccgtggggggtccctgagactctcctgtgcngcctctggactcaccctttagcaactctgtccatgggctgggtccgccgaggcgtccgggggaaggggcgtgggaggtgggtctcgaagtnttgatgagaatgggtggaagcactattcgtacggtcggtactccggtaggtaacgggtcccggttcaccgactcctccagacgaactaatttcagtancacgctgtatctaanaatagaacagctagagagacgaggacacggcttatattctgtgagaagttctagtacgctagtccgccccgtagccgtctttacgtttttcgacgttccgngggtacccgg

SEQ ID NO: 84770 - DNA, 625 bp, Homo sapiens
  misc_feature: GYAE6OF02JAPJY.47.46.E02.1.454.CMB.1.raw
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcgtggcgtctttacgttgtggtacttttttaaaaggtgtccagtgtgaggtgcaactgttggagtcgtgggggagacttagtaccacccgtggggggtccctgagactctcatgtgcagcctcgtggacctctacctttagcaacttcgtgtcagtgggtcgtcgggtcccgccgaggccggtccgggggaagggctgggagtcgggtctacgaagttgttgatagagtaagtggtaggaagcgtactattcgtacgtacggcgtcgtaggaacggtccggttacacctatctaccgagacgactattcgagcgacacgtctagtactacgtaacaatacgaactacgctagacgcgacgacgaacgacggtactatcttcgtgtacgtacgtaagttcgtaagtacgacgtacggtacccgtcccccgtacgccgttaaccttaccgttttccgttaccggttactttaccgggg

SEQ ID NO: 84771 - DNA, 623 bp, Homo sapiens
  misc_feature: GYAE6OF02FNQP4.47.46.E02.1.454.CMB.1.raw
  modified_base (212)..(212): a, c, t, g, unknown or other
  misc_feature (212)..(212): n is a, c, g, or t
  modified_base (219)..(219): a, c, t, g, unknown or other
  misc_feature (219)..(219): n is a, c, g, or t
  modified_base (371)..(371): a, c, t, g, unknown or other
  misc_feature (371)..(371): n is a, c, g, or t
tcagagctcacgtacacgaccggtgctcgatttagactcatctacagggaaaggggtctgagagaggagcccagccctgggattttcaggtgttttctatttggtgatcaggactgaaccgagagaactcaccatggagtttgggctgagcgtggctcttacgtggtgtacttttttaaaaggtgtccagtgtgaggtgcaatgttggagtntgggganacttagtacaccgtgggggtccctgagtactctcctgtgcagcctctggacctcacctttagcaacttctgtcagtcgggcgtggtccccgcaggccgttccgggggaagggctggagtgggtctacgaagtattggatcggagaagtgggngaacgcactagttccgtaagtggccttcggtaggaacgggtcccgttacacccagtcctaccgagacgtaactaacgttcgaaggtcgacaccgtgtagtactcgtaaacaatagactagctagacgtagaccgagacctacggtcttagtactttcgtagtaccgaagtacgttctaacgtcggctaacgtccccgaccccctaacggctccccgttaagtttccggttacgtacccgtttgggaaccggg

SEQ ID NO: 84772 - DNA, 647 bp, Homo sapiens
  misc_feature: GYAE6OF02IL0CQ.47.46.E02.1.454.CMB.1.raw
  modified_base (228)..(228): a, c, t, g, unknown or other
  misc_feature (228)..(228): n is a, c, g, or t
tcagagctcacgtacacgaccggtgctcgatttagactcatctacagggaaagggggaggaactgctcagttaggacccagacggaaccatggaagccccagcgcagcttctcttctcctgctactctggctccagagaccactggagaaatgtgatcggacgcagtctccagccaccctgtctgtctctccgaggggaaaccgccacatctcgtggtacgggccgtnagtagtatcgcatacaacttcgctaggaccagcaagacgtaccgtggacacggtcctccgaggtcctccgtcattctagtgactcgtccgtaccgaccgacgggtaccacgttcggttacccagtccgtaggttcaggtcggactacggtcgccggtcgtacgggacaggtacttacgaccgttcctacgacctagtaccgtaacgtacgtaccgtcgacgtacgtacgtagtaacgttctttacgtacgttacgttttacttacgtacgtcgtaagtacgtaacgttactacgtaacgttaacggtcggtaccgtacgttaccgtaccgttaccggaaccgtaggtacgaacggtacggtacggtaacgtaacgttaaacgtacgtaggtacgacgtaccgtacgtacgtactcgtac

SEQ ID NO: 84773 - DNA, 804 bp, Homo sapiens
  misc_feature: GYAE6OF02JVONN.47.46.E02.1.454.CMB.1.raw
  modified_base (305)..(305): a, c, t, g, unknown or other
  misc_feature (305)..(305): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggtctttttaaaggtgtccagtgtgaggtgcaactgttggagtcgtgggggagacttagtacacccgtgggggggtccctggagactctcctgtgcagcctctggactcacctttagcaactctgtcatgggctgggtccncaggcgtccgggggaagggctggacggtggtctacgtaagtattgactggagaagtgggtaggaagcacgtattcgtacggtggacctcggtagaacggggtcccgttacgacctactccgtaccgaaggtacggaaccttaagttttaccggaaggggacgtaccgtaccgggtacttacggttacgtaccgttaaacctaaaagttaccggaaaaccgtacgggttacccgtacgggtaaagggacccggtacccgggaacggggtaaacccgtaacccgggggtaccccgtttaaaagtttacccggtttttaaccgcggggtttaaccggggaaaccggttaaaccggtttaccttaaacgggttaacgggtaacccggttaaccgggtaacccccgtttaacccccccggtaaccgggtaccccggttaccgttaaaccccttttttccggtttaccgggttaaccccgttttcccggggttaacccggggggg

SEQ ID NO: 84774 - DNA, 669 bp, Homo sapiens
  misc_feature: GYAE6OF02HX88B.47.46.E02.1.454.CMB.1.raw
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcgtggctctttcttgtggtcttttttaaaaggtgtccagtgtgaggtgcaactgttggagtcgtgggggagacttagtacacccgtggggggtccctgagactctcctgtgcagcctctggactcacctttagcaactctgtcatggctggtccgcgaggcgtccggggaaggggctggagtgggtctcgaagtattgattggaagtaagtgggtaggaaacgctaacaattctacggtggactaccggtaggaacggggtccgttcaacctactcctacccgagacgtaacgtaaacttttcgaaggtacgacgaaccgtaccgttaggtaaactaccgttaaactaaaacgttacgaaaacctaagttccgtaacgaagggaacgacccggaaggaaccgtaaccgggaccgttaatttaagtttaccgtgtacgaacgtaaacgttctaacgttaagcctaaggtccctacccccgtagccgtaccgtcctttacgttcgtaccgttgtaccggggg

SEQ ID NO: 84775 - DNA, 682 bp, Homo sapiens
  misc_feature: GYAE6OF02GAV82.47.46.E02.1.454.CMB.1.raw
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggcttttttaaaaggtgtccagtgtgaggtgcaactgttggagtctgggggagacttagtacacccgtggggggtccctgagactctcctgtgcagcctctggactcacctttagcaactctgtcatgggctgggtccgccgaggcgtccgggggaagggctgggagtgggtctcgaagtattgatgagaatgggtggaagcactattcgtacggtgaccgttccggtaggaacgggtcccggttacacccgtacgttcctaccgaaggacgaactaaattttaccgaagggtacgaccgaacggcgttacgtacttaccgttaaacgaaaattacggaaaccacggtccctaaggacggtaacggacccgggaagggaccgtaaccgggtacccgtttaacgtttaacttttccggtagttacggaccgtaagtctaagtacgtactaacggttcccgaccccccgttaagccggtacccttacctttccgttttagacccgtttcggtaccggggg

SEQ ID NO: 84776 - DNA, 608 bp, Homo sapiens
  misc_feature: GYAE6OF02HCLSD.47.46.E02.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (222)..(222): a, c, t, g, unknown or other
  misc_feature (222)..(222): n is a, c, g, or t
  modified_base (251)..(251): a, c, t, g, unknown or other
  misc_feature (251)..(251): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagcccacctgtctgtctctccgagggaangccacatcnctgagggccgtnagagtatagcatcaacttgcctggtaccngcagacgaccgtggacacggcctcccgagggtcctccctacgacttcctatgtactcggccgtaccaccgacgggcctacgttcggttcccacgtccgtagttcagtcggactagtcgtcgtacgtggggactaggtacgttcacctccgtaccaactactaccaacgtcgcccttggacctaggttcgtaagtaacgttcgttttagacgtttaagttttacttacgtagtaccgtagactaaggttaataacgtaacgtcggccttcgacgtttccggagaacgggactacggcgttagaaccgtaagttaaccgaggttgtacggtctacggcctacgtatcgtcgttactccg

SEQ ID NO: 84777 - DNA, 676 bp, Homo sapiens
  misc_feature: GYAE6OF02G4D68.47.46.E02.1.454.CMB.1.raw
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggtctttttaaaaggtgtccagtgtgaggtgcaactgttggagtctgggggatacttagtaccacccgtggggggtccctgacgactctcctgtgcacgcctctggactcctacctttagcctaactctgtcagtgggtctcgggtccgccgtaggcggtaccgggggaaggggcctggggacggttcgggtactaccgtaaaggttacttggaatggaaggtaagttgggtaaggaacgactaactacgttccgtacgtggaccttccggtaggtaacggggtcccgttcacctacgtcctacgagaacgtactaacgtttcgaacggtacgaccgacgtctacgtacttacgtaacgtaaacgtcgaacgtacgtacgacgaacgacggtacccggacggaccacgggtacctaagtttcttacgtgtacgacggttaactctaagtcgacgtacggtccctaccccgtagtcccgtccttacttccgtttacgtcccgttcgtaccggg

SEQ ID NO: 84778 - DNA, 667 bp, Homo sapiens
  misc_feature: GYAE6OF02IPUAC.47.46.E02.1.454.CMB.1.raw
  modified_base (182)..(182): a, c, t, g, unknown or other
  misc_feature (182)..(182): n is a, c, g, or t
  modified_base (221)..(221): a, c, t, g, unknown or other
  misc_feature (221)..(221): n is a, c, g, or t
  modified_base (345)..(345): a, c, t, g, unknown or other
  misc_feature (345)..(345): n is a, c, g, or t
  modified_base (507)..(507): a, c, t, g, unknown or other
  misc_feature (507)..(507): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcgtgcgtcttacgtgtggtactttttaaaaggngtccagtgtgaggtgcaacgtgttggagtcgtggggganagttagtacacccgtgggggtccctgagacctctcctgtcgcagtcctctggacctcgtacctttagacacttctgtcagtggtctcggtccgcgtaggccggtccgggggaagggtctagggnggttcggtactacgtaagttattgagtggaagtagtgggtgaagtcagtagttacgtacgtcggactccggtaggacggtcgttaccacgtacgtctaccgtagacgtaacttaagttcgagtacgtcaccgtatacgtactaacgtaactaaactacgaancgtccgaaggacgacggaccggaagaccgtaaccggtccgttaagtttaccgtttcgtaggtaaccgtaacgtaaagttcctaaggtcgtaccgtaccggtcccgaccccgttaagtcccgtaacttacccgtttaggttaccgtccgtttagggccggg

SEQ ID NO: 84779 - DNA, 665 bp, Homo sapiens
  misc_feature: GYAE6OF02IQ7TE.47.46.E02.1.454.CMB.1.raw
  modified_base (203)..(203): a, c, t, g, unknown or other
  misc_feature (203)..(203): n is a, c, g, or t
  modified_base (230)..(230): a, c, t, g, unknown or other
  misc_feature (230)..(230): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccgaggggaaancgccacatcctcctggtagggccgtanagagtattagcatcaacttgcctggtaccagcagacgaccgtgggcacggcctcccgaggtcctcctcattctatgactcgccgtccaccgacgggtcctacgttcggttacccacgtccgtacggttcaggtcggacaggtcgcggtacgtgggacagtacgttccacgtcctaccacctactaccaacgtacgtcctacgtacgtagttaccgtaagttaacgtttcgttttacgacgttttaagttttacttacgttagttacgacgtacttaagttactacgtaacgtaccggtccggtccgttacccttacccgtaccggtaccgggtaaccgaaccgggtactaaccgggtacggtaacggtaaacgtaaacgtttaaaccggacgttacgggtcgtaccgtaccgtaccctaacttcgtaccgtttcg

SEQ ID NO: 84780 - DNA, 642 bp, Homo sapiens
  misc_feature: GYAE6OF02F6SGI.47.46.E02.1.454.CMB.1.raw
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggtcttttttaaaaggtgtccagtgtgaggtgcaactgttggagtcgtgggggagacttagtacacccgtggggggtccctgagactctcctgtcgcagcctcgtcggactcctacctttagctaaccttctgtcagtgggagtcggggtcccgccgagggccgtccggggggaaggggcgtgggaggtgggtctacgaagtattgagtggaagtaagtgggtaggaacgcactattcgtacggtaggtaccgtccggtaggtaacggggtcccggttaccacccgtacttccgtacccgagaacgactaaacgtttcgaaggagccacgcttagactacctaacaaatacgaacacgcctaggagacgcggaacggaccgacggtcgttattacttcgtgtcgacgtaacgtctaagtacgccgtaacgtcccgacccctacgcgtcctactttcgttacgtacgttcggtaccggg

SEQ ID NO: 84781 - DNA, 648 bp, Homo sapiens
  misc_feature: GYAE6OF02HIGI6.47.46.E02.1.454.CMB.1.raw
  modified_base (204)..(204): a, c, t, g, unknown or other
  misc_feature (204)..(204): n is a, c, g, or t
  modified_base (469)..(469): a, c, t, g, unknown or other
  misc_feature (469)..(469): n is a, c, g, or t
tcagagctcacgtacacgaccggtgctcgatttagactcatctacagggaaagggggaggaactgctcagttaggacccagacggaaccatggaagccccagagcagcttctcttcctcctgctactctggctcccagagaccactggagaaatagtgatgacgcagtctccagcccaccctgtctgtctctccgaggggaaangccaccatctcctggtacgggccggtcagagtattagcatcaacttagcctggtaccagcagagacctgggcaggcctcccaggcctcctcatctatgatcgccgtaccaccgacggggccctacgtttcgggtttaccccacggtcccgtaagggtttccaacggttcgggactagggttcggcggttactgggggacctaggtacgtttccaccgttcctaccaccgtaatccaacacgtacctgcctacgtctagtaagttnttttgactttagttttactacgttcgatacgtactagttactacgtaactaaccgtcggtcctccttaccgtaccgttcgggaccgaagggtaccaccggtacgttaaggaacgttaaacgttaaaccggtacgttagggtaccggtactaccggtacctaaccgtagttcccttacgg

SEQ ID NO: 84782 - DNA, 692 bp, Homo sapiens
  misc_feature: GYAE6OF02G53V4.47.46.E02.1.454.CMB.1.raw
tcagagctcacgtacacgaccggtgctcgatttagactcatctacagggaaaggggagctctgagagaggagcccagccctgggattttcaggtgttttcatttggtgatcaggactgaaccgagagaactcaccatggagtttgggctgagcgtggcgtcttacgtgtcggtactttttaaaaggtgtcctagtgtgaggtgcaactgttggagtcgtgggggagacttagtacacccgtgggggtccctgacgactctcctgtgcagcctctggactcacctttagctaactctgtcagtcgggctgggtcccgcgagggccgtccggggaagggcgtagggaggttgggtctcgaagttattaggattgaagtaagtggtaggaagcactagtttctacggtgtacgtccgtaggtaacgggtccggttccaacctactacctgacccccccccccgtagaacgtaactttacgtaaggacgacgaaccgtccgtagttagtacgtaactaaacgtaacgaaacctacgaccgtagaacggacggaccggaacgggaaccgtaccggtaccgttaacgttacgtttacgttacgttaggtacggtaacgttaacgttaagtaacggtacgtacgtaccgtaccccgtacccggtccgtaccgttaccgtttaccgtttacgttaaccgg

SEQ ID NO: 84783 - DNA, 669 bp, Homo sapiens
  misc_feature: GYAE6OF02GSQEH.47.46.E02.1.454.CMB.1.raw
  modified_base (201)..(201): a, c, t, g, unknown or other
  misc_feature (201)..(201): n is a, c, g, or t
tcagagctcacgtacacgaccggtgctcgatttagactcatctacagggaaagggggaggaactgctcagttaggacccagacggaaccatggaagccccagctcagcttctcttcctcctgctactctggctcccagataccatcggagaagttgtgttgacacagtctccagccaccctgtctttgtctccaggggaangccaccctctcctgcagggccagtcagaatattcactcctacttagcctggtaccaacagaaacctggtcaggcctcccgaggcctcctcatctaatgatcgacactacccgaacgacgggccacgtggaccactcccagacgtaggttcaggtcggacgtaggttggggtctggggacacggtacttacgaccttcctaccacctataccgacgccaacgtcccgtaaggaccgtacccgtagtaaacggttacgtttacggtaaccttttagttacgttacgtacgacgtcgtacggtcgttaggtacgttcgtaccggtcccttaccgtccgttcgtaccggttttccgggacgggtaaccgggaccggtagggggtacggacggtaacgtaacggaaaccggtacgttacgggtacggtaccgtacgtaccgaccgttacgttaccgttcgttaccgtttaccg

SEQ ID NO: 84784 - DNA, 611 bp, Homo sapiens
  misc_feature: GYAE6OF02F7O36.47.46.E02.1.454.CMB.1.raw
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcgtggcgtctttacgttgtggcttttttaaaaggtgtccagtgtgaggtgcaactgttggagtctgggggagacttagtacaccctggggggtccctgagactctcctgtgcagcctctggactcacctttagcaactctgtcagtgggctgggtcccgccaggcgtccgggggaaggggctgggaggtgggtctcgaagtattgatgagaatgggtagaagcactattctacgtggactccggtaggaacgggtccggttcacctatctccagtacactaatttcgaagggtacgacacgctagtatctaacaaagtcgaacagtctagagacgaccgaggacgacgggtcctagttacttcgtgtacgacgtaagttctaagtacgtacgtacggttcccgacccccttaaggcccgtaccttaaccgttttccgtttcgtaccgtttcggtaccggggg

SEQ ID NO: 84785 - DNA, 723 bp, Homo sapiens
  misc_feature: GYAE6OF02HFSYK.47.46.E02.1.454.CMB.1.raw
  modified_base (197)..(197): a, c, t, g, unknown or other
  misc_feature (197)..(197): n is a, c, g, or t
  modified_base (245)..(245): a, c, t, g, unknown or other
  misc_feature (245)..(245): n is a, c, g, or t
  modified_base (297)..(297): a, c, t, g, unknown or other
  misc_feature (297)..(297): n is a, c, g, or t
  modified_base (312)..(312): a, c, t, g, unknown or other
  misc_feature (312)..(312): n is a, c, g, or t
  modified_base (537)..(537): a, c, t, g, unknown or other
  misc_feature (537)..(537): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcggtgtcgtcttacgtggtcgtatttttaaaggtgtcagtgtgagtgnactgttggagtcgtggggagcttaggtacaccggtgggggtcctgganactctccgtgtgcacgtcctcgtggctcctactttagactaactctcgtacngtggcctgggtcccnccggtaggtccggtccggggggaagggtcgtcgggtacgtgggtcctagtaagttatggtaatcggaagtaaggtggtaggagtacgactattccgtacggtcgtacgtccggtaggtaaccgggtccgttacacctactcctaccgagaacgtaactaacgtttcagggtactcgaccgtacttacggtaactaactaaacgtaattacgaaactacgtacggngtaacgcgggtaccacgggtaaccgaccggttaacggttaccttagtttccggtaaggttaggaaccgttaaacgtgtttaacccggtgacccgttacgggtaccccgtaaccccccggttcgtaccccggtacttttaaccggttttccggtttaccgggttacccgtttaacgggtcccggggg

SEQ ID NO: 84786 - DNA, 854 bp, Homo sapiens
  misc_feature: GYAE6OF02FP01S.47.46.E02.1.454.CMB.1.raw
  modified_base (384)..(384): a, c, t, g, unknown or other
  misc_feature (384)..(384): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcgtggctctttcgttgtggtacttttttaaaaggtgtccagtgtgaggtgcaactgttggagtcgtgggggagactttagtacacccgtggggggtccctggagactctcctgtgcagcctctggactcacctttagcaactctgtcatgggctcgggtccgccaggccgtccgggggaagggcgtgggaggtgggtcctacgaagttattgatggaagtaagtcggtagggaancgacgtatttcctacggtcggtaacgttccggtagggtaaacggggtccccggtttcaacccgttattcccgtaccgaaggtaacgtaaccttaaacgttttcggaaacgggcgtaaccgtaccggtaccgtttacgggttaaacttacccgttaaaacccgaaaaagtttaaccggtaaacgttaacggtttcccgttaacgggtaaacgggaccccggtaaacccggggaacgggaaaccccgtaacccggggggttaccccttttaaatttaaccggttttttaccggttacggtttaaccgggaaccgggtttaaacggtttacgtaaacgggttttaggaaccccggttaacgggttacccccggttaaccccccgttaacccgggtccgttaaccccggtttaccccggttttttaccgttttaaccggttacccggtttttcccggggtaaccccgggggggg

SEQ ID NO: 84787 - DNA, 616 bp, Homo sapiens
  misc_feature: GYAE6OF02F9K20.47.46.E02.1.454.CMB.1.raw
  modified_base (201)..(201): a, c, t, g, unknown or other
  misc_feature (201)..(201): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccacctgtctgtctctccaggggaaanagccacatctcctgtagggccgtcagagtattagcatcaacttagcctggtaccagcagagacctgggcaggcctcccgaggcctccgtcatctatgatgccgtccaccgacgggcctacgtcggtttccccagtccctaggttcaggttcggcgtaggtcgcgtctggggacagtagttccacttctaccaccatccaacacgtcctgcagtctagtaacgttatttgcttagtttattacgttcgtacgagtctagttacttacgaacttaacgtcggacctcgtaccctacccgtttccgggacccgtaacgggaccgtaaccggtaacggtaacggtaacgtaaacgtttaaaaccggaacggttacggtacggtacgtaccgtaaccgaacccgtagttccgttaaccgg

SEQ ID NO: 84788 - DNA, 716 bp, Homo sapiens
  misc_feature: GYAE6OF02I4YK8.47.46.E02.1.454.CMB.1.raw
  modified_base (233)..(233): a, c, t, g, unknown or other
  misc_feature (233)..(233): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggcctcccagagaccactggagaaatagtgatgacgcagtctccagccaccctgtctttgtctccgaggggaaatcgcccacctctcctgcagggtcagtcagngtgtcacagcttactagtctggtaccaagacgaaccgtggaccaggctcccgaggtcctcctcactccgtgggactggcctactccgaagcgggcctcgtcggccacgtccccgaggccctaggttccaaggtcgaccgtagggtcggttacgtcggggaactacggtaccgtttaccgaccgttcctacccgtaaccgtagtaccgtaacggacgtacggtacccgtaacggaccgtacccgttaaggtaaacgttacgttttacggacgtttaagttttactttaccgttcgtaccgaacgtaccgtaaacgttaaacgttccgtaccggttacccgtaccgtccgttaaccgttaccggtttaccgggacgggtaacgggtaccgtacgggtacgtaacgtaggttaccggtaaaccggtacgtacggtacggtacgtaccggaccgttaccgtacgttaccgttacggttccttaaccg

SEQ ID NO: 84789 - DNA, 587 bp, Homo sapiens
  misc_feature: GYAE6OF02IMH9A.47.46.E02.1.454.CMB.1.raw
  modified_base (373)..(373): a, c, t, g, unknown or other
  misc_feature (373)..(373): n is a, c, g, or t
  modified_base (407)..(407): a, c, t, g, unknown or other
  misc_feature (407)..(407): n is a, c, g, or t
  modified_base (410)..(410): a, c, t, g, unknown or other
  misc_feature (410)..(410): n is a, c, g, or t
  modified_base (435)..(435): a, c, t, g, unknown or other
  misc_feature (435)..(435): n is a, c, g, or t
  modified_base (444)..(444): a, c, t, g, unknown or other
  misc_feature (444)..(444): n is a, c, g, or t
  modified_base (452)..(452): a, c, t, g, unknown or other
  misc_feature (452)..(452): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttctgtggctttttaaaaggtgtccagtgtgaggtgcaactgttggagtctgggggagacttagtacacccgtgggggtcccctgagactcctcctgtgcagcctctggactcacctttagcaactctgtcatgggctgggtccgccgaggcgtccgggggaaggggcgtgggaggtgggtctcgaagtatgatgagaagtgggtaggaagcaatnttctacgtgacgtcgtagaagggtccgtcaccgntcnccagacgaacaattcgagagcacgntgatctaanaatgaacngcctagagacgaccggaggaccgacgggtaccttattaactttcgtaggtagtacgtaagtacgtagtacgtacgacgttccggacccccttaaggccgtaaccttcgttactttcggtaccgttcggtccgggg

SEQ ID NO: 84790 - DNA, 682 bp, Homo sapiens
  misc_feature: GYAE6OF02HDG0A.47.46.E02.1.454.CMB.1.raw
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggtctttttaaaaggtgtccagtgtgaggtgcaactgttggagtcgtgggggagacttagtacacccgtggggggtccctggagactctcctgtgcagcctcgtggactctacctttagctaactctgtcagtgggctgggtcccgcaggcgtccggggaagggtcgtgggagtgggtactcgaagtagttgatggaagtaagtggtaggaagcactattcgtacggtggacgtccggtaggaacggggtccgttacgaccgtactccgtaccgagtacgaacctaatttcgaaggacgccgaaccgtcgttacgtaacttaccgttaaactaaaagtacgaaactaacgtaccgtaggaacgtacggacccggacgggaaccgaacgggtaccgttaattacgtttccgtacggtacggtaacgtaagttaccgttaagtagaccgtaggtaccccgtacccccgtaacggtcccgtaccgttacctttccgtttacgtccgttacggtacccgggg

SEQ ID NO: 84791 - DNA, 598 bp, Homo sapiens
  misc_feature: GYAE6OF02I3UVG.47.46.E02.1.454.CMB.1.raw
  modified_base (202)..(202): a, c, t, g, unknown or other
  misc_feature (202)..(202): n is a, c, g, or t
  modified_base (226)..(226): a, c, t, g, unknown or other
  misc_feature (226)..(226): n is a, c, g, or t
  modified_base (273)..(273): a, c, t, g, unknown or other
  misc_feature (273)..(273): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaangccacatctcctggtagggccgtnagagtattagcatcaattgccgtggtaccagcagacgaccgtgggcncggctcccaggcctcctcatctatgatcgccgtccaccgacgggccacgttcggtttcccaacggtccgtaggttacaggtcggctagtgcgtcgtgggactaggtacgttccgactcgcctaaccgtactaccaaacacggtcctagactagtacgtagtaagttacttttggacttagttttacttagtgtacagtctaagttattacgtactaacgtcggcccgtactcctaccgtaccgggaccgtaaggaccgtacgacggtcggaagtaaacgttaacggtacgttggtaggtccgtaccgccacgttactcgttaccg

SEQ ID NO: 84792 - DNA, 677 bp, Homo sapiens
  misc_feature: GYAE6OF02I0Z9M.47.46.E02.1.454.CMB.1.raw
  modified_base (203)..(203): a, c, t, g, unknown or other
  misc_feature (203)..(203): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccgaggggaaancgccaccatcctcctggtacgggccggtcagagtattagctatctaacgttgcctacggtaccagccagacgaccgtgggccaggcctccgaggtcctccgtcagtctatgattgccgtaccaccgcgggacctacgttccggttcccagtcccgtaggttccaggtggctaggttcgcgttacgtggggacaggtacttaccacgttcctaccctacgactaccgaaaccgacgcctacggactacggttacctaggtaacgttacttttacggactttaaattttacttaccgttcgtaacgttacgacttaacggttaattaaacgtaccgttacggtcccttacgttccgttaccggttcgggaaccgggtacgggtacccgggtagggttacgggaacgtacgtaacggtacggtaacgttacgggtaggttcggaccgttacgcccgtaacgtaccgttcgttaccgg

SEQ ID NO: 84793 - DNA, 678 bp, Homo sapiens
  misc_feature: GYAE6OF02FUQP7.47.46.E02.1.454.CMB.1.raw
  modified_base (312)..(312): a, c, t, g, unknown or other
  misc_feature (312)..(312): n is a, c, g, or t
  modified_base (353)..(353): a, c, t, g, unknown or other
  misc_feature (353)..(353): n is a, c, g, or t
  modified_base (466)..(466): a, c, t, g, unknown or other
  misc_feature (466)..(466): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcgtggctctttcttgtggtcttttttaaaaggtgtccagtgtgaggtgcaactgttggagtcgtgggggagacttaggtacacccgtggggggtccctgagactctcctgtgcagcctctggactcacctttagcaacgtctgtcagtgggctgggtccgcgnggcgtccgggggaagggcgtggaggtgggtctcgaaggttnttagatggaagtaagtgggtaggaagctacgtatttccgtaacggtggaccgttcggtagggaacgggtcccggttacacctactctaccgaggacactaagtttcgaggacncctaacttcgtagtaacttacctaaactaaagttcgaaactacgttcgtagggaagtacggaccgaagggacccgaccggggtactttaattacttttcggtcgtacggacgttaaacgttctaaggtaccgtacgtacggtcccgtacccccggtagacccggttccttaaccttttaccggtcggttaccctttggggtaaccccggggg

SEQ ID NO: 84794 - DNA, 656 bp, Homo sapiens
  misc_feature: GYAE6OF02FUHXS.47.46.E02.1.454.CMB.1.raw
  modified_base (206)..(206): a, c, t, g, unknown or other
  misc_feature (206)..(206): n is a, c, g, or t
  modified_base (219)..(219): a, c, t, g, unknown or other
  misc_feature (219)..(219): n is a, c, g, or t
  modified_base (230)..(230): a, c, t, g, unknown or other
  misc_feature (230)..(230): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccaaactggagaaatagtgatgacgcagtctccagccaccctgtctgtcctctccgaggggaaangccaccatctccngtagggccgtnagaatattcactctattagcctggaccaacagaacctggtcaggctcccaggctcctcatctatgatgcactcccaacgagggccacgtggccactcccagtacaggttcaggtggacgtaggtcggtacgtgggaactacgtacttccacttcctacaaccctacgttccgaacgtacgaccgtcccgtaaggacgacccgttaaggaaccgttacgttttacgggtaactttttaacgttacgttacgttacgtacggactacggtccggttggttaccgttccgtccggtaccgttccgtccttacgtaacccggtttcgggacggtaccggggaccgtaggggtacggacgtaacgtaaccgtaaaccgtacgttacggtacggtccgtcggtaacccaccgttacgttcgttacgttaccc

SEQ ID NO: 84795 - DNA, 781 bp, Homo sapiens
  misc_feature: GYAE6OF02HA7CM.47.46.E02.1.454.CMB.1.raw
  modified_base (261)..(261): a, c, t, g, unknown or other
  misc_feature (261)..(261): n is a, c, g, or t
  modified_base (268)..(268): a, c, t, g, unknown or other
  misc_feature (268)..(268): n is a, c, g, or t
  modified_base (284)..(284): a, c, t, g, unknown or other
  misc_feature (284)..(284): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagattccaccggagacattgttttgacacagtctccagccacctgtctttgtctccgaggggaaagcgcccaccctctcctgcacgggccagtcaggagtgttggcagctactagcctgaccaanagaaccngcaggtctccagctcnatctatgatcgcataccgaacgcgggaccacgtgggacctacgtccccgagtccccgtaagggtttcaagggttcggactaagggttcggacgggtttacgtacgggggactaacgggtactttacccgaccttacctaccgaaccctaagttaccgaacggtaccaaccggtacccgtaaacgggtaaccggtcccgttaaagggtaaacggttaacgtttttacggaacctttaaccgtttttacgtttaaccgtttcggtaccgtaaggtacctaacgggttaccgttaacggtacccgtaaaccgttccggtacccgttaccgtttaccgttaccggttttacccggggaaccggggtaaccgggggtacccggtacgggggttacgggtaacgggtaacgttaccggtaaacggggtaaccggttaaacggttacgggtaacgggtccgtaaccggtaccggtaacccgttacgggttacctttaacccggg

SEQ ID NO: 84796 - DNA, 765 bp, Homo sapiens
  misc_feature: GYAE6OF02H1NAW.47.46.E02.1.454.CMB.1.raw
  modified_base (150)..(150): a, c, t, g, unknown or other
  misc_feature (150)..(150): n is a, c, g, or t
  modified_base (197)..(197): a, c, t, g, unknown or other
  misc_feature (197)..(197): n is a, c, g, or t
  modified_base (217)..(217): a, c, t, g, unknown or other
  misc_feature (217)..(217): n is a, c, g, or t
tcagagctcacgtacacgaccggtgctcgatttagactcatctacaggaaaggggtctgagagaggagcccagccctcgggattttcaggttgttttctatttggtgatcaggactgaaccgagagaactcaccatggagtttggctgancgtggctctttcttgtggtctttttaaaggtgtcctagtgtgaggtncactgttgagtcgtgggganacgttagtacgtacccggtgggggtcctcgagactctcctggtcgcagtcctcgtaggtacctactaccgtttacgcctaactcgttcgtcagtcggtccgtcgggtcccgccgaacgggtccgtacccggggggaaggtcggtacggtaacggtcgggttaccgttaacgaaacggtttacgttaggattagggaaacgtaaggttcgggtaggaaacgccgtaaactcgttacgtaggtacccggtacgttaccgggtagggaaaccgggttccgggttaccaaccgttactacccggtacgtaacggaacgtaacttaacggtttacgaacggtacgtacaccggtaccgtacgtttacgaaccgtaaacgtaaacgttacgaaccgtaacgtccggtacgtacgaaccggtacggaacggtaaccccgaggtaacccgttaagttaccttagttagaacgacgtaacgttcttaagacggttacacggtacccgaccctaccggtacgccttaccgtttcgtttaacgtcccgtggtaaccggg

SEQ ID NO: 84797 - DNA, 673 bp, Homo sapiens
  misc_feature: GYAE6OF02JUWPN.47.46.E02.1.454.CMB.1.raw
  modified_base (223)..(223): a, c, t, g, unknown or other
  misc_feature (223)..(223): n is a, c, g, or t
  modified_base (472)..(472): a, c, t, g, unknown or other
  misc_feature (472)..(472): n is a, c, g, or t
  modified_base (513)..(513): a, c, t, g, unknown or other
  misc_feature (513)..(513): n is a, c, g, or t
tcagagctcacgtacacgaccggtgctcgatttagactcatctacagggaaagggggcgtctgagagaggagcccagccctgggattttcaggtgttttcatttggtgatcaggactgaaccgagagaactcaccatggagtttgggctgagctggctctttcttgtggtacttttttaaaaggtgtccagtgtgaggtgcaactgttggagtcgtggggganacgttagtacacccggtgggggtccctggagactctccgtgtcgcacgcctcgtggacctcgtacctttacgacaacttctcgtcagtcgggcgttcgggtccaccgaggtccggtaccggggacggtcgtagggacgttcgggtctaccgtaagttagttcggagtagaacggtaagtgggtacggaagactacgtagtttccgtacggtggtaaccgtccggtaggaacgggtcccggttaccactntcccgtccgaggtaccgattaacgttgaggactcgaacgtntagtaacgttccaagaaatcaaacgtcaccggtgaacgacggacccgtaaggccgtaccggtaccgttagttactttcgaggtagaccggtaagttccctaagtacgctacggtcccgtaccccgtgcccgtattcccgtttacgttgacccgttccggg

SEQ ID NO: 84798 - DNA, 647 bp, Homo sapiens
  misc_feature: GYAE6OF02H8P2Z.47.46.E02.1.454.CMB.1.raw
  modified_base (157)..(157): a, c, t, g, unknown or other
  misc_feature (157)..(157): n is a, c, g, or t
  modified_base (219)..(219): a, c, t, g, unknown or other
  misc_feature (219)..(219): n is a, c, g, or t
  modified_base (295)..(295): a, c, t, g, unknown or other
  misc_feature (295)..(295): n is a, c, g, or t
  modified_base (383)..(383): a, c, t, g, unknown or other
  misc_feature (383)..(383): n is a, c, g, or t
  modified_base (392)..(392): a, c, t, g, unknown or other
  misc_feature (392)..(392): n is a, c, g, or t
  modified_base (473)..(473): a, c, t, g, unknown or other
  misc_feature (473)..(473): n is a, c, g, or t
  modified_base (478)..(478): a, c, t, g, unknown or other
  misc_feature (478)..(478): n is a, c, g, or t
  modified_base (514)..(514): a, c, t, g, unknown or other
  misc_feature (514)..(514): n is a, c, g, or t
tcagagctcacgtacacgaccggtgctcgatttagactcatctacaggggaaagggggtctgagagaggagcccagccctgggattttcaggtgttttcatttggtgatcaggactgaaccgagagaactcaccatggagtttgggctgagcgtggngtcttagtgtgtactttttaaaggtgtcctagtgtgaggtgcaatgttgagtcgtggggganacttagtacaccgtggggggtccctaggagcttctcctgtcgcagcctcgtaggccttccacctttagctaacctntacgtcagtgggtgtcgggtccgaccgaggtccgtaaccgggggagggcttagggagtcgggtctagagttattggattagaatacgnggacggaancctaatacttccgtaaggtaggtactcggtagggaaggttcccgtactacatccgtacaagtagaactacttagagacgancggtnactataacgtaacaaattagaaccgtagtcgagganacgacggacgacggtacgtacgtattcgttagtcgtagtacgtaagttctaagtaagccctaacgtaccccggtacccgtaccgaccgttacctttactttccggtttaattacccggttggtaacccggggg

SEQ ID NO: 84799 - DNA, 579 bp, Homo sapiens
  misc_feature: GYAE6OF02JA2RS.47.46.E02.1.454.CMB.1.raw
  modified_base (203)..(203): a, c, t, g, unknown or other
  misc_feature (203)..(203): n is a, c, g, or t
  modified_base (227)..(227): a, c, t, g, unknown or other
  misc_feature (227)..(227): n is a, c, g, or t
  modified_base (363)..(363): a, c, t, g, unknown or other
  misc_feature (363)..(363): n is a, c, g, or t
  modified_base (398)..(398): a, c, t, g, unknown or other
  misc_feature (398)..(398): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccgaggggaaangccacatctcctggtagggccgtnagagtattagcatcaacttagcctggtaccagcagagaccgtgggcacggcctcccgaggcctcctcatcatgatgccgtcaccgagggcccacgttcggttcccagccgtaaggttcaggtgctagtcgcgtcgngggacaggtacgttcacttctacacgactacaacngtcctgcagttctagtaagtatttgacttagtttattacgtgtacagtctagttatacgtaataacgtcggaccgttcctaccgtaacccttccgggaaccgtaacgggacctacggtaccgtagggaacgtaaacgttaaacgacgttaggtacgcgttacgacctacctagtccgtacg

SEQ ID NO: 84800 - DNA, 457 bp, Homo sapiens
  misc_feature: GYAE6OF02GJLW0.47.46.E02.1.454.CMB.1.raw
  modified_base (439)..(457): a, c, t, g, unknown or other
  misc_feature (439)..(457): n is a, c, g, or t
tcagagctcacgtacacgaccggtgctcgatttagactcatctacaggggaaagggccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtcgtgggacagagttcactctcaccatcaacagcctgcagtctgaagtattttgctagtttattactgtcagcagtatcataacgtcggccctctacctacccgttcggaccgaagggacacggacgtggaagtaattaaacgactggtggctgcacatctgtcttcacttcccttcccgctactcgtagcttacgtgactcctcgagacggtcgggtcgtcggacgaaggcgacagtgnnnnnnnnnnnnnnnnnnn

SEQ ID NO: 84801 - DNA, 521 bp, Homo sapiens
  misc_feature: GYAE6OF02HOVOC.47.46.E02.1.454.CMB.1.raw
  modified_base (203)..(203): a, c, t, g, unknown or other
  misc_feature (203)..(203): n is a, c, g, or t
  modified_base (228)..(228): a, c, t, g, unknown or other
  misc_feature (228)..(228): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagcccaccctgtctgtctctccaggggaaanagccaccatctcctgtagggccgtnagagtattagcatcaacttagcctgtaccagcagagacctgggcaggctcccaggctcctcatctatgatgctccaccagggccactggtttcccagccaggttcagtggcagtgcgtctgggacagtagttcactctacaccatacaacagcctgcagtctgaagtattttgcttagtttattacttgtcagtctagtatacataacctggaccgactccgtaccttccggaccaagggaccacgacgtggaagaagttaaacgaacgtgtggctggacacctagtcttacg

SEQ ID NO: 84802 - DNA, 694 bp, Homo sapiens
  misc_feature: GYAE6OF02JL445.47.46.E02.1.454.CMB.1.raw
  modified_base (350)..(350): a, c, t, g, unknown or other
  misc_feature (350)..(350): n is a, c, g, or t
tcagagctcacgtacacgaccggtgctcgatttagactcatctacagggaaagggggctctgagagaggagcccagccctgggattttcaggtgttttcatttggtgatcaggactgaaccgagagaactcaccatggagtttggctgagctggctctttcttgtggtcttttttaaaaggtgtccagtgtgaggtgcaactgttggagtcgtggggagacttagtaccaccgtggggggtccctggagactctcctgtgcacgcctctggactctacctttgctaactctgtcagtcggctggccgcgaggccgtccggggaaggcgtggagtcgggtctacgaagttnttagagtagaggtaagtgggtagacgtcgaacgtgtttacgtacggtaggtaccgtccggtagggaaccgggtccggttacaccgtacgtccgtaccgtaacgaacgtaactaacgtttacgaacggagtaccgaacgtcgttacgttacgttaacctaactaaaggtacgaacgtacgtccggtaagaacgggaccggtaccgaaagggacccgaaccggtaccgtttaacgttacgtttacgtaggtacgtaccgtaacgtacgttaacgtacggtacgtaccgtcccgtaccccgtacggtcccgtacgttacccgttttcgttacggtacccgttccggg

SEQ ID NO: 84803 - DNA, 600 bp, Homo sapiens
  misc_feature: GYAE6OF02FP42C.47.46.E02.1.454.CMB.1.raw
  modified_base (344)..(344): a, c, t, g, unknown or other
  misc_feature (344)..(344): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggtcttttttaaaaggtgtccagtgtgaggtgcaactgttggagtcgtgggggagacttagtaccacccgtggggggtccctggagactctcctgtgcagcctctggactccacctttagcaactctgtcatgggctgggtcccgccaggcgtccgggggaagggctgggagtgggtctnaagtatgatgagatggtggaagcactattctacgtggactccgtgaacgggccgttacaccatctaccagacgtactaagtttcgaggacgcacgctagtatctaacaaatgaaacacgcctagacgaggaccgaggaccgtacgggtccgttaatagtttctagtgtacgtaagttctaagttacgacgtacggtcccgacccccgttaacggccgtacctaccgtttcgtttacgttaccgttcggtcccgggg

SEQ ID NO: 84804 - DNA, 565 bp, Homo sapiens
  misc_feature: GYAE6OF02F9ORA.47.46.E02.1.454.CMB.1.raw
  modified_base (202)..(202): a, c, t, g, unknown or other
  misc_feature (202)..(202): n is a, c, g, or t
  modified_base (225)..(225): a, c, t, g, unknown or other
  misc_feature (225)..(225): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaangccacatctcctgtagggccgtnagagtattagcatcaacttgcctggtaccagcagacgacctgggcaggcctcccgaggctcctcatcatgatgcatccaacgcgggccacgtggcactcccagcctaggttccagtggcagtgcgtcgtgggacagtagttcactctcacatcaacagcctgctagtctagtaagtattttcgacttagtttattacttgtactagactagttactactaacttaacgtcggaccgtcttaccaccgtttaccggaccgtaacgggtaacctaacggtacgtaacgggaacgtaaacgttaaaccggtaacgtacggtacggtccgttaggaccctaccg

SEQ ID NO: 84805 - DNA, 642 bp, Homo sapiens
  misc_feature: GYAE6OF02IVGHL.47.46.E02.1.454.CMB.1.raw
  modified_base (199)..(199): a, c, t, g, unknown or other
  misc_feature (199)..(199): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctccagagaccactggagaaatagtgatgacgcagtctccagccacctgtctgtctctccgagggaanacgccaccatctcctggtacgggccgtcagagtattagcatcaacttagcctggtaccagcagacgaccgtgggcaggcctcccgaggcctcctcatctatgatcggccgtacccaccgacggggtccctacgtttcggtttccccagtcccgtaggttcgaggttcggctaggtcggacgtcgtgggactaggtacgttccacttcctaccgacctactaccaacgacgtcctagtcgtagtacgtagtaacgttacgttttgacgttagttttacttacgttgtactacgtactaagtactacgtaataccgtcggtccgtacttaccgtacccgttaccgggaaccgtaacgggaccgaacggtaccggtaagggtaaccgttaacggttaaaccgtacgttaggtacggtactaccggacctaacgttactcgttaccg

SEQ ID NO: 84806 - DNA, 678 bp, Homo sapiens
  misc_feature: GYAE6OF02G2A47.47.46.E02.1.454.CMB.1.raw
  modified_base (203)..(203): a, c, t, g, unknown or other
  misc_feature (203)..(203): n is a, c, g, or t
  modified_base (420)..(420): a, c, t, g, unknown or other
  misc_feature (420)..(420): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggcctcccagacgaccactggagaaatagtgatgacgcagtctccagcccacctgtctgtctctccgagggaancgccacatcctccgtggtacgggccgtacagagtatgctatactaactgccgtaggtaccagcaagacgaccgtgggcacggccaccgaggctcctcatctagtgatcgcctccgaccgcgggtcctacgttccggttacccacgtccgtagttcgagtggctaggtcgcgtcgtggactaggtacgttcacttccacgacctataccaaccgtacnccgtgactacgtcgtagtaaagtttctttacgcgtttaaagttttacttaccgtttgtacgtaacgtactaagtttacgtacttaaaccggtacgttccgggtcccgtaccgtttaacccgtaccgttcccgggaaacccgtaacgggtaccctaaccggttacgggttaacggtaaacggttaaaacctttaaaccgggaacttttcgggaccggttacgttaccggaccccgtaacctacgttttcccgttaccgg

SEQ ID NO: 84807 - DNA, 709 bp, Homo sapiens
  misc_feature: GYAE6OF02HXD1U.47.46.E02.1.454.CMB.1.raw
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggcttttttaaaaggtgtccagtgtgaggtgcaactgttggagtcgtgggggagacttagtacacccgtggggggtccctgagactctcctgtgcagcctcgtggactctacctttagctaactctgtcatgggcgtcgggtccgccgacggccgtaccgggggaaggggtcgtgggaggtcgggtctacgtaagttattgatggaagtaagttggtagggaacgcgtaactacttacgtacggtcggacgttacccggtagggtaaccggggtccggttaccaacccgtacttccgtaccgaagacggtaactaaagttttacgaagggtacgccgaacggtcttacggttaacttactaaaccgtaaagtaacgaaacgaacgaccgtaggaacgacggaccggaacggaaccgtaccggtaccgttaattttaacgtttcgtagtacggtaacgtaagttctaacggtacgacctacggttcccgcccccgtaacggtaccgaccgttaccgtttcgtttacgttaccgttcggtaccgggg

SEQ ID NO: 84808 - DNA, 647 bp, Homo sapiens
  misc_feature: GYAE6OF02J1ART.47.46.E02.1.454.CMB.1.raw
  modified_base (183)..(183): a, c, t, g, unknown or other
  misc_feature (183)..(183): n is a, c, g, or t
  modified_base (220)..(220): a, c, t, g, unknown or other
  misc_feature (220)..(220): n is a, c, g, or t
  modified_base (272)..(272): a, c, t, g, unknown or other
  misc_feature (272)..(272): n is a, c, g, or t
  modified_base (347)..(347): a, c, t, g, unknown or other
  misc_feature (347)..(347): n is a, c, g, or t
  modified_base (351)..(351): a, c, t, g, unknown or other
  misc_feature (351)..(351): n is a, c, g, or t
  modified_base (430)..(430): a, c, t, g, unknown or other
  misc_feature (430)..(430): n is a, c, g, or t
  modified_base (459)..(459): a, c, t, g, unknown or other
  misc_feature (459)..(459): n is a, c, g, or t
  modified_base (499)..(499): a, c, t, g, unknown or other
  misc_feature (499)..(499): n is a, c, g, or t
  modified_base (507)..(507): a, c, t, g, unknown or other
  misc_feature (507)..(507): n is a, c, g, or t
  modified_base (540)..(540): a, c, t, g, unknown or other
  misc_feature (540)..(540): n is a, c, g, or t
  modified_base (590)..(590): a, c, t, g, unknown or other
  misc_feature (590)..(590): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcgtggtcgtcttacgtgtcggtctttttaaaggngtccagtgtgagtgcaactgttggagtcgtggggganacgttagtacacccgtgggggtccctgacggactcgtccgtgtgcagtcctntggtactccaccgtttagaccaccttctcgtacacgttggactcgggtccaccgtggccgtacgggggacggtcncggnggtcgggtctacaggttattgagttaggagaagtgggtagaacgtctacgtacttaccgtcggtgaacccggtttcggnggtaaacggggtcccgtttcgaaaccctntccgtaaccgtagagtaacaagttcgaaggcgacgacgtnttacgtanacttaacaactagaacagtaccgtacggaacgnggaccgtaggaaccgccgggaacttgtaacgttgtacgtgaccgtagttnacgtaagccttgaccgtcccctggacctcgtaacctttcgtcttaccgtcgtacggg

SEQ ID NO: 84809 - DNA, 757 bp, Homo sapiens
  misc_feature: GYAE6OF02H13T4.47.46.E02.1.454.CMB.1.raw
tcagagctcacgtacacgaccggtgctcgatttagactcatctacagggaaagggggagtcagtctcagtcaggacacagcatggacatgagggtccccgctcagctcctggggctcctgctactctggctccgaggtgccagatgtgacatccagatgacccagtcctccactccctccctgtctgctatcgtggtaggacgacacgacgtaccaccatccacgttcggacccgggtgagtcgaaggactattagacttaattttatttacgccgtagtactacagacgaacgaaaaccggaggggttaaaacttacccgtaaagccgtttacctaaggtacttactttagttacgttaactacttaccctattttacgacttaaccgggtttccgggtacctaacgtttccgttaccggtttacgaacggttcggaacgtacgggttaggtaacgttcggttaacgggtacgttaacgttacttttaccgactttaccgacctactaacgtacacggtacaccggtaccgtgtaccgaagtaccgtaggaacgtctttcgtagaccttaagttttaacgttagttaaacgtaaaacttaaaacgttaacgtaaaccgtcgtaccccgtaacccgtcgttttaacccgtacggtttacccgggagggttaacccggaacggggttaagttacgggaaactaacgttaaccggtaacggtaaccggttgggtaacggtacgttcgaaccccgttaag

SEQ ID NO: 84810 - DNA, 720 bp, Homo sapiens
  misc_feature: GYAE6OF02JDHWW.47.46.E02.1.454.CMB.1.raw
  modified_base (152)..(152): a, c, t, g, unknown or other
  misc_feature (152)..(152): n is a, c, g, or t
  modified_base (181)..(181): a, c, t, g, unknown or other
  misc_feature (181)..(181): n is a, c, g, or t
  modified_base (191)..(191): a, c, t, g, unknown or other
  misc_feature (191)..(191): n is a, c, g, or t
  modified_base (254)..(254): a, c, t, g, unknown or other
  misc_feature (254)..(254): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcgngcgtctttcgtgtgtactttttaaaggtntctagtgtgnggtgcagtgtgagtgtggggatattagtaccgccgtggggtccctgacgtctctcctgtcgcncgtcctgtcgactctaccgtttacgcctaactctcgtcgtagtcgggtacggtcgggtccgaccgtaggtccgggtcgggggaaggtcgtggtgggtcggtctacgtaaacggttgtggtacgttaggaacggtaaggttgggacgaaagtcgagttacgttccgtacgggtacgtaccggtccggtaagggtacgggttacccgttacgaaccgtctccgtacgacggtaactactaacgtttcgaggacacgtacgtactagtaactactaacgaagttacgaacgttccgacctggtaaacggcggtaccgtaacgggacccttaccgggttaacgtttacttacggttcgttaagggccaaaacgttagtttccgaaggtacggtcctaaccgggttcccccgaaccttaccggtccgttacctttacccgttaaggtttccggttacccgttaggcccggg

SEQ ID NO: 84811 - DNA, 606 bp, Homo sapiens
  misc_feature: GYAE6OF02F7BJB.47.46.E02.1.454.CMB.1.raw
  modified_base (202)..(202): a, c, t, g, unknown or other
  misc_feature (202)..(202): n is a, c, g, or t
  modified_base (225)..(225): a, c, t, g, unknown or other
  misc_feature (225)..(225): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaangccacatctcctgtagggccgtnagagtattagcatcaacttagcctggtaccagcaggacgaccgtgggcaggcctcccgaggcctccctcattcctatgatcggccgtcccgaccgacgggcctacgttcggtttccccaggtcccgtaggttccaggtcggctaggtcgcgtcgtagggacaggtattccactctaccgaactatacaacgacgtccgtacgactacgttcgtagtaacgttactttcgtacttagtttattacgttgtactacgtactagttactactacgtacgtcggtaccgtactaccgtaccgttacgaccgtaaggaccgacggtacgtacggaacgtaacgtaaacgtacgtggtacggtacgtcgacctactacgtcgttacg

SEQ ID NO: 84812 - DNA, 783 bp, Homo sapiens
  misc_feature: GYAE6OF02H7Y09.47.46.E02.1.454.CMB.1.raw
  modified_base (315)..(315): a, c, t, g, unknown or other
  misc_feature (315)..(315): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcacatggagtttggctgagcgtggctctttcgttgtggtactttttaaaggtgtccagtgtgaggtgcactgttggagtcgtggggatacgttagtaccgacccgtgggggtccctagacgtactcgtccgtgtcgctacgcctcgtacggtacctccgtaacctttagacctaacgtcgtagtacngttcgggccgtcgggtccgccgtagggccgtaccggggaagggtccgtggaggtcggtactacgtaagttgtgagttagagtaagtaggtaaggaagctaacgtaacgttacgtacggttaggaccgttacggtacgggaacgggtcccgttacgaaccctagttccgtaaacctggaaaccgtacgttaaacgttcgaacgggtacgaaacccgtcctacgttttaacgaactttaaccgaaaaacgtaaacgttaaggtaaaacccgttcggttaacgtaacggaacccgggtaaacgggtaccccgggtaaaggaaaccccggtaccggggttacccttttaaagtttccgttagtaccggtaacggtaaacgtaacgtttcgtaagtccgaccgttaccggcccccgttaaccctggaccctacgttcccgttttaccgtttaggacccgtttccgggaacggg

SEQ ID NO: 84813 - DNA, 785 bp, Homo sapiens
  misc_feature: GYAE6OF02F5XGG.47.46.E02.1.454.CMB.1.raw
tcagagctcacgtacacgaccggtgctcgatttagactcatctacagggaaagggggctctgagagaggagcccagccctgggattttcaggtgttttcatttggtgatcaggactgaaccgagagaactcaccatggagtttgggctgagctggctctttcttgtggtacttttttaaaggtgtccagtgtgaggtgcaactgttggagtcgtggggagacttagtacacccgtgggggtccctgagactctccgtgtcgcacgcctcgtcggaccttcctacctttagcctaacctctgtcagtcgggcgtcgggtcccgccgtacgggccggtaccggggggaacggggtccgtaggggtacgggttggggttcctacgtaaaggttacgttaggtaagtaggaaggtaaagtaggggttacgggaaagtccgaaaccgtacgtttcgtaacgggttacggtaccgttaccggtacgggtaaccggggtcccggttaccgtaacccgtacgttacccgtacccgtaacggaacgtaaaccgttaacgtttacggacggtacgtaccgaccgtcgttacgttaacgttacctaaacctaaagtaccgaaacgacgtacccgtaggaacggacgggaccggtaaccggaaccgaccgggtaccgttaagttacgttttcggtagttacgtacgttaacgtacgttaacgtacggtaccgtaccgtacccgtacccccggtacgacccgtaccttaccgtttccgttttacgtaccgtttccggg

SEQ ID NO: 84814 - DNA, 592 bp, Homo sapiens
  misc_feature: GYAE6OF02IEDIU.47.46.E02.1.454.CMB.1.raw
  modified_base (228)..(228): a, c, t, g, unknown or other
  misc_feature (228)..(228): n is a, c, g, or t
  modified_base (231)..(231): a, c, t, g, unknown or other
  misc_feature (231)..(231): n is a, c, g, or t
  modified_base (269)..(269): a, c, t, g, unknown or other
  misc_feature (269)..(269): n is a, c, g, or t
  modified_base (395)..(395): a, c, t, g, unknown or other
  misc_feature (395)..(395): n is a, c, g, or t
  modified_base (554)..(554): a, c, t, g, unknown or other
  misc_feature (554)..(554): n is a, c, g, or t
  modified_base (556)..(556): a, c, t, g, unknown or other
  misc_feature (556)..(556): n is a, c, g, or t
  modified_base (560)..(560): a, c, t, g, unknown or other
  misc_feature (560)..(560): n is a, c, g, or t
  modified_base (562)..(563): a, c, t, g, unknown or other
  misc_feature (562)..(563): n is a, c, g, or t
  modified_base (565)..(565): a, c, t, g, unknown or other
  misc_feature (565)..(565): n is a, c, g, or t
  modified_base (567)..(568): a, c, t, g, unknown or other
  misc_feature (567)..(568): n is a, c, g, or t
  modified_base (570)..(572): a, c, t, g, unknown or other
  misc_feature (570)..(572): n is a, c, g, or t
  modified_base (574)..(592): a, c, t, g, unknown or other
  misc_feature (574)..(592): n is a, c, g, or t
tcagagctcacgtacacgaccggtgctcgatttagactcatctacagggaaggggcgtggagtgggtctcaagtattgatgagaatggtggaagcacattctacgtggactccgtgaacgggccggttcaccatctccagagacaatttcaggagctacgctgtatctacaaatgaacagcctgagagccgaggaccacggtcgtatatttctgtcgcgaaagtctanagnagtcgcccccctagcgctactttctttcgactttccgngggggacccaaggggtaatcccgtagggtccaaccggttcctcccacacgtccctccaaccgtaacggcccctagtccgtttcccttccccccgtgggcccctacccgtgcctcccgaaggggacncctaacccgtccgaggaaccgccaaacgcggtccggaccccgttggggacctcggtccccttagggtaccgaacgggtaccttaccgtttccgtaacggtcgtaacgtcctacgtggacggcgggttaccgcgggtacgaacggccgtacgaatacggnancacngnngncnncnnncnnnnnnnnnnnnnnnnnnn

SEQ ID NO: 84815 - DNA, 610 bp, Homo sapiens
  misc_feature: GYAE6OF02IHQH2.47.46.E02.1.454.CMB.1.raw
  modified_base (200)..(200): a, c, t, g, unknown or other
  misc_feature (200)..(200): n is a, c, g, or t
  modified_base (226)..(226): a, c, t, g, unknown or other
  misc_feature (226)..(226): n is a, c, g, or t
  modified_base (365)..(365): a, c, t, g, unknown or other
  misc_feature (365)..(365): n is a, c, g, or t
tcagagctcacgtacacgaccggtgctcgatttagactcatctacagggaaagggggagaactgctcagttaggacccagacggaaccatggaagccccagcgcagcttctcttcctcctgctactctggctcccagagacccatggagaaatagtgatgacgcagtctccagccacctgtctgtctctccgaggggaangccaccatctcctggtagggccgtanagagtattagcatacaaattgcctaggtaccagcagagaccgtgggcaggctccaggtcctcctcatctatgatgctaccaccgacggcctactcggtttcccagccgtagtcaggtcggctagtcgcgtcgtcggacngtaagttcacgtactcacctatacaacgcgacccttggacctagttcctaaggtaagtttacgttttacgaccgtttaaaggttttttacttacgttacggttaccaggtacttaagttacttaacgtaagttaaccgtcggaccgttctacccgttaccgttcgaacgaaggaccgtaagaccggttagaacgttaacgtaaacgtagttaggtcggtacgtacgacctactacgtcgttaccg

SEQ ID NO: 84816 - DNA, 465 bp, Homo sapiens
  misc_feature: GYAE6OF02GGMHS.47.46.E02.1.454.CMB.1.raw
  modified_base (238)..(238): a, c, t, g, unknown or other
  misc_feature (238)..(238): n is a, c, g, or t
  modified_base (352)..(352): a, c, t, g, unknown or other
  misc_feature (352)..(352): n is a, c, g, or t
  modified_base (411)..(411): a, c, t, g, unknown or other
  misc_feature (411)..(411): n is a, c, g, or t
  modified_base (438)..(438): a, c, t, g, unknown or other
  misc_feature (438)..(438): n is a, c, g, or t
  modified_base (441)..(465): a, c, t, g, unknown or other
  misc_feature (441)..(465): n is a, c, g, or t
tcagagctcacgtacacgaccggtgctcgatttagactcatctacaggggaaagggccaccatctcctgtagggccggtcagagtattagcatcaacttagcctggtaccagcagagacctgggcaggctcccaggctcctcatctatgatgcatccaacagggccactgacatccccagccaggttcagtggcagtgagtctgggacagacttcactctcaccatcagcagcctagngcctgaagattttgctactttattactgtcagcagcgtagcaactggccctctcacgtttcggcggagggaccgagggtcggagatcgagacgtaacgtggtaggctgcacctntctgtcttctcttccttcccgcctactctgtactacgtgactctcgtgacggcgggtcncgggacgaacggtccgatacgtagctncgnnnnnnnnnnnnnnnnnnnnnnnnn

SEQ ID NO: 84817 - DNA, 608 bp, Homo sapiens
  misc_feature: GYAE6OF02IXPTY.47.46.E02.1.454.CMB.1.raw
  modified_base (202)..(202): a, c, t, g, unknown or other
  misc_feature (202)..(202): n is a, c, g, or t
  modified_base (472)..(472): a, c, t, g, unknown or other
  misc_feature (472)..(472): n is a, c, g, or t
tcagagctcacgtacacgaccggtgctcgatttagactcatctacagggaaagggggagaactgctcagttaggacccagacggaaccatggaagccccagcgcagcttctcttcctcctgctactctggctcccagagaccactggagaaatagtgatgacgcagtctccagccacttgtctgtctctccgaggggtaaangaccaccatcctcctggtacgggccggtcagagttattagctatcaacttgccttggtaccagcagagaccgtgggcaggcctaccgaggcctcctcatctatgatcgccgtccaccgagggcctacgttcggttcccagccgtaggttcaggtcggctacggtgccgttcgtagggactaggtacgtttcacttcctccacccgtatacaaaccgcgcctagctagttctaggtaattattttgacgttagttttaacttactgtaacngtctaagttactctaataaccgcggtcctaccttacctacccgttcggaccgtaacgggacctacggtacggtaggaacttaacggtaaacgtaccgtaggtacgtaccgtacgtaccgaaccttcgtagttaccg

SEQ ID NO: 84818 - DNA, 605 bp, Homo sapiens
  misc_feature: GYAE6OF02I75RU.47.46.E02.1.454.CMB.1.raw
  modified_base (307)..(307): a, c, t, g, unknown or other
  misc_feature (307)..(307): n is a, c, g, or t
  modified_base (468)..(468): a, c, t, g, unknown or other
  misc_feature (468)..(468): n is a, c, g, or t
  modified_base (481)..(481): a, c, t, g, unknown or other
  misc_feature (481)..(481): n is a, c, g, or t
  modified_base (486)..(486): a, c, t, g, unknown or other
  misc_feature (486)..(486): n is a, c, g, or t
  modified_base (523)..(523): a, c, t, g, unknown or other
  misc_feature (523)..(523): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttctgtggtctttttaaaaggtgtcagtgtgaggtgcaactgttggagtcgtgggggagacttagtacgacccgtggggggtccctgacgactctcctgtgcagcctctggacctcacctttagccaactctgcagtcgggctcgggccnccgaggccgtccgggggaagggcgtgggagtcgggtctacgaagttatgatgaagagtgggtagaacgcgactattcgtacggtcgacgttccggtaggaacgggtccggttcaaccgtacttccgccaaggacgactaaagtttcgaggactcaacggtntacgtactacaanaagtnaactgtactggagacgccgaggacaccgggcttaatntttcgagtcgaacgaatctaagtcacgtagtccctaccccgtagccttaccgtacgtttcttacgtccgttaggtaccgggg

SEQ ID NO: 84819 - DNA, 818 bp, Homo sapiens
  misc_feature: GYAE6OF02GGU9K.47.46.E02.1.454.CMB.1.raw
  modified_base (184)..(184): a, c, t, g, unknown or other
  misc_feature (184)..(184): n is a, c, g, or t
tcagagctcacgtacacgaccggtgctcgatttagactcatctacagggaaagggggctctgagagaggagcccagccctgggattttcaggtgttttcatttggtgatcaggactgaaccgagagaactcaccatggagtttggctgagctggctctttcttgtggttactttttaaaaggtntccgagttgtgaggtgctaactggttggagtcgtgggggagtacttagtaccgacccggtgggggtccctgacgactcctccgtgtcgcacggtcctcgtcggtacctacctaccgtttagacctaacctctgtcaggtcgggtcgtcgggtcccgtccgacgggtcccggtacgggggaaggggtccgttaggggtacgggtcggggttcctaacggaaaggtttagttacgggtaagttaagggtaaggtaagttcggggtaggaaacgtctaacgttactttacggtaaccggtggtaacccgtccggtagggtaaaccggggtcccggttaaccacccgtacgttacccgtaccggtaacggtaacgtaaccttaacgtttaacggaacggtaccggaccgtaccggtacgttaacggttaacttaaccgtaaacgtaaacgtaccgaaacgtacgtaccgttacggaacggtacgggaccggtaacgggaaccgtaaccgggtaccgttaacgttacgtttacgttacggtacgtacgttaaacgttacgtaacgtacgtacgtaccgttacccgtaccccgtacgaccgttaccgttacctttacgtttaccggttaccgttaccggg

SEQ ID NO: 84820 - DNA, 677 bp, Homo sapiens
  misc_feature: GYAE6OF02HL6GS.47.46.E02.1.454.CMB.1.raw
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggtactttttaaaggtgtcctagtgtgtaggtgacaactgttggagtcgtggggagacgttagtaccgaccggtcgggggtccctggagtactctcctgtgcacgtcctgtcgactctacctttagctaactctgtccgagtcgggcgtcgggtcccgcccgtagggcccggtccgggggaagggcgtgggaggttcgggtctacgtaagtagttacgagtagagtaagtgggtagaagcatacttcgtaggtcgacgttcggtaggaaccggggtcccgtacgaccgtgtcctacgagactaactaagtttcgagcgacgacgtctagtactacgtaactaagtacgaacctagtaccgtaggacgtacgtacccgaggtacccgacgggtaccttagttacttcggtgtacgtaacgtagttagtacgttaacggccgttaacggtccccgttacccccgtagtcccgtacgttaccttttccgttaccggttcgttccggggtaaccggg

SEQ ID NO: 84821 - DNA, 711 bp, Homo sapiens
  misc_feature: GYAE6OF02H5WGJ.47.46.E02.1.454.CMB.1.raw
  modified_base (203)..(203): a, c, t, g, unknown or other
  misc_feature (203)..(203): n is a, c, g, or t
tcagagctcacgtacacgaccggtgctcgatttagactcatctacagggaaagggggaggaactgctcagttaggacccagacggaaccatggaagccccagctcagcttctcttcctcctgctactctggctccagataccatcggagtaagttgtgttgacacagtctccagcccacctgtctttgtctccgaaggggaancgccaccctctcctgcgacgggcagtcagaatattcactcctattacgcctaggtaccaacagaaacctggtacacggcctacccgaggtcctcctacattccgtaagtcgatcgactactaccgaaacgtcgggacctacggtggacctaacgtacccgaaggtaactacggggttaccaggtcggacgtagggtttcgggtactacggggaaacctacggtaactttcccgaacttacctacctaaaccctagttacccgaagtccgaagtcccgttaaggaccgtacccgttaaggtaaacgttaccgtttaggttaacctttttaacgttccgttacgtaccgaaggttacctaggttaccggtacgttacggttccgtacccggtaccttacccggtcttcccgttacggttcgggaacggtaccgggacgtagggtagacgtaacgtaacggaaacgtcggtagtcgacgtacgaccgaactaccgttgttacgtcttaccg

SEQ ID NO: 84822 - DNA, 697 bp, Homo sapiens
  misc_feature: GYAE6OF02IQRDF.47.46.E02.1.454.CMB.1.raw
  modified_base (201)..(201): a, c, t, g, unknown or other
  misc_feature (201)..(201): n is a, c, g, or t
  modified_base (230)..(230): a, c, t, g, unknown or other
  misc_feature (230)..(230): n is a, c, g, or t
  modified_base (269)..(269): a, c, t, g, unknown or other
  misc_feature (269)..(269): n is a, c, g, or t
  modified_base (278)..(278): a, c, t, g, unknown or other
  misc_feature (278)..(278): n is a, c, g, or t
  modified_base (290)..(290): a, c, t, g, unknown or other
  misc_feature (290)..(290): n is a, c, g, or t
tcagagctcacgtacacgaccggtgctcgatttagactcatctacagggaaagggggaggaacgtgctcagttaggaccagacggaaccatggaagcccagcgcagcttctcttcctcctgctactctggctccagacgaccactggagaaatagtgatgacgcagtctccagccacctgtctgtctcgtccgagggaaancgccaccattctccgtggtagggccggtnagattagttcgcatcattacggcctggtaccagcagganaccgtgggnacggctacccgnggctccacatctagtcgatcgcctccgacgaggccacgttggttacccaggaccgtaggttcagcgggtactacggtgcccgtttgacgggggaactaggtacgttttacccgaaccttttcccgaacgtaaaccctaggtaaccctaaacggtaccggtacccgttacggtaccgttacggttaccgttaaacgggttaacgttaacggtttttacggtacgttaacgtttttaccgttacgttacggttacgtacggtactaacgttacttactacgtaacgttcggaccttacgttaccgtaccgttaccggaacgaaccggtacgaaccggtacggtaacggaacgttaacggtaaaccgttacggtaggttcggtccgtagaccgtaccttgtaccgttccg

SEQ ID NO: 84823 - DNA, 751 bp, Homo sapiens
  misc_feature: GYAE6OF02JBUJ4.47.46.E02.1.454.CMB.1.raw
  modified_base (202)..(202): a, c, t, g, unknown or other
  misc_feature (202)..(202): n is a, c, g, or t
  modified_base (299)..(299): a, c, t, g, unknown or other
  misc_feature (299)..(299): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctttgtctccgaggggaanacgccaccctctcctgcagggccagtcagaatatcactcctattagcctggtaccaacagaacctggccaggcctccgaggcctcctcatcgtaggntcgcacgtacccaacggacggggcccgcgtcgggaccaccgtaccccgaggtaccccggtaaggtttccgaagggttcggaccgtacggggtttcggggtaccggtcggggggaacctaggttaccgtttaccgacctttccgtaacctacccgaactcgacgaccacgtacccgtaaggacgtaccgtacggtaagtttcgtttagacgtttaagttttaacgttaccttggtaccgtaacgtaccgtaaacggttaaagttacggttaccgggacccttcccggtaccttaccggttaaccggttttccgggggacgggtacccggggtaaccgggtacgggggtaaccggtacgtaacgttaacgggaaaacttaccgggttacgggtacgggtacgttcccggaactaccgtaccggtttcgttaccgtttacccgttacgttacccg

SEQ ID NO: 84824 - DNA, 747 bp, Homo sapiens
  misc_feature: GYAE6OF02F2TYV.47.46.E02.1.454.CMB.1.raw
  modified_base (167)..(167): a, c, t, g, unknown or other
  misc_feature (167)..(167): n is a, c, g, or t
  modified_base (178)..(178): a, c, t, g, unknown or other
  misc_feature (178)..(178): n is a, c, g, or t
  modified_base (193)..(193): a, c, t, g, unknown or other
  misc_feature (193)..(193): n is a, c, g, or t
  modified_base (297)..(297): a, c, t, g, unknown or other
  misc_feature (297)..(297): n is a, c, g, or t
  modified_base (305)..(305): a, c, t, g, unknown or other
  misc_feature (305)..(305): n is a, c, g, or t
  modified_base (377)..(377): a, c, t, g, unknown or other
  misc_feature (377)..(377): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcgtgcgtcttagtgtcgntttttaaaggngtccagtgtgagtgnaactgttgagtctgggggagacttagtacacccgtggggggtccctgaggactctccgtgtggctagcctctggactctaccttagctaactctgtacatggcngggttccnccgtaggctaccggggaaggggctcggagtgggtctcgtaagtagtgtaatagtaggtaagtggtggggaanccgtaatagttacctaacggtacggtacttaccgggtagtaacgggggtaccccgggtttaccaccgtaacggtcccttaacccgtaggtaaacccagtaaaccgttttaccgaaggttacggaccgtaacgacccgttaggtattaaccttaaccgtaaactagtaaacccgaaggttcctaaggaacgtaacggtacccggacgggtaacccgtaaccgggtcccggttaaatttacgttcgtttacgggtactacggggtaaacgtttcgtaaggtaacgtacgttaaccggtacccggaccccccgtttaacggcccgtacgttccccgttttaagttccggttaccgttaccgggttaaccgggg

SEQ ID NO: 84825 - DNA, 618 bp, Homo sapiens
  misc_feature: GYAE6OF02GD7LF.47.46.E02.1.454.CMB.1.raw
  modified_base (150)..(150): a, c, t, g, unknown or other
  misc_feature (150)..(150): n is a, c, g, or t
  modified_base (198)..(198): a, c, t, g, unknown or other
  misc_feature (198)..(198): n is a, c, g, or t
  modified_base (270)..(270): a, c, t, g, unknown or other
  misc_feature (270)..(270): n is a, c, g, or t
  modified_base (384)..(384): a, c, t, g, unknown or other
  misc_feature (384)..(384): n is a, c, g, or t
  modified_base (563)..(563): a, c, t, g, unknown or other
  misc_feature (563)..(563): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactgganaaatgtgatgacgcagtctcagccacctgtctgtctctccgagggaancgccacgatcctcgtggtaggccgtcaggtagttagtacgcatccgtaaacttggcctaggtaccagcaagngaccgtgggcacggctccgaggtcctccgtacattcgtatggtacgtcgtccgtaccgacgacgggtaccctagttccggttacccgagtcccgtaggttcgaggtcggtacgngttacggcgtacgtagggactaggtacgtctcctcgtacctaaccgagtcgtaacgcgtctacgacgtagtacgtaacgttagtactttacgtacgttaagtttacgttacgtagtcagtaccgtaagtactacgtactacgtcgcgttacctccgtacgtaccgacgacgtcaacggngtacgacgttaagtaaccgtagtacgtagtacgtacgacgtacctagtcgttacg

SEQ ID NO: 84826 - DNA, 739 bp, Homo sapiens
  misc_feature: GYAE6OF02F50DF.47.46.E02.1.454.CMB.1.raw
  modified_base (299)..(299): a, c, t, g, unknown or other
  misc_feature (299)..(299): n is a, c, g, or t
  modified_base (514)..(514): a, c, t, g, unknown or other
  misc_feature (514)..(514): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggcttctttcttgtggtcttttttaaaaggtgtccagtgtgaggtgcaactggttggagtcgtgggggagacttagtacacccggtgggggtccctgacgacttctcctgtgcagtcctctggacctctacctttacgcaaccgtctntcaggtggcgtcgggtcccgaccgcggcggtccggggggaagggtcgtggggaggttcgggtctacggtaagttagttgagtaggaaggtaagttgggaggtaacgcctacgtaactttcgtacgggtacggaccgttccggtagggaacggggtcccggttacaccgtactccgtaccgaaggtaaccgtaacttaacgtttacgaacgggtanaccggacgttcgtacgttacctaacgttaaaacaagttagaaaccgtagtttccggaggtaaacgccgggtaccgaacggggtaaccgtaccgggtaccgtttattaacctttcgtaggtacgtaacggttacgttccgaatacggtccttaccgggtacccggtaccccctaggtacccgtccttacgttttacccgttcgttacccgggtcgggtaacccggg

SEQ ID NO: 84827 - DNA, 729 bp, Homo sapiens
  misc_feature: GYAE6OF02G7NGY.47.46.E02.1.454.CMB.1.raw
  modified_base (205)..(205): a, c, t, g, unknown or other
  misc_feature (205)..(205): n is a, c, g, or t
  modified_base (235)..(235): a, c, t, g, unknown or other
  misc_feature (235)..(235): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtcctccagcccaccctgtcctgtctctccgagggaaanacgccaccatcctcctggtacgggcccgtnaagtagttaattagcatacaaacttgccgtaggtaccagacagacgtaccgtgggacaggcctaccccgaggtcctcctacgacttacctagtcgtacgtcggtccgtacccgaaccgacgggtccctaccgttacggtttccccaagtccgtaggttacgtaggtcgggacgtagtcggtacggttcggagggaaccgtagtacgttccacttccgtacaacctactaccaaacctacgtacctaggacctaggttcgtaagtaaacgtttatttgaaccgtttaattttacttacgttagtacctaagtaccttaagtattaaccgtacttaccgggtccgtaacccgttcctaaccgtttacccgtaccgggtaaccgaaagggaccctaacgggtaaccggtacgggttaaaacgtaaacgtttaaaacgggtacccgtttaggtaccgggtacctacggttaaccctaccttacggttacttaacccgg

SEQ ID NO: 84828 - DNA, 633 bp, Homo sapiens
  misc_feature: GYAE6OF02I2Q7F.47.46.E02.1.454.CMB.1.raw
  modified_base (220)..(220): a, c, t, g, unknown or other
  misc_feature (220)..(220): n is a, c, g, or t
  modified_base (266)..(266): a, c, t, g, unknown or other
  misc_feature (266)..(266): n is a, c, g, or t
  modified_base (397)..(397): a, c, t, g, unknown or other
  misc_feature (397)..(397): n is a, c, g, or t
tcagagctcacgtacacgaccggtgctcgatttagactcatctacagggaaagggggctctgagagaggagcccagccctgggattttcaggtgttttcatttggtgatcaggactgaaccgagagaactcaccatggagtttgggctgagctggctctttcttgtggcttttttaaaaggtgtccagtgtgaggtgcaacgtgttggagtctggggganacttagtacacccgtgggggtccctgagactctcctgtgcagcctntggctcaccttagcaactctgtcatggctggtccgcaggtcgtccggggaagggctgggagtgggtctcaagtgttgatgagagtggtagagcacattcgacgtgaccgtcgtgacgggtccgtacacctntcctacgagacgactaagttcgacggtagcgacgtcgtcgtactacaactaagtgtaacgcgaacctcggaagtacgacggaacggtaccggaaccgggtcccgttaagttaccttttacgacggtttacgacggttaaacggttccgttaaggtaaccgacgttaacgttaccccggaccccccggtacgaccgttcccgtaacgttttacccgtttcggtaaccctttccgggg

SEQ ID NO: 84829 - DNA, 776 bp, Homo sapiens
  misc_feature: GYAE6OF02F9RZI.47.46.E02.1.454.CMB.1.raw
  modified_base (204)..(204): a, c, t, g, unknown or other
  misc_feature (204)..(204): n is a, c, g, or t
  modified_base (230)..(230): a, c, t, g, unknown or other
  misc_feature (230)..(230): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagcccaccctgtctgtctctccgaggggaagngccaccatcctccgtgtagggccgtnagtagtattagcatacaacttagcctggtaccagcagagaccgtgggacaggccctacccgaggcctcctactactcgtagtgacgtgcctaccgacgtacgggacctacgttccggtttacccaggtccgtaggtttaccaggtttcggaccgtaaggtccggtcggtttccggacggggaacgtacggttaacgtttaccccgtactttcccgtacccgaacccgtattaacccgaaacctaccggtacccgttaggaccgttaacgggttacttaaggttaacggttttacgttttacggtaacgttttaacgttttagtttaccgttggttaacctacggttacgttaacggtaccttaacgacgtttaaccggtccggtaccgttaacccgttcccgttaccccggtaacccggggtacccgtaaacgggtaccccgtacggtaaccggtacgggaaaccggtttaaacgttaaaaccgggttaccgttacgggtacgttaccgttaaccggacccttaaaccggtcgtttaccgttccgg

SEQ ID NO: 84830 - DNA, 707 bp, Homo sapiens
  misc_feature: GYAE6OF02F3QJH.47.46.E02.1.454.CMB.1.raw
  modified_base (221)..(221): a, c, t, g, unknown or other
  misc_feature (221)..(221): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggtcttttttaaaaggtgtccagtgtgaggtgctaactggttggagtcgtggggganacttagtacacccgtgggggggtccctgagacctctccgtgtgcagtcctctcggactctacctttgcaactctgtcagtcgggctgggtccgccacggccgtccggggggagggtctgggtaggtcgggtctgtaaagtattgatgagagtgggtagaagcacgtattcgtacgtaggtacctcggaggtaacgggtcccggtacaccgtatccgtcgaagtacgtactaagttcaagggtacacgtacgcgttagttacgaccttaaagaaacttcggaaacctaggttctagggaactccggaccgggtaacggaaccgacccgggttactttaacgtttaactttccgggttaggtacctaacgggtttaacgtccgttaagtaacgggtacccgtaaagggttcccccgaaccccttacgggacccgtaccgtttacctttttccggtaaccgtttacccgggtttacggtacccgggggg

SEQ ID NO: 84831 - DNA, 617 bp, Homo sapiens
  misc_feature: GYAE6OF02I458S.47.46.E02.1.454.CMB.1.raw
  modified_base (305)..(305): a, c, t, g, unknown or other
  misc_feature (305)..(305): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggtcttttttaaaaggtgtccagtgtgaggtgcaactgttggagtctgggggagacttagtacacccgtggggggtccctgagactctcctgtgcagcctctggactctacctttagcaactctgtcatgggctgggtccnccaggcgtccgggggagggctggagtgggtctcgaagtatgatgagagtggtggaagcatattcgtacgtggacgtccgtaggaagggtcccgttacacctatccgtaccagaacgtactaatttccgaggacgcacggcttacgtatactaactaaatacgaaactacgcctaggacgacggaccgaaggaaccgacggtaccgttattacgtttcctagtcgaacgtaagttccgtaagtacggcctagtccccgtacccccgtaacggccgtaccttactttccgtttcggtacccttacggtccgggg

SEQ ID NO: 84832 - DNA, 657 bp, Homo sapiens
  misc_feature: GYAE6OF02GR0B0.47.46.E02.1.454.CMB.1.raw
  modified_base (182)..(182): a, c, t, g, unknown or other
  misc_feature (182)..(182): n is a, c, g, or t
  modified_base (202)..(202): a, c, t, g, unknown or other
  misc_feature (202)..(202): n is a, c, g, or t
  modified_base (315)..(315): a, c, t, g, unknown or other
  misc_feature (315)..(315): n is a, c, g, or t
tcagagctcacgtacacgaccggtgctcgatttagactcatctacagggaaagggggaggaactgctcagttaggacccagacggaaccatggaagcccagctcagcttctcttcctcctgctactctggctccagataccatcggagaagttattttgacacagtctccagcccacccgtntttcgtctccgaggggaaangccaccctctcctgcgacgggccagtcagtagtattagcacgcaacttacgcctggtaccagcaacgtaaaccgtgggctaggcctccgaggcctccgtcattctagtggtcncactcccgacgaggccaagtgtactcccgagccgtagggttcaggtcgacaggtcgggtactgggacagtcgttccacgtctcgaacatccgagcacgtcctagcgtagtacgtagtaagttctttacgactttaaattttacgttacgtacgtcgtaagtactaacgttaaattaacgttaaccgtcggtaccttccggtaacgttcccggaacggtaaccgggtactaaccggtaacgtacggtaaacgtaacgttaaaccggaggttcggtacggtaccggttacgaaccgtaacgtacgttcgttaccgttacgtttacctaccgttccgttaccccg

SEQ ID NO: 84833 - DNA, 727 bp, Homo sapiens
  misc_feature: GYAE6OF02JJGF4.47.46.E02.1.454.CMB.1.raw
  modified_base (168)..(168): a, c, t, g, unknown or other
  misc_feature (168)..(168): n is a, c, g, or t
  modified_base (202)..(202): a, c, t, g, unknown or other
  misc_feature (202)..(202): n is a, c, g, or t
  modified_base (465)..(465): a, c, t, g, unknown or other
  misc_feature (465)..(465): n is a, c, g, or t
tcagagctcacgtacacgaccggtgctcgatttagactcatctacagggaaaggggagaactgctcagttaggacccagacggaaccatggaagcccagcgcagcttcgtcttcctcctgccttactctggctccagtagaccagtgagaaatgtgatgacgcagtcncagccaccgtgtctgtctacgtcgaaggggtaancgcctacacttcgtcctggacggccggtacaaggttacgttatacgctaataccaaacgtttcgccgttaggtaccaggactacggaacgtcggtacgggtcaacggttccctacccggtaacggtcctacccgttacggtcttacggtaacgtcgtacgtcctaccggaccaggaccgttcctacggttcggtttacccaggtacccgtgttacgagttcggactaggttcacgtcgtaacggctaggtcttacgcttaccnctacgtactaccaaacggtctacgtacgtacgtcgttactacgttaagtcgtttacgtacgttacggtttacttaacgtgttaaaccgtcgtagtacgtttataacgttaccgtaccgtacgttccgtaccgtttaccgaccgtttaccggaaccggttaaccggtacgtaacccgtttaggtacggttaaaccgtacgttaaaccggagttttaccgggaccttacgttacccgggacttacggttacgtacgttttaccg

SEQ ID NO: 84834 - DNA, 594 bp, Homo sapiens
  misc_feature: GYAE6OF02FHNQG.47.46.E02.1.454.CMB.1.raw
  modified_base (205)..(205): a, c, t, g, unknown or other
  misc_feature (205)..(205): n is a, c, g, or t
  modified_base (373)..(373): a, c, t, g, unknown or other
  misc_feature (373)..(373): n is a, c, g, or t
  modified_base (399)..(399): a, c, t, g, unknown or other
  misc_feature (399)..(399): n is a, c, g, or t
  modified_base (404)..(404): a, c, t, g, unknown or other
  misc_feature (404)..(404): n is a, c, g, or t
  modified_base (419)..(419): a, c, t, g, unknown or other
  misc_feature (419)..(419): n is a, c, g, or t
tcagagctcacgtacacgaccggtgctcgatttagactcatctacaggggaaagggggaggaactgctcagttaggacccagacggaaccatggaagccccagcgcagcttctcttcctcctgctactctggctcccagagaccactggagaaatagtgatgacgcagtctccagcccaccctgtctgtctctccgaggggaaangccacatcctcctggtagggccgtcagagtattagcatcaacttgcctaggtaccagcagacgacgtgggcaggcctcccgaggtcctcctcatctatgatcgcctaccacgcggacctacgttcggttcccagtcctaggttcaggtgctaggtcgtcgtgtcgganagtcttcactcgtcaactatacaacngtccngcagtctagtaattnttgacttagtttattacgtgtacagtactagtctacgtaagtaccgtcggtaccttctaccgttaccgttccggaaccgtaacgggtaccaacggtacggtaacggaacgttaaacgttaaaccggtacgtaggttacggtcctaacggtaccctaaccgttagttaccgttacg

SEQ ID NO: 84835 - DNA, 599 bp, Homo sapiens
  misc_feature: GYAE6OF02FLAGJ.47.46.E02.1.454.CMB.1.raw
  modified_base (355)..(355): a, c, t, g, unknown or other
  misc_feature (355)..(355): n is a, c, g, or t
  modified_base (460)..(460): a, c, t, g, unknown or other
  misc_feature (460)..(460): n is a, c, g, or t
tcagagctcacgtacacgaccggtgctcgatttagactcatctacagggaaagggggctctgagagaggagcccagccctgggattttcaggtgttttcatttggtgatcaggactgaaccgagagaactcaccatggagtttgggctgagctggctctttcttgtggtcttttttaaaaggtgtccagtgtgaggtgcaactgttggagtcgtgggggagtacttagtaccacccgtggggggtccctgagactctccgtgtgcacgcctctggacctctacctttagacctaactctgtcagtgggcgtcgggtccgccgagggccgtccgggggaagggctgggagtggtcngaagtatgatagagaagtggtagaagcactattcgtacgtggacctcggtagaacggggtcccgttcaccatcctaccagacgtactaatttcgaggacgcacgntagtatactaacaaatcgaaccagcctagagacgccggagaccgacggtctagttacttcgtgacgtacgtaagtcgtaagtagcgtacgtacccgtccccggacgccgtaccgttacctttcgttacgtccttacggg

SEQ ID NO: 84836 - DNA, 837 bp, Homo sapiens
  misc_feature: GYAE6OF02H8CRY.47.46.E02.1.454.CMB.1.raw
  modified_base (207)..(207): a, c, t, g, unknown or other
  misc_feature (207)..(207): n is a, c, g, or t
  modified_base (497)..(497): a, c, t, g, unknown or other
  misc_feature (497)..(497): n is a, c, g, or t
tcagagctcacgtacacgaccggtgctcgatttagactcatctacagggaaagggggaggaactgctcagttaggacccagacggaacatggaagccccagcgcagcttctcttcctcctgctactctggctccagagaccactgggaagaaatggtagatgacgcagtcctccagccaccctgtctgtctctacggaaggggaaancgccaccatcctcctggtacgggccgggtacaggtagtacttagactataccgtaactttacgcccgttagggtaaccaggtacgaacggacggtaacccgtggggctaacggggtcctaccccgaagggtcccttaccctactacttccttaagtaggtataccgggccttacccggaaccggacggggccctaacggttccggttccccgaacggccgtacgggttcgacgggtcggtactacgggtcggtaccggtcgggttagggaaccgaggttacgttaacccncccgtttacgacctaacccttaacgtacccgtaaacgtaccggttacccgtgtaacccgtaggttcgttaaacggtaacggttttaggtttttaccggaaccgttttaggtttttaacttacgttacgggttctaacgggtacttacgggtttaactactaacgtttacggtaccggtaccctccgtttaaccgttacccggtaccggggtaaaccgaaccggggttaccgacggtttaacccgggaaggttaaccgtaaaacgtttaaacccgggtaacggttcggttacgggtaaccgttacgtaaccccgttagttacccggttacgttttacccgg

SEQ ID NO: 84837 - DNA, 749 bp, Homo sapiens
  misc_feature: GYAE6OF02JO1MZ.47.46.E02.1.454.CMB.1.raw
  modified_base (203)..(203): a, c, t, g, unknown or other
  misc_feature (203)..(203): n is a, c, g, or t
  modified_base (275)..(275): a, c, t, g, unknown or other
  misc_feature (275)..(275): n is a, c, g, or t
  modified_base (432)..(432): a, c, t, g, unknown or other
  misc_feature (432)..(432): n is a, c, g, or t
tcagagctcacgtacacgaccggtgctcgatttagactcatctacagggaaagggggaggaactgctcagttaggaccagacggaaccatggaagccccagcgcagcttctcttcctcctgctactctggctcccagagaccacgtggagaaatagtgatgacgctagtctccagccacctgtctgtctctccgaggggaaancgcctacatcctctggtacgggccgtacagtagtacttagccactactaacgtttacgcccttaggtaccancgagacgtaccgtgggcgacggtcctaccccgtaggcccttcctactactctagtgtacgtcggaccgttaccgaaccgtggggtaacctacggttccgtttacccccgaagtcccggtaggttaccaggttgggacgtacgtcggacggttacggngggaaccgtagggtccgtttaccaattcccacctacccaacgtacgtaaacccgccgtaccgtacgtacgtacggttaccgtaaggttaacttacggttttacgtaacgttttacggttttaataccgttaagtccgtaaacgtcgtaaacgtttacaccggttaactacgttacgggtaccttccttaaccggtaccttaacgggaaccgtaacggggtaaccaacgggtacggtaaacggttaaggttaaaccgttaaaccggtcgttaaccggtaccggtgtaacccgggactaaacccgttcgttaggtaccg

SEQ ID NO: 84838 - DNA, 810 bp, Homo sapiens
  misc_feature: GYAE6OF02H7KU0.47.46.E02.1.454.CMB.1.raw
tcagagctcacgtacacgaccggtgctcgatttagactcatctacagggaaaggggtctgagagaggagcccagccctgggattttcaggtgttttcatttggtgatcaggatgaaccgagagaactcaccatggagtttgggctgagcgtggctctttcgttgtaggtcttttttaaaaggtgtcctagtgtgaggtgcaactgttggagtctgggggagacttagtacacccgtgggggtccctgagactctcctgtgcacgcctcgtggaccttcctacccgtttagacctaaccttcctgttcagttcgggtcgtcgggtcccgccgagggcccggtaccggggggaaggggtccgtgggagggttcgggtcctacggtaagttagttcggaagtaggaggtaaaggtggggtagggaaacggtacctaactagtttaccgtaacggttcgggtaccgttacccgggtagggtaaccggggttcccggtttacccgtaaccgtaaccgtttcccgtacccgaagggaaacggtaaccttaaagttttacgagggtaacgcctacgttcgtttacgtaactttaacctaaacgtaaaagtacgaaaccttcgggttactaacggaacgggtaacggaccccgggaacgggaacccgtaccggggtaccttaaagttttctttcggtacgttagtaacgttaaacgttcgttaaagtcgtaaccgtacggtccccgttaaccccccgtacggcccgttacctttacccgttttcggttttaccgttacccggttcggttacccggggg

SEQ ID NO: 84839 - DNA, 832 bp, Homo sapiens
  misc_feature: GYAE6OF02G8X15.47.46.E02.1.454.CMB.1.raw
  modified_base (204)..(204): a, c, t, g, unknown or other
  misc_feature (204)..(204): n is a, c, g, or t
tcagagctcacgtacacgaccggtgctcgatttagactcatctacaggggaaagggggaggaactgctcagttaggacccagacggaaccatggaacgccccagcgcagcttctcttcctcctgctactctggctcccagagaccacgtggagaaatagtgatgacgcagtctccagccacctgtctgtctctccgaggggaanacgccacatcctcctggtacggcctgacagagtattagctatccaaacttcgcctaggtaccagaccaaggacgaaccgtgggccagggcctacccgaggccttcccgcaacttccgtatgtatcggcctaccacggacggcctacgttcggtttaccccagtccgtacggtcgaggtcgcgtaggtcgtccggtacgtcgggactacggttacgttaccaccgttacctacgaaccctactaaccgtaaccgtaccggtaccctacggtacgtaacggttaccgtaaggtaaacgtttaccgttttacggttaccgttttaaacggtttttaaccgttaaccgtttacgtacgttaaccggttacccgttaaagttaaccgtttaaccgtaacgttaaacccggttccgggtaaccctttacccggttacccggtttaaccccgttaaccccggggtaaacccgggttaaaccccgggttaaccggtaacccgggttaaacccgggtttaaaacgggttaaaccgggtaaacccgggtttaaaaaaccggttaccggttaaccggggtttaaccgggacccggttttaaccggaacccgttaacccggttaccggttttaaccccgg

SEQ ID NO: 84840 - DNA, 681 bp, Homo sapiens
  misc_feature: GYAE6OF02HHDMJ.47.46.E02.1.454.CMB.1.raw
  modified_base (202)..(202): a, c, t, g, unknown or other
  misc_feature (202)..(202): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccgaggggaangccacatctcctgtacgggccgtcagtagtaatagcatcaacttgcctaggtaccagcagagaccgtgggcaggctcccgaggtcctcctcattctatgatcgaccactaccaaacgtacggggccctaacgtcgggacctacgtacccccgaggtacccgtaagggttccaggggttcgggacaagggttcggtaacgttccgggtacggggaaccaagggtacccttttaccgaacgttccgtacctaacccgtataccgaacgtcgacgtaccgtacgacgtaccgtagaagttacttttacgacttaacttttaacgttacttgtacgtagtacgacggtacgtacgtactaacgtccggtacctccgtacgttaccggttacgggacgggtaccgggaacggtacggggtacggaacgggtagtaccggaacggtaaccggtaacggttacggttacggtccgttacggacccg

SEQ ID NO: 84841 - DNA, 689 bp, Homo sapiens
  misc_feature: GYAE6OF02IXEE3.47.46.E02.1.454.CMB.1.raw
  modified_base (473)..(473): a, c, t, g, unknown or other
  misc_feature (473)..(473): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttctgtggtcttttttaaaaggtgtccagtgtgaggtgcaactgttggagtcgtgggggagtacttagtacacccgtggggggtccctgacgactctcctgtgcagcctctcggactcaccgtttagcaactctgtcagtcgggacttcgggcccgccgaggccgtccggggggaaggggcgtgggaggtgggtctacgaagtacttggagtgagaagtgggtaggacgcgaactattcgtacggtcgacgttcggtagaacgggtccggttaccaccgtaactcgtaccaggtaacaacgtatttcgaagggacnccgacgtctacggtactactaaacaatacgaacacgtcctaggagacgtccggaaggaccgtacgggtacccgttaagtttactttaccgttaggtacggtaccgtaaagttccggtaaagtcggaactaccggttaccccgaccccccgtttaaggcccgttaccgttaaccgttttaccgtttacggtacccggtttaccggtaacccgggggg

SEQ ID NO: 84842 - DNA, 693 bp, Homo sapiens
  misc_feature: GYAE6OF02G8LVQ.47.46.E02.1.454.CMB.1.raw
  modified_base (219)..(219): a, c, t, g, unknown or other
  misc_feature (219)..(219): n is a, c, g, or t
tcagagctcacgtacacgaccggtgctcgatttagactcatctacagggaaaggaggctctgagagaggagcccagccctgggattttcaggtgttttcatttggtgatcaggactgaaccgagagaactcaccatggagtttgggctgagctggctctttcttgtgtctttttaaaaggtgtccagtgtgaggtgcaactgttggagtcgtggggganacttagtacacccggtgggggtccctgagaccttctcctgtgcacgcctctggactctacctttagcctaactctgtcagtgggcgtcgggtccgccgaggccggtcgggggaacgggtcgtgggacggttcggggtctacggtaagttagttcggagtaggaagtaagtgggtaggaacgtactaacgtacgtttacggttaccggtacggtaacccgttaccgggtacgggtaaccggggttccccgttaccgaccttaaccgtccctacccgtaagaacgtactaacgtttacgaggtacgcgtacgcttgtacttacaacaatacgaacacgaccgtagacggacgaccggaacggaccggtacggtaccgttaacgttacgtttcgtacggtacgtaggtaacgttcgtaagtacgtacgtacgtcccgaccccgtacgccctaccgttacctttacgttcgttaccgg

SEQ ID NO: 84843 - DNA, 784 bp, Homo sapiens
  misc_feature: GYAE6OF02IFDM0.47.46.E02.1.454.CMB.1.raw
  modified_base (222)..(222): a, c, t, g, unknown or other
  misc_feature (222)..(222): n is a, c, g, or t
  modified_base (700)..(700): a, c, t, g, unknown or other
  misc_feature (700)..(700): n is a, c, g, or t
tcagagctcacgtacacgaccggtgctcgatttagactcatctacagggaaagggggctctgagagaggagcccagccctgggattttcaggtgttttcatttggtgatcaggactgaaccgagagaactcaccatggtagtttgggctgagcgtggctctttcgtgtggtactttttaaaaggtgtccagtgtgaggtgcactgttggagtcggtgggganacttagtaccgaccggtcgggggtccctggagtacctctccgtgtgcacgtcctcgtcggtacctaccgtactttacgactaactcgtcgtctagtcgggtcgtcgggtcccgcgaccggtccgggtacgggggaacgggtcgtagggtacggtcgggtactacgtaagttagtacggtaagtagggaagtaggtaggggtacggtaacgtacgtaactagttaccgtaacggttacggtacccgttcgggtaacggtaaccgggttcccggtaaccgtaacccgtaccgtttacccaaccggtagtaacgttaaaccgttagttaccgggaaggccgtacgacgttcggttaacgttaactaacctaaacgaaaggtaccttaaaacgccggtacgtaggaaccggtaagacccggaacgaacccgtcggttaccgttatttaaggtttccgacgggtaatacccggtaattaccgngtaaccggttcgacccggttacccgtcccccgaaggttccgttacgtttaacccgtttacggttccggttacctacccgggggg

SEQ ID NO: 84844 - DNA, 795 bp, Homo sapiens
  misc_feature: GYAE6OF02HVRIV.47.46.E02.1.454.CMB.1.raw
  modified_base (118)..(118): a, c, t, g, unknown or other
  misc_feature (118)..(118): n is a, c, g, or t
  modified_base (213)..(213): a, c, t, g, unknown or other
  misc_feature (213)..(213): n is a, c, g, or t
  modified_base (248)..(248): a, c, t, g, unknown or other
  misc_feature (248)..(248): n is a, c, g, or t
  modified_base (585)..(585): a, c, t, g, unknown or other
  misc_feature (585)..(585): n is a, c, g, or t
tcagagctcacgtacacgaccggtgctcgatttagactcatctacagggaaagggggaggaactgctcagttaggacccagacggaaccatggaagccccagcgcagcttctcttccncctgctactctggcctcccagacgaccacgtggaagaaatggtgatgacgcagtcctccagcccacctgtctgtcctcgtacggaaggggaaacncgccaccattccgtccgtggtaacgggcccggtanaagtagttaacttacgcctaattacctaaagttcgccgttagggtaacccaaggtcaacggtaacggtaccggttcgggggacctacgggccccttacccggaggtcccttaccctctaacttcgttacggtcggtacgaccctaccgtacccgaaccggtacggggtacccttacgggttacggtaccctaccccggaggtaccccggtttaaggttcgaacggttcgggacgttaggggttccggggttacgtacggggaccttaggtacgttttacccgaccgtttcccacccgtaaccgtacgtacggaccggtacctaccggtccgtaccgnggttaaccgttacgttaacggtaagtttacgtttacgttaacttttaagtttaacttacgttacgtactagggtaacttacgtttaaacgttacgttacgtccgttcctcgtaccggtacgaacggtacggactacgtacgttaggaacgttaacggttaacgacggttcgacgtccgtaacggcttaaccgttcgttccgtacgttacc

SEQ ID NO: 84845 - DNA, 748 bp, Homo sapiens
  misc_feature: GYAE6OF02JVCFS.47.46.E02.1.454.CMB.1.raw
  modified_base (202)..(202): a, c, t, g, unknown or other
  misc_feature (202)..(202): n is a, c, g, or t
  modified_base (273)..(273): a, c, t, g, unknown or other
  misc_feature (273)..(273): n is a, c, g, or t
  modified_base (390)..(390): a, c, t, g, unknown or other
  misc_feature (390)..(390): n is a, c, g, or t
tcagagctcacgtacacgaccggtgctcgatttagactcatctacagggaaaaggggtctgagagaggagcccagccctgggattttcaggttgttttcatttggtgatcaggactgaaaccgagagaactcacagtggtagtttgggctgagtcgtggctctttcgtgtcgtcttaatttaaaagtgtccagtgtgagtgnagctggtgagtcgtggggagtcgtagtacgcgtccggtcggggtcctggagtacgtcctccgtgccgtacncggtcctgtacggttacttcttaccgtttagtagttacctcgcctagttcgtaacgttcggtccgaccacggctaccggaaggggaacgggttcgagggtgtcgggtcctcggacgngttacggttgggtggttaggtggtacgaaccggtgaaacgtgttaaaaccggttaacgttaaaccggtcccgttaggaccgggtacggggtacccgttttatttacccgttttaccgtaccgtaaccggagtaacttaacccgtaacgttaccgaaaggtaaacctattaacgtacgttaccttggtacctcggtaaccgtcgaacgtccgtaatcgggacgttaaggaccggtaggaaccaccggtttacttagtagttagttaaggtcgtttaaacggtggtaggtggttcggaaccgttcgtacgggtaccgggttaccgggccggttaacccggtaccggttgtacccgttccg

SEQ ID NO: 84846 - DNA, 685 bp, Homo sapiens
  misc_feature: GYAE6OF02H07YM.47.46.E02.1.454.CMB.1.raw
  modified_base (203)..(203): a, c, t, g, unknown or other
  misc_feature (203)..(203): n is a, c, g, or t
  modified_base (258)..(258): a, c, t, g, unknown or other
  misc_feature (258)..(258): n is a, c, g, or t
  modified_base (280)..(280): a, c, t, g, unknown or other
  misc_feature (280)..(280): n is a, c, g, or t
  modified_base (502)..(502): a, c, t, g, unknown or other
  misc_feature (502)..(502): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctccagataccatcggagaagttgtgttgacacagtctccagcccaccctgtctttgtctccgaggggaaancgccaccctctcctgcacgggccagtcaagtatctcactcctactcgctgtacanagaacctgtcagctccagctcnatctatgatgctactccaacgcggccacgtcggcactccgaagacgtaggttcgaggtcgacgtggtcgggtcgtagggaactacggtaccttaccgacttcctaccacctataccgacgtacgacgtccgtaaggtcaccgtaggtaaacgtttcgtttacgtaccttttaaacttttaccgtttacgtacgttacgaacggtactaggtacccggttaanaacccgttacgtcccgggttccctttccgttacccggttaccgtttccggggaaccgggtaaccgggtccggttaacgggggtcgaacggtccggtaaaccggtacggaaccggttaaacggtggggtttaccgccggttacgacccgttaacccggtagttttcccgtacgttttaaccccg

SEQ ID NO: 84847 - DNA, 560 bp, Homo sapiens
  misc_feature: GYAE6OF02FS03F.47.46.E02.1.454.CMB.1.raw
  modified_base (204)..(204): a, c, t, g, unknown or other
  misc_feature (204)..(204): n is a, c, g, or t
  modified_base (290)..(290): a, c, t, g, unknown or other
  misc_feature (290)..(290): n is a, c, g, or t
  modified_base (309)..(309): a, c, t, g, unknown or other
  misc_feature (309)..(309): n is a, c, g, or t
  modified_base (373)..(373): a, c, t, g, unknown or other
  misc_feature (373)..(373): n is a, c, g, or t
  modified_base (556)..(556): a, c, t, g, unknown or other
  misc_feature (556)..(556): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactgggagaaatagtgatgacgcagtctccagcccaccctgtctgtctctccaggggaaangccaccatctcctgcagggtcagtcagaatattcactcctattagcctggtaccaacagaaacctggtcaggctcccaggctcctnatctatgatgcatccaaancgggccacgtggcatcccagacaggttcaggtggcaggtcgggtcgtgggacagacttcactcncaccatcagcacgcctagacgcctaggtaacgtaccgtttaggtacttttattacgttgtacagtccaggtccgtagtacgtttcgtacggtcccttccgtctccgtacgtttcgggacggtacgggaccgtagggtcggagtacgtaaccgtaaacgtacgtggtcggccgtagctaccgtnttcg

SEQ ID NO: 84848 - DNA, 708 bp, Homo sapiens
  misc_feature: GYAE6OF02IMBWB.47.46.E02.1.454.CMB.1.raw
  modified_base (204)..(204): a, c, t, g, unknown or other
  misc_feature (204)..(204): n is a, c, g, or t
  modified_base (232)..(232): a, c, t, g, unknown or other
  misc_feature (232)..(232): n is a, c, g, or t
  modified_base (316)..(316): a, c, t, g, unknown or other
  misc_feature (316)..(316): n is a, c, g, or t
  modified_base (562)..(562): a, c, t, g, unknown or other
  misc_feature (562)..(562): n is a, c, g, or t
  modified_base (702)..(702): a, c, t, g, unknown or other
  misc_feature (702)..(702): n is a, c, g, or t
tcagagctcacgtacacgaccggtgctcgatttagactcatctacaggggaaagggggaggaactgctcagttaggacccagacggaaccatggaagccccagcgcagcttctcttcctcctgctactctggctcccagagaccactggagaaatagtgatgacgcagtctccagcccacctgtcctgtctctcgaggggaaancgccaccatctcctggtacgggccgtanaggtactattagcataccaacgttagacccgtggtaaccagacaggacgaccgtgggacacggacctccgacggcctacccgtnacttctagtagacgtcggtccgtacccgaaccggacgggtaccctaccgttccggttttacccgacgtacccggtaaggttccggacgttcgggtacgtaggttcggtaccggtaccgtaggggaactacgggtactttacaacccgttctacccaaccgtacttaaccgaaccgtacgtacccgtagtcgtaacgtcgtaacgtaagtttactttaggtactttaacgtttacttcgtattacgngtacgtaacgtttactactacggttaaccgtaccggtcctacgttaccccacggttacccgaacgtaacggccaacggagttaacggaacgtaacgttaaacgtaccgttaaggccgtacgtcgacccttactaccgttnttaccg

SEQ ID NO: 84849 - DNA, 846 bp, Homo sapiens
  misc_feature: GYAE6OF02IB8JB.47.46.E02.1.454.CMB.1.raw
  modified_base (309)..(309): a, c, t, g, unknown or other
  misc_feature (309)..(309): n is a, c, g, or t
tcagagctcacgtacacgaccggtgctcgatttagactcatctacagggaaagggtctgagagaggagcccagccctgggattttcaggtgttttcatttggtgatcaggactgaaccgagagaactcaccatgggtacgtttgggctgagcgtggcttctttcttggtggtacttttttaaaaggtgttcctagttggtggtaggtgtacaacgtgttggagtcgtgggggatacttagtaccacccggtgggggtccctgacgctctctgtgcacgcctcgtcggactcctacctttagcactcgtntacgtgtgggtcgtcgggtcccgcgacgggtcccgggtccgggggtagggggtcgtaggggacggttcgggtacctacgtaaagtttgtttacggattagggaaagtagtagggtaacggaaagtcctaacgttacgttcgtaacgggtcggtaccggtaccgggttagggggtaaccgggtcccggttaacccgacccgttacttccccgggtactaaacgggtactaaccgtttaaacgttcgggaaggtacggtacctacggtacgttagttaaccttaacgtaaaactaagttaacggaacttaccggaacccgtagaaacggaccgggacccgtaacggggtacccgtaaccggttaacccgtttaagttttaccgtttacggttagtaccgggttaaccgtaaaagtttcccgttaacgtaaccggtacccggttaaccgggttcccccctaacccccggttacttacccggtaccttttaccctttttacccgggtttacccgttaaccggttccggggttaacccgggg

SEQ ID NO: 84850 - DNA, 770 bp, Homo sapiens
  misc_feature: GYAE6OF02H59NH.47.46.E02.1.454.CMB.1.raw
  modified_base (182)..(182): a, c, t, g, unknown or other
  misc_feature (182)..(182): n is a, c, g, or t
tcagagctcacgtacacgaccggtgctcgatttagactcatctacagggaaaggggtctgagagaggagcccagccctgggattttcaggttgttttcatttggtgatcaggactgaaccgagagaactcaccatggagtttgggctgagcgtggctcttcttgtggtactttttaaaggtntcagtgtgaggtgacactggttggagtcgtagggggagtacttagtaccgacccggtgggggtccctaggacgtctctcgtgtcgcacgtcctcgtcggtactctaccgtttgacctaactcgtatcgtacgtgggtccgtcgggtcccgaccgtacgggacccggttaccggggggaagggtcggttagggacgggttcgggtactacggttaaggtagttacggagttaagggaaggtaaggtgggtacggtaacgtacgtaactacgtttaccggtacggtacggtaccgttaccggtacgggtaacggggttcccgtaccgtaaaccgtcgttacccgaacgtaggtaacctaacgttacgttaccgaaggtccgactacggtacgttacgtaactacctaaacgtaagtacgtaacgttacgcgtaaggacgtaacggaccgacggtaaccggtacggtaccttaagttacttacggtacggttacgacgttaagtcgtaacgtccgtacgttacccgtacccgttaccccgacgtacccgtacttacccggtttacgttacgttaccggtggtaacccgggg

SEQ ID NO: 84851 - DNA, 661 bp, Homo sapiens
  misc_feature: GYAE6OF02F51QJ.47.46.E02.1.454.CMB.1.raw
  modified_base (202)..(202): a, c, t, g, unknown or other
  misc_feature (202)..(202): n is a, c, g, or t
  modified_base (233)..(233): a, c, t, g, unknown or other
  misc_feature (233)..(233): n is a, c, g, or t
  modified_base (244)..(244): a, c, t, g, unknown or other
  misc_feature (244)..(244): n is a, c, g, or t
  modified_base (284)..(284): a, c, t, g, unknown or other
  misc_feature (284)..(284): n is a, c, g, or t
  modified_base (611)..(611): a, c, t, g, unknown or other
  misc_feature (611)..(611): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagacgaccactggagaaatagtgatgacgcagtctccagccaccctgtctgtctctccgagggaangccaccctctcctgcagggccagtcagaatntcactctatancctggaccaacagaacctggtcagcctccgagcctccgtnatctagtgatgactactaccaacgacggcccacgtcggactacgtacccaagaccgtaggttccgaaggtcggagtggttcgggtcgtacgggaactacggtaccttaccgacttccgaacctaccgtagtacacggacctacgtactaaggcgtacgtaacgtaagtcgttttacggtaactttacgttacgttacggtccctaaggtcctaggttccgttagtaccggtttcgtccggtcccttccggtcttaaccgttccgggtttacgggacgggttaccggacggttagggtcgggtaacaacgttaaccgtaaaccgggtnttcggggtacgtaccgtaccgtaccggaaccttacggttccgtttaccgg

SEQ ID NO: 84852 - DNA, 643 bp, Homo sapiens
  misc_feature: GYAE6OF02F5KAW.47.46.E02.1.454.CMB.1.raw
  modified_base (205)..(205): a, c, t, g, unknown or other
  misc_feature (205)..(205): n is a, c, g, or t
  modified_base (231)..(231): a, c, t, g, unknown or other
  misc_feature (231)..(231): n is a, c, g, or t
  modified_base (299)..(299): a, c, t, g, unknown or other
  misc_feature (299)..(299): n is a, c, g, or t
  modified_base (371)..(371): a, c, t, g, unknown or other
  misc_feature (371)..(371): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggcctcccagagaccactggagaaataggtgatgacgcagtctccagcccaccctgtctgtctctccgaggggaangccacatcctcgtggtacgggccgtnagagtattagcatcaacttagccgtaggtaccagcagacgccgtgggcaggcctccgacggtcctccnctatctagtgagtcgccgtccgaccgacgggcctacggttccggttcccgagtccgtaggtcaggtcggacnggtcgcggtcgacgggactaggtctccgtacctctaccaccgtactaccgaacgtacgcctacgacgtacgtacgtaagtacgtttactttacgtacgtttaagttttacgttacgtcgtaaccgtgtactaacggttactacgtaacgttaccggtccggttaccgtccgttaccgtaccggtaccggaaccgtagggacctacggtacggtaaggtaacgtaacgttaaccgtagtcggtacaccggtagaccctcgttacgctttacgg

SEQ ID NO: 84853 - DNA, 682 bp, Homo sapiens
  misc_feature: GYAE6OF02FVV5V.47.46.E02.1.454.CMB.1.raw
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggtcttttttaaaaggtgtccagtgtgaggtgcaactgttggagtcgtgggggagacttagtacgtacccgtggggggtccctggacgaccttctcctgtgcagcctctggactcacctttacgctaactctgtcagtcgggcgttcgggtcccgccgagggccggtccgggggaaacggggcgtagggacggtgggtctacgtaagttattgtatagagtaagttgggtaggaagctactagttcgtacgtcggactcggtagggtaacgggtccggttcaccgtatcctacgagacgtaactatttacgaggactacaccggtctagacttactaaacgaaattacgaacgtacggtactaggaacggacggacccgggaacgaccggaccggtacgttaacttacgtttcgtacggttagaacgtacgttacgtaacgtacgtaccgtacggtccccgaccccgttaggcccgtacttaccgtttactttaccgttaccggttggtaacccgggg

SEQ ID NO: 84854 - DNA, 815 bp, Homo sapiens
  misc_feature: GYAE6OF02GBV1O.47.46.E02.1.454.CMB.1.raw
tcagagctcacgtacacgaccggtgctcgatttagactcatctacaggggaaaggggtctgagagaggacgcccagccctgggattttcaggtgttttcatttgggtgatcaggactgaaccgagagaactcaccatggagtttgggctgagctggctctttcttgtggtcttttttaaaaggtgtccagtgtgaggtgcaactggttggagtcgtgggggagacttagtaccacccgtggggggtccctgagactctcctgtgcagcctctggacctctaccttacgcaactctgtcagtgggcgtcgggtcccgcgacggccggtccggggggaaggggcgtggggaggttcgggtccgtacgtaaggttagttagagtaggaaggtaaggtgggtagggaacgacgaactacgttcgttaaccgggtacgggtaccgttcccgggtagggaaccgggggttcccgggtttaccaacccgtacgttacccgtacccgaacggaacgaaccgaaaccgggtacaaaggtaacgttaacgttaacgttacgttaacgttacggttaaacgggaaacgtttaacggaaaccttaaacgttaccgtaagggtaaagggtaccggttaaccgggaaccggtaacgttaaccgggtcgtttacgttacttaacttacgtttagttttcggtttacgttttacgtaccgttcggttccccggtttccgggttacccgggtccgggtttaccgttccggggtaccggggttaccccggaaccggggttaaccccggttcgggttaccggacggttccccgg

SEQ ID NO: 84855 - DNA, 618 bp, Homo sapiens
  misc_feature: GYAE6OF02HBEYO.47.46.E02.1.454.CMB.1.raw
  modified_base (201)..(201): a, c, t, g, unknown or other
  misc_feature (201)..(201): n is a, c, g, or t
  modified_base (607)..(607): a, c, t, g, unknown or other
  misc_feature (607)..(607): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctcagccaccctgtctgtctctccgaggggaancgccacattcctccgtggtacgggccgtcaggatattagcatcaacttcgcctggtaccagcagacgaccgtgggcaggcctcccgaggtcctccctctattcctagtgactcggccgtaccaacggacggggccctcgtggccctacgtccccgaggcccgtaggttccgaggtcggacgtagggtcgggtctacggggactgtaccgttaccaccgttcctaccgacctactccaggcctaacggccgtaggcgtacgtagtaacgttagttttcgtactttaacgttttactcgttcgtacagtaacttaaacgtaactcgtcgtccctcgacttcgtacggttcggaccgggaggtaccgtgggtacgacgtacgtagaaccgtagtcgtagccgtagaccnctacgttctcg

SEQ ID NO: 84856 - DNA, 758 bp, Homo sapiens
  misc_feature: GYAE6OF02G34WY.47.46.E02.1.454.CMB.1.raw
  modified_base (660)..(660): a, c, t, g, unknown or other
  misc_feature (660)..(660): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccagtggtagtttgggctgagcgtggcttctttcgttgtggttactttttaaaaggtcgtcctagtgtgtaggtgacgtaacgttggttaggcgttcggtggggtagtacgttaaggtacctacccggttcggggtccctgacgtactcgtccgtgtgtacgtcgtcgtaggtaactcgtacgttacgtacgtaccttgtggtactgacgacggttcgacccgacctaacgtcggaggggtacggtcgtagggtcggtacgtcgtacgtaactctacgtacttccgtagacgtcggacgttaggtttaacgtttaaagttaacgttcggtaccggtaaccggtttacggttacgggtacgggtaacgggtaccgttaacgttcgtaacgtccgtacgttaccggaacggaacgtaacgaccgtaaacgggactaaagggtactacgtcggttaagtacgtacggtaaagtaataacgtaacttacgtacgacgaggtaaacctacggtaacgtacgtaccggtcttagtnttaaacgtcgtttaagttccgttacgttacgccgttccggttcgacccgggtcgtaccgttggtacgtcgggtaccgtggaccgtttgacccgttcgg

SEQ ID NO: 84857 - DNA, 674 bp, Homo sapiens
  misc_feature: GYAE6OF02I09WX.47.46.E02.1.454.CMB.1.raw
  modified_base (204)..(204): a, c, t, g, unknown or other
  misc_feature (204)..(204): n is a, c, g, or t
  modified_base (306)..(306): a, c, t, g, unknown or other
  misc_feature (306)..(306): n is a, c, g, or t
  modified_base (467)..(467): a, c, t, g, unknown or other
  misc_feature (467)..(467): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaattagtgatgacgcagtctccagccaccctgtctgtctctccagggggaaangcccacatcctcctaggtacggggccgtcagtagtattagcatcaactttagccttggtaccagacagacgaccgtgggcaggcctcccgaggcctcccgtnatctatgatcgacgtccgtaccgagggccctacgttccggttacccacggtcccgtagggttacgacggtcgggcttacgggtgccggttcgtggggaactaggtgttccacttccgtacacctactaccgacgtacgcctcgactagtcgtagtaagttnttttacgcttttaagttttactttacgttcgtacgtagtactaagttacttacttaagtaccgttaccggccgtttaccgttacccgtaccgtttacccgggaacgtaaccgggtaccgaccggttaacggaacgggttaactaacgtttaaaccggtaccgttaggttacggttacgtcgtaccctacgttacgttccgtttaccg

SEQ ID NO: 84858 - DNA, 638 bp, Homo sapiens
  misc_feature: GYAE6OF02FUS1Q.47.46.E02.1.454.CMB.1.raw
  modified_base (203)..(203): a, c, t, g, unknown or other
  misc_feature (203)..(203): n is a, c, g, or t
  modified_base (226)..(226): a, c, t, g, unknown or other
  misc_feature (226)..(226): n is a, c, g, or t
tcagagctcacgtacacgaccggtgctcgatttagactcatctacaggggaaagggggaggaactgctcagttaggacccagacggaaccatggaagccccagcgcagcttctcttcctcctgctactctggctcccagagaccactggagaaatagtgatgacgcagtctccagccaccctgtctgtctctccgaggggaangccacatcctctgtagggccgtnagagtattagcatcaacttgcctggtaccagcagacgacctgggacacggtcctacccgaggcctcctcatctatgactcgcctaccaccgacgggcctacgttcggttacccacgtaccgtaggttcacggttggctaggtcgtcggtcgaggggacaggtagttccacgtctaccgaactagtaccaaactcgtcctcgacgtacgttactaggtaacgttcgttttacgtcgtttaagtttacgtttacgtagttacgtacgtacgtaagttaactacgtaacgtttacgcggtcctaccgttaccgtaccgttaccggaacgtaacggtaccgaccggtagtacggtaaacgttaacgtaaacccggtagtgggtacggtacctacggacccacttaccgtcgttacg

SEQ ID NO: 84859 - DNA, 681 bp, Homo sapiens
  misc_feature: GYAE6OF02F7XUA.47.46.E02.1.454.CMB.1.raw
  modified_base (262)..(262): a, c, t, g, unknown or other
  misc_feature (262)..(262): n is a, c, g, or t
  modified_base (293)..(293): a, c, t, g, unknown or other
  misc_feature (293)..(293): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggcttctttcttgtggtcttttttaaaaggtgtccagtgtgaggtgcaactgttggagtcgtgggggagacttagtacacccgtgggggtccctgagactctcctgtgcancctactcggactccaccttttagctaacctntcgtacagtcgggcttcgggtccgcccgagggcccggtccggggggaaggggctgggaggttcggggtctaccgtaagttagttcgagtacggaagtaatcgggtagaaacgcaactacgttacgtaacgtggtaccgtccggtaggtaacggggtcccggttacaccagttccctacgaggaacgtactaactttcgaggacgtaccacggtctacgtacttacgtaaacaaagtgaaaccgtagtacgtacggaagacggaccgacggaaccgtaccgggacgttattacttcggtacgtcggtaacgtaacgttctaacgtcgactacggtacctcccccgtacgaccgtctaaccgtttcctttacgccgtttaccggtacggg

SEQ ID NO: 84860 - DNA, 547 bp, Homo sapiens
  misc_feature: GYAE6OF02HVQ4X.47.46.E02.1.454.CMB.1.raw
  modified_base (245)..(245): a, c, t, g, unknown or other
  misc_feature (245)..(245): n is a, c, g, or t
  modified_base (312)..(312): a, c, t, g, unknown or other
  misc_feature (312)..(312): n is a, c, g, or t
  modified_base (318)..(318): a, c, t, g, unknown or other
  misc_feature (318)..(318): n is a, c, g, or t
  modified_base (400)..(400): a, c, t, g, unknown or other
  misc_feature (400)..(400): n is a, c, g, or t
  modified_base (461)..(461): a, c, t, g, unknown or other
  misc_feature (461)..(461): n is a, c, g, or t
  modified_base (515)..(517): a, c, t, g, unknown or other
  misc_feature (515)..(517): n is a, c, g, or t
  modified_base (519)..(521): a, c, t, g, unknown or other
  misc_feature (519)..(521): n is a, c, g, or t
  modified_base (523)..(547): a, c, t, g, unknown or other
  misc_feature (523)..(547): n is a, c, g, or t
tcagagctcacgtacacgaccggtgctcgatttagactcatctacaggggaaagggccaccatctcctgtagggccggtcagagtattagcatcaacttagcctggtaccagcagagacctgggcaggctcccaggctcctcatctatgatgcgtccaccgagggccctacgtcggtttcccagcccgtaaggttccagtggcagtcgcgtctgggacaggacgttcactcctacacatacaacncgcctgctagtctagaagttattttgcttagtttacttactgtactaggactagtactacaataacncggccncctctaccgttacggacaaagggtaccacgacgtaggtaactaacgtaaaaccgtagtgttacgccgttagacctaaccgtntcgttctccttacgtaccttcccgttccccgactactacgtataccgttaaacgcgtaacnccgttcggtacgggacgtccggggctagggacccgtaaggcgttactacgtagnnntnnnannnnnnnnnnnnnnnnnnnnnnnnn

SEQ ID NO: 84861 - DNA, 682 bp, Homo sapiens
  misc_feature: GYAE6OF02HKTI9.47.46.E02.1.454.CMB.1.raw
  modified_base (204)..(204): a, c, t, g, unknown or other
  misc_feature (204)..(204): n is a, c, g, or t
  modified_base (217)..(217): a, c, t, g, unknown or other
  misc_feature (217)..(217): n is a, c, g, or t
  modified_base (233)..(233): a, c, t, g, unknown or other
  misc_feature (233)..(233): n is a, c, g, or t
  modified_base (285)..(285): a, c, t, g, unknown or other
  misc_feature (285)..(285): n is a, c, g, or t
  modified_base (329)..(329): a, c, t, g, unknown or other
  misc_feature (329)..(329): n is a, c, g, or t
  modified_base (336)..(336): a, c, t, g, unknown or other
  misc_feature (336)..(336): n is a, c, g, or t
  modified_base (450)..(450): a, c, t, g, unknown or other
  misc_feature (450)..(450): n is a, c, g, or t
  modified_base (590)..(590): a, c, t, g, unknown or other
  misc_feature (590)..(590): n is a, c, g, or t
  modified_base (651)..(651): a, c, t, g, unknown or other
  misc_feature (651)..(651): n is a, c, g, or t
tcagagctcacgtacacgaccggtgctcgatttagactcatctacaggggaagggggagaactgctcagttaggacccagacggaaccatggaagccccagcgcagcttctcttcctcctgcttactctggcctccagagaccactggagaaatgtgatgacgcagtctccgagcccaccttgccttgtcctcgtcgagggaancgacctcagttcncgtgtacgggccgtanagtagtattagctaatcgaattcgaccttggaacctagagacgtacgtacgngggacgtacggtcctccgacgtcctccatactcgtaatcgtaancgtaccnccgacgacggtccaacgttcgttccccgagtaccgtacggttgacggtcgcgtaggtccgtcggtcggtaaggtacaacggtttgaccctacgtttaccgacctaccggtaacnccgtaaaaccgtcgtcccggttaacgtcgtaacccgttagtcgtttaaaccgttaggttttaccgacgttttagtttaaccgtttacgttgtacgtagtacccgttagttaaaccgtgttaacccgtaacgtcggtaccncgtaccgtacggtaaccgtacgacgtaccgacggtacgtaggaacgtactaagtaacggtntaccgacttgaaccgtacttcgtagttaccg

SEQ ID NO: 84862 - DNA, 672 bp, Homo sapiens
  misc_feature: GYAE6OF02HLGDR.47.46.E02.1.454.CMB.1.raw
  modified_base (327)..(327): a, c, t, g, unknown or other
  misc_feature (327)..(327): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccaccggagaagttattttgacacagtctccagccaccctgtctttgtctccgagggaaagagccaccctctccgtgcagggtcagtcagagtgttgacagctacttagtctgtacaagagaaacctggccaggctcccgaggcctcctctatcgtgggactgactaactacccaacgcgggcccncgtcggccaacttcccaggtcccgtaggttcaggttggcgtaggtcggtcgttcggtacgggaacgtaggtacttccgtacgttccgtaccacctatcccaaagtacgcccgtgcctaggttaccgtagtaaagttattttcgacttaagttttacgttacgttagtccgaagtacgtatactacgtaattaccggtcgtacctaccgtaccgtaccggtttacggaccggtaaacggacctaacgggtacgtagggtaagttaacccgttaaaaggaccgttacggtacggtacgtacgcccgtaacgtcgttacccgttacggtttaccttacgttaacccgg

SEQ ID NO: 84863 - DNA, 730 bp, Homo sapiens
  misc_feature: GYAE6OF02H1YY9.47.46.E02.1.454.CMB.1.raw
  modified_base (198)..(198): a, c, t, g, unknown or other
  misc_feature (198)..(198): n is a, c, g, or t
  modified_base (231)..(231): a, c, t, g, unknown or other
  misc_feature (231)..(231): n is a, c, g, or t
  modified_base (407)..(407): a, c, t, g, unknown or other
  misc_feature (407)..(407): n is a, c, g, or t
  modified_base (472)..(472): a, c, t, g, unknown or other
  misc_feature (472)..(472): n is a, c, g, or t
tcagagctcacgtacacgaccggtgctcgatttagactcatctacagggaaagggggaggaactgctcagttaggacccagacggaaccatgaagccccagcgcagcttctcttctcctgctactctggctccagacgaccaaccggagaagttattttgacacagtctccagccacctgtctttgtctccagggaancgcaccctctcctgcaggtcagtcagagtgttnacagtacttacttgtctggtaccaagacgaacctggccgagcctaccgacggcctacctacgaacttccgtagggacttcggacctaacgttaccccaaacgggacggggacccgtccgtacgggtacctaccttacccgacgacccgttaagggttaccacggttccgggaacgnggtttacggccggtttccgtaggggctaacgtacgtttcccactttaccgacctaacccgttaanacccgtaaacgaccgtaccgcgtacctaccggttacgtaacgtaaggttacgtttttacgaacggtttacgttttaacgtttacgttaccgttactaggttaccgttaagttactacgttaacgttaaaccggtacgtacccgtaccttaccgttaaccgtttccgaaccggtaacgaccgtacgtaacgacgtaagtaaacgtaacgaacgtcggtacgacgtactacacgttactccgttacttccgttcttaacc

SEQ ID NO: 84864 - DNA, 864 bp, Homo sapiens
  misc_feature: GYAE6OF02JGQM3.47.46.E02.1.454.CMB.1.raw
tcagagctcacgtacacgaccggtgctcgatttagactcatctacagggaaagggggctctgagagaggagcccagccctgggattttcaggtgttttcatttggtgatcaggactgaaccgagagaactcaccagtggagtttgggctgagctggctctttcgttgtggtacttttttaaaggtgtccaggtgtggtaggtgacaacgttgttggtagtcggtgggggagtacttagtaccacccggtgggggtccctggactacgtactcctggtcgctacggccttcgtggacctccgtaccgtttagacctaaccttcgtcggtagcgtacggggctccgggttcccgaccggtacggccgggtacccgggggtaagggtccgttagggtacggttcggggttaccgtacggttaaacggtcgttttagacggttaggaacgggttaagttggggtaacggtaacggtaccgtaagttacgtttaaccgttaaccgggtacgggtaacccgtttaccggggtaaccgggttaacgggggtaccccggtttaccaaccgtaacgtttccccgaacccggttaaaggtaacccggttaaaccgttaaacgttttacggaaaccgggtaacgtacccgtacggttacgtttaccgtaaacgtttccgaaacttaaacgggtaccgtaaacgacctacccgggttcgaaacgggttaaccgccgggtaaacgtacccggtaccggtaaccttagttacttttaccgggagtaccgttaagacgtttcgtaaccggtagtaccggtacgtacccgtacccggtacgacgttccgttaaccgtttcggttacgtaccggttacggg

SEQ ID NO: 84865 - DNA, 726 bp, Homo sapiens
  misc_feature: GYAE6OF02JP0LW.47.46.E02.1.454.CMB.1.raw
  modified_base (211)..(211): a, c, t, g, unknown or other
  misc_feature (211)..(211): n is a, c, g, or t
  modified_base (230)..(230): a, c, t, g, unknown or other
  misc_feature (230)..(230): n is a, c, g, or t
  modified_base (244)..(244): a, c, t, g, unknown or other
  misc_feature (244)..(244): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggcctcccagagaccacgtggaagaaatgtgatggacgcagtcctccgagccctacctgtctgtctcgtaccgagggaaacncgccctaccagtcctccgngggtaggcccggtnaaggtagttactacgctaatccgtaaacttgcctggtaccagtaccagacgtaccgtgggacctacgggcctaccccggagtacccttccaccgacttacctagtcgtagtaccggtccctaccgaccggtaggcccgttacgttccgggttaccccacggtaccgtagggttcgacggtaggccgttaggtcggtaccggtacggtacgggaacctagggtacctttccgactccggtaccaacccgtataccgtaacgacgtccgtacgacgttcgtagtacgtaaagtttctttagaccgtttatttaaccgtgtacgtacgtagtaccgttaagttactacgttaaccgtacggtcgtaccgtacctccgtaacggtccggaaccgtaggtaccctaggtacgtaacggtaaaccgttaacgtaaaccggttagtacggttcccgtacgaacgttcccaacgttcgttaccgttaccg

SEQ ID NO: 84866 - DNA, 775 bp, Homo sapiens
  misc_feature: GYAE6OF02HQ9G4.47.46.E02.1.454.CMB.1.raw
  modified_base (152)..(152): a, c, t, g, unknown or other
  misc_feature (152)..(152): n is a, c, g, or t
  modified_base (162)..(162): a, c, t, g, unknown or other
  misc_feature (162)..(162): n is a, c, g, or t
  modified_base (181)..(181): a, c, t, g, unknown or other
  misc_feature (181)..(181): n is a, c, g, or t
  modified_base (189)..(189): a, c, t, g, unknown or other
  misc_feature (189)..(189): n is a, c, g, or t
  modified_base (191)..(191): a, c, t, g, unknown or other
  misc_feature (191)..(191): n is a, c, g, or t
  modified_base (194)..(194): a, c, t, g, unknown or other
  misc_feature (194)..(194): n is a, c, g, or t
tcagagctcacgtacacgaccggtgctcgatttagactcatctacagggaaaggggtctgagagaggagcccagccctgggtattttcaggttgttttcagtttggtgatcaggactgaaccgagagaactcacatggtagtttggctgagntggcttcttnttgtgttactttttaaagngtcagtgngngtnctatgtggagtcgagggatacgtagtaccgaccgtcggggtcctagacgtactcgtcgtcgtgctacgtcctcgtcgtacctccttaccgttagacctactcgtcgtgtagtcggtcgtacggtcccgcgacgggtccggccggggaaggtcggtaggtggtggtaccgttaacgtagtttagtgtagtaggtaacgtaggtacggtaagtaacgtcgtaactttacggttacgtacggtacggtacggttacggtaacgggtacgggttaccccgttcaacccgttctaccctaacgtaaggtaaccgtacgtttaaacgtacggacggtactacgtacgttacgtaacgttaactaacgtaaacgttaacgtaacgtaacgtacgtaacgtaacggaacggtaccggtaacgggaaccgtaccgggttaaccgttaaccggtttaacgtttaacgttcggttaacggtacggtaaacgttagttacgtttaaacggcgttaacccgtaccggtacccccgtacccgtaccgttaccgttaacccgttcgttttacggtccgttacggtccggtaaccgg

SEQ ID NO: 84867 - DNA, 791 bp, Homo sapiens
  misc_feature: GYAE6OF02I69MK.47.46.E02.1.454.CMB.1.raw
  modified_base (153)..(153): a, c, t, g, unknown or other
  misc_feature (153)..(153): n is a, c, g, or t
  modified_base (204)..(204): a, c, t, g, unknown or other
  misc_feature (204)..(204): n is a, c, g, or t
  modified_base (233)..(233): a, c, t, g, unknown or other
  misc_feature (233)..(233): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggactcccagacgaccacgtgganaaatagtgactgacgcagtctccagccacctgtctgctctccgagggaaancgccacatctcctggtaacgggccggtanacggagttgtcgaacagcctttaactcggttcctaggtaacccaagaacggtaaaccgtggccacggaccctcccgaggtccttacctctaagttcctaagtcgtagtcgcccgttaccaaccgacggcctacggttccgtttaccccaaggccgttaacggttccgagggttcggacttacggtccggtccgttaccggtaggggacctaaacgggttacgttacctaaccttacccgtacctaacccgtaacttacccgaacctaacccggtcctaacggacctaacgggttaccttaacgggttaaactttaacggttttccgtaaacgtttaaacgtttttaaaccgtacgttttacgaacccggttacgttactaaacggttccggtttaaactaaaccggtttaaccggtcccggtacccggttaccctaacccgtttaaccggttaaccggaccggttaaacgggaccgtacccgtagggtaacggtactaaacgttaaacggccgtaaggtccgtaccctgacctaccgtacttacgttccgacttaccg

SEQ ID NO: 84868 - DNA, 740 bp, Homo sapiens
  misc_feature: GYAE6OF02GJ925.47.46.E02.1.454.CMB.1.raw
  modified_base (180)..(180): a, c, t, g, unknown or other
  misc_feature (180)..(180): n is a, c, g, or t
  modified_base (284)..(284): a, c, t, g, unknown or other
  misc_feature (284)..(284): n is a, c, g, or t
  modified_base (290)..(290): a, c, t, g, unknown or other
  misc_feature (290)..(290): n is a, c, g, or t
  modified_base (467)..(467): a, c, t, g, unknown or other
  misc_feature (467)..(467): n is a, c, g, or t
tcagagctcacgtacacgaccggtgctcgatttagactcatctacagggaaaggggctctgagagaggagcccagccctggaattttcaggtgttttcatttggtgatcaggactgaaccgagagaactcaccatggagtttggctgagcgtgcgtcttacgtgtcgtacttttaaaggngtcagtgtggagtagctatgtgacgtgtggggactactagtaacgcccggtggggtcctagacgtctctcgtgagctcgcctgacgtactacgacttcactacnctggcngtggctggccacgagggaccggtaccggggtaggtccggtaggtcgggtacggtacctaacggtagttagttaggaagtggtagtaacgtgggttaccggaaggaccttcgtaagttccgtaaacggtcggttaaccgtacggtaacggggtacggggtacccttacggaacccgtntacccgtacgaaagtaccgtaacgttacttaggaaacgtcgtacccgaagtcccgttaagtaccgttaaactaaacgtaacgtaaccggaacgtacggaacggtcggaacgaccgggaccggttaccggaccgtaacggttacttaacgttacgttacgaagggttaccgttagttaacgtaaccgtttacgaacggaccgttacccgttaccccgtaccgttccggttaaccgttcgttttaacccggttacgttaccggtttcggtaacgg

SEQ ID NO: 84869 - DNA, 672 bp, Homo sapiens
  misc_feature: GYAE6OF02ILP7W.47.46.E02.1.454.CMB.1.raw
  modified_base (192)..(192): a, c, t, g, unknown or other
  misc_feature (192)..(192): n is a, c, g, or t
  modified_base (215)..(215): a, c, t, g, unknown or other
  misc_feature (215)..(215): n is a, c, g, or t
  modified_base (223)..(223): a, c, t, g, unknown or other
  misc_feature (223)..(223): n is a, c, g, or t
  modified_base (257)..(257): a, c, t, g, unknown or other
  misc_feature (257)..(257): n is a, c, g, or t
  modified_base (262)..(262): a, c, t, g, unknown or other
  misc_feature (262)..(262): n is a, c, g, or t
  modified_base (377)..(377): a, c, t, g, unknown or other
  misc_feature (377)..(377): n is a, c, g, or t
  modified_base (393)..(393): a, c, t, g, unknown or other
  misc_feature (393)..(393): n is a, c, g, or t
  modified_base (472)..(472): a, c, t, g, unknown or other
  misc_feature (472)..(472): n is a, c, g, or t
  modified_base (482)..(482): a, c, t, g, unknown or other
  misc_feature (482)..(482): n is a, c, g, or t
  modified_base (491)..(491): a, c, t, g, unknown or other
  misc_feature (491)..(491): n is a, c, g, or t
tcagagctcacgtacacgaccggtgctcgatttagactcatctacaggggaaaggggtctgagagaggacgcccagccctgggattttcaggtgttttcattttggtgatcaggactgaaccgagagaactcaccatggagtttgggcttgagcgtgcgtcttacgtgtgtactttttaaaggctactagtntgagtgcatgtgctcgtggggancttagacncccgtggggtcctgacgcttctcctgtcaccganccgtntcggaacctactacctttaagctaaccgtcttagactaagtgggaccgttagggtccacccgaagggtccggccggggtaaggggcgttagggcggttgggtcctataaaggttnttagagtgacgaaagnggtccggaatctatatttcgaacctggacttacggcgaaggttccgaacaccacttcaccgagttcgaaacttacgtanacgggtaacncgtactgtnttaactaactaactaaaggtacaacaacgtcgtaagacgtaccgtaccggacgtaaccgggacgttaccgttattaacgttgttaacgacgacggttaactacgtagtaccggtcctaccggtaccccgtaccgtaccgtaccttacgttacctttacgtttacgtccggttacggccggg

SEQ ID NO: 84870 - DNA, 754 bp, Homo sapiens
  misc_feature: GYAE6OF02G9NKP.47.46.E02.1.454.CMB.1.raw
  modified_base (213)..(213): a, c, t, g, unknown or other
  misc_feature (213)..(213): n is a, c, g, or t
  modified_base (224)..(224): a, c, t, g, unknown or other
  misc_feature (224)..(224): n is a, c, g, or t
  modified_base (301)..(301): a, c, t, g, unknown or other
  misc_feature (301)..(301): n is a, c, g, or t
  modified_base (325)..(325): a, c, t, g, unknown or other
  misc_feature (325)..(325): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgaggtctggcttctttcgttggtaggtcttttttaaaaggtgtccagtgtgaggtgcaactgttggntacgtgggganacgttagtaccgacccgtgggggtaccctgacgacttcgtcctgtgcgagcctgtcggctctacctttagctaactntcgtctagcgggtctcgggtcccncggtacgccggtaccgggggaaggcggtggtagggcggttctacggaatagttgaattggagaaagttcgggtaggaatcgaactagttcgtaacggtgtaccgtcggtaggaacgggtccggttacaaccgtagtccctacgacgaacgtaactaagtttaacgaggtacgccgtaacgtcgtacgttaactacgtaacgtaaaagttacgaaactacgttacgtacgaacggacgggaccgtaacggaaccggtaaccggttccgttaacgttaacgtttacgttacgtaacgtacgttaaacggtaccgttaaacggtaaccgtacggtaaccggttaccccggtaccccccggtacggtaaccgttccccgtttaaccgtttccggttttaaccggttaccggtttaccggttaaacccgggggg

SEQ ID NO: 84871 - DNA, 700 bp, Homo sapiens
  misc_feature: GYAE6OF02F3RGM.47.46.E02.1.454.CMB.1.raw
  modified_base (339)..(339): a, c, t, g, unknown or other
  misc_feature (339)..(339): n is a, c, g, or t
  modified_base (387)..(387): a, c, t, g, unknown or other
  misc_feature (387)..(387): n is a, c, g, or t
  modified_base (408)..(408): a, c, t, g, unknown or other
  misc_feature (408)..(408): n is a, c, g, or t
  modified_base (458)..(458): a, c, t, g, unknown or other
  misc_feature (458)..(458): n is a, c, g, or t
  modified_base (472)..(472): a, c, t, g, unknown or other
  misc_feature (472)..(472): n is a, c, g, or t
tcagagctcacgtacacgaccggtgctcgatttagactcatctacagggaaagggggctctgagagaggagcccagccctgggattttcaggtgttttcatttggtgatcaggactgaaccgagagaactcaccatggagtttgggctgagctggctctttcttgtggtctttttaaaggtgtccagtgtgaggtgctaacgtgttggagtcgtggggagtacgttagtaccgacccggttggggggtcccctggacgtaccgtcctccgtgtcgctacgtcctcgtcggtactacctaccttagcctaactcttgtcctaggtcggtcgtcgggtccnccgagggtccggtccgggggtaagggcgtgggaggtggtcacgtagtnttgatggagagtggtggaacncacgtattcgtacggtcggacgtcggtaggacgggtcccgtacgtacccntccgtacgacgtanaactagtacgaggaactcgacgtacgttagtacgttactaaacgtaaacgttacgaaccgtactaccggtagaccggtaccggcgaacgggaacccttacgggaactttaccgttacgttacgtacgtcggtaaccgttacggttaactacggtaacgtccgtaaccggttcccgtaccccgtacggttcctacccttaccgttttcttaacggtccggttacccggg

SEQ ID NO: 84872 - DNA, 695 bp, Homo sapiens
  misc_feature: GYAE6OF02GW7P5.47.46.E02.1.454.CMB.1.raw
  modified_base (273)..(273): a, c, t, g, unknown or other
  misc_feature (273)..(273): n is a, c, g, or t
  modified_base (386)..(386): a, c, t, g, unknown or other
  misc_feature (386)..(386): n is a, c, g, or t
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagcgtggctctttcgttgtggtactttttaaaaggtgtccagtgtgaggtgactaactgttggagtcgtgggggagacgttagtacacccgtgggggtccctggagacctctcctgtgcagcctcngactctaccttagacaactcgtgtcagtgggctcgggtcccgccgaggccggtaccgggggaagggtcgtgggaggtcgggtctacgagtagtgatggagtagtggtaggaancgaatattactacggtggacgtccggtagggtaaccgggtccggttaccaaccgtacgttcccgtaccgaagtaacgtaactaaacgtttcgaaggggactaccgacgtacgttagtaacctaccgtaaactaaagtacgaaacgtagttacgtaggacgtacggacccggaaggtaccgtaccgggacgttaatttcgttcgtacgtacgtaacggttaacgttcgtagtacgtaccgtaccggtcccgtaccccgtacgtccggtaccttaccgttttccgtttacgtaccgttaccggtaccgggg

SEQ ID NO: 84873 - DNA, 703 bp, Homo sapiens
  misc_feature: GYAE6OF02FTKDV.47.46.E02.1.454.CMB.1.raw
  modified_base (201)..(201): a, c, t, g, unknown or other
  misc_feature (201)..(201): n is a, c, g, or t
  modified_base (256)..(256): a, c, t, g, unknown or other
  misc_feature (256)..(256): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaanagccaccatctcctgtagggccgtcagagtattagcatcaacttagcctgtaccngcagagacctggcaggctcccaggctcctcatctatgatgctccaccagggccacgtcgtttcccagtccaggttcagtggcagtgcgtcgtggggacacgtagttacgaacttccgttaccaccgtaattcccgaaacacggtcccctaggcctaaggttccgttacgaaagttagtttttacggaccttaaggtttttaactttaacgttgttaccgtaacgggtcctaaggtttaactaaccgttaacgtttaaaacccgttagggtcccccgtaaccgttaccgtaaaccctttacccggggtaccctaaacggggggacccctaaccgggtaaccggttacggggtaaacgttaaaccggtttaaaaacccggtaaccgttacgggttacggggtaaccttacgggaacccctaacccggttaacgttcccgtttaacccgg

SEQ ID NO: 84874 - DNA, 904 bp, Homo sapiens
  misc_feature: GYAE6OF02HYQ2C.47.46.E02.1.454.CMB.1.raw
tcagagctcacgtacacgaccggtgctcgatttagactcatctacagggaaagggggagaactgctcagttaggacccagacggaaccatggaagcccagcgcagcttctcttcctcctgctactctggcctccagtacttccaccggagactattgtttgactactagtctaccacgccaccttgtctttcgtaccttaccgaagggaaagacgcccctaacctcttccgcggaccgacgggcctaggtacgaggtaaggttcggttggcctacgaccttacgttacgccggtacggtaaccaaacgtaccgaaaccgtcggaccgtaacggcctaccccgaggtccttaacccgctaaccgtcgttaacgtggtacctacggacctaaaccgttacccgaaaacggtccgggacccctaacgggtacggtaccaccccgtacccgtaagaaccgggttacggtacggtaacggtggaccgttaaggggtcgggtccgaacgggtactaacgggttaccttacgtacctttcgaacccgtaccgtacgtacggaccgacgtaaccgtaccgtaacggtaccaccgtaggtaaccgtttacgttacgtactttacgttacgttacgttccgtaagtaccgacgttacggtaccgtaacgtaaccggggttaccttacccggttaccgttaccgttacccggggtttaacccggttaccgggggtaacccggtaaacccgggggtacgggttaaccgggggttacgggtaacccggtttaaccggaaacggtaaccccggggttaaacgggttaaccgggttaccgggtaccggtttaaccgggtaccccgtaacccgggttaaacccggtttccggttacccgtttaggttttaaccccccggg

SEQ ID NO: 84875 - DNA, 848 bp, Homo sapiens
  misc_feature: GYAE6OF02JHJLL.47.46.E02.1.454.CMB.1.raw
tcagagctcacgtacacgaccggtgctcgatttagactcatctacaggggaaagggccaccatctcctgtagggccggtcagagtattagcatcaacttagcctggtaccagcagagacctgggcaggcctcccaggtctcctcatctatgatcgcgtccaccgagggccacgttggttcccagcctacggttcaggtggcagtgcgtcgtgggactagtgttcaacttctaccaccatacgaacacgcctaggcaacgttctaacgtaagttacgtttttacggtacgttaacgtttttaacgtttaccgtttacggtacgtaacgtaccgttaaggttacttaaccgttaacttaaaccggtccggtaccccgtacctacccggttaacccgtttaccggggaaccccggtaaaacggggaaccgttaacccggtaacggttaacggggtaaacctttaaacggttaaaaacccgggtaacggttcggtaccgggttacgtaacccggtaccctaacccgttaacgttcgtttaacggtttccctttaccgttaaacccggtttcccccgttaaacccgttacccgtacgttttaccgtacgggttaaaccgttaccgggttacggtaaacccgttccgtaaccggttacgggtaaccgggtccggggttaaccggtaccgggaacggttaaacccgggcgggttaccctaaagggttcgaccgtacggtaacccggtggtaccgtgtacgtacgtacggtacgtcgtacgtacgtacgtacgtacgtacgtacgtcgtacgtactactactacgtaccgtacgacgtcgtcgtacgtacgagtcg

SEQ ID NO: 84876 - DNA, 701 bp, Homo sapiens
  misc_feature: GYAE6OF02FUXJH.47.46.E02.1.454.CMB.1.raw
  modified_base (194)..(194): a, c, t, g, unknown or other
  misc_feature (194)..(194): n is a, c, g, or t
  modified_base (340)..(340): a, c, t, g, unknown or other
  misc_feature (340)..(340): n is a, c, g, or t
  modified_base (523)..(523): a, c, t, g, unknown or other
  misc_feature (523)..(523): n is a, c, g, or t
tcagagctcacgtacacgaccggtgctcgatttagactcatctacagggaaagggggctctgagagaggagcccagccctgggattttcaggtgttttcatttggtgatcaggactgaaccgagagaactcaccatggagtttgggctgagcgtgctctttcgttgtggtactttttaaaggtgtccagtgtgnggtgcacttgttggagtcgtggggggactacgttagtaccacccggttggggggttccctaggacgtacctctacctggtacgcacgcctcgtggacctcgtacctttagctaacgtctagtctagttcgggcttcggggtacccncgtacgggtccggtacccggggggtagggtccgtggggacgtgggtactacgtagtacttgagtgaagaaggtcggtacggatacctatatttaccggtgtacgggtactccgggtaaggtaaccggggtcccgttcgaaacctacgtcgtaccgagaacggtaactaagttcgaggacgacncgtcctagtactaactaacgtaaagtacgtaacgacgtccgtaggacgtaccggacggacggtccggacgggtaaccgttacgtttacgttcgtaggtacgagttacggtacgttatacggactccggtccgtccccgtaggtccgtaccttacgtttctttacgaccggtttccggg

SEQ ID NO: 84877 - DNA, 610 bp, Homo sapiens
  misc_feature: GYAE6OF02F4YWJ.47.46.E02.1.454.CMB.1.raw
  modified_base (198)..(198): a, c, t, g, unknown or other
  misc_feature (198)..(198): n is a, c, g, or t
  modified_base (311)..(311): a, c, t, g, unknown or other
  misc_feature (311)..(311): n is a, c, g, or t
tcagagctcacgtacacgaccggtgctcgatttagactcatctacagggaaagggggaggaactgctcagttaggacccagagggaaccatggaagccccagctcagcttctcttcctcctgctactctggctcccagattccaccggagcattgtttgacacagtctccagccacctgtctttgctccaggggaaanacgccaccctctcctgcagggccagtcagaatattcactcctacttagcctggtaccaacagaaacctggtccagctcccaggctcctcactctaatgattgcatccgaaacncggccaactggcactccagccaggtcagtcgcagtgagtcgtggacacgacttcgactctacacctatcagcaagctacgacgactagtaaacatttagctaaccgtttaattaccgtagtaccagtacaacggtaccgtaacgtacaacgttcggtacccttaccgttactaccgtttaccggaccgggtaacggggtaacccgtaggggtacggaacgttaacggtaactaggaaccggtaacgttacgggtacgtccggttacgaccgtaacccgtacgttccgttacgttacccg

SEQ ID NO: 84878 - DNA, 781 bp, Homo sapiens
  misc_feature: GYAE6OF02H9DZ2.47.46.E02.1.454.CMB.1.raw
  modified_base (712)..(712): a, c, t, g, unknown or other
  misc_feature (712)..(712): n is a, c, g, or t
  modified_base (771)..(771): a, c, t, g, unknown or other
  misc_feature (771)..(771): n is a, c, g, or t
tcagagctcacgtacacgaccggtgctcgatttagactcatctacagggaaaggggagctctgagagaggagcccacgccctgggattttctaggtgttttctatttggtgatcaggactgaaccgagagactcaccatggtaggtttgggcgtgagctagtcgttctttcttggtaggttacttttttaaaaggtcgtccagttgttgaggtgctaacgttggttggtagtcggtgggggtatacttacgtaccgtaccggttccggggggtcctaggacgtacttcctccgtgtcgcacgtccttcgtggaccttctaaccgtttacacgtaacttccgtagttcgaggttacgggtcgttaccggggtcgaccggtacgggtccggggtaaccggggggaacggggtacggttggggacggtttacggggtaccttaaggtaacggttagttacggtaaggtaggtaaaggtaaggtacgggtaagggaaacgtcgaactttaacgtttaccgttacggacggttaccgtacggtacgggtaacgggttcccgtactacgtactacctacgacgtaatacgttaagtacgtaggcgaccgtaggtacttagtaacgtactaaagaacgtacgaacgcgtacgtaagacggtactaccgggaaccgacgtaccggtacttacgtactttcggaggtacgtaagtaacgtnttaacgtcggaacttacggtccccgtacccgtaccgaccggttacttccgttttaccgngttacccggg

SEQ ID NO: 84879 - DNA, 648 bp, Homo sapiens
  misc_feature: GYAE6OF02FSW6Q.47.46.E02.1.454.CMB.1.raw
  modified_base (150)..(150): a, c, t, g, unknown or other
  misc_feature (150)..(150): n is a, c, g, or t
  modified_base (210)..(210): a, c, t, g, unknown or other
  misc_feature (210)..(210): n is a, c, g, or t
  modified_base (241)..(241): a, c, t, g, unknown or other
  misc_feature (241)..(241): n is a, c, g, or t
  modified_base (312)..(312): a, c, t, g, unknown or other
  misc_feature (312)..(312): n is a, c, g, or t
  modified_base (363)..(363): a, c, t, g, unknown or other
  misc_feature (363)..(363): n is a, c, g, or t
tcagagctcacgtacacgaccggtgctcgatttagactcatctacaggggaaagggggaggaactgctcagttaggacccagacggaaccatggaagccccagcgcagcttctcttcctcctgctactctggctccagacgaccatgganaaatagtgatgacgctagtcctccagcccaccctgtctcgtcctcctccgaagggaaacncgccaaccatcctccgtggtacgggccgtanaggtagtattagcattcaacttagcctaggtaccagcagacgtaccgtgggcacggcctccgaggcctccntactctatggacttcgcctaccgaccgcgggcctacgttccggttacccgngtaccgttaggtcgaggtcggactgggtaccggtcggtacggagggtaacacgtacgttcccaccgttcctaccaactataccaaccgtacgtcctcgacgtacgtacgtagtaacgttacttacgtacgtttacgtttacttcgttagtcgtacgtacgtaattactacttaacgtaccgtccgtccttcctaccgtaccgttaccggaccgtaacggacgtacgtacggtaggtaaccgaacgttaacggacttcggactcgacaccgtacttagtccttccg

SEQ ID NO: 84880 - DNA, 671 bp, Homo sapiens
  misc_feature: GYAE6OF02FJ2HO.47.46.E02.1.454.CMB.1.raw
  modified_base (149)..(149): a, c, t, g, unknown or other
  misc_feature (149)..(149): n is a, c, g, or t
  modified_base (175)..(175): a, c, t, g, unknown or other
  misc_feature (175)..(175): n is a, c, g, or t
  modified_base (212)..(212): a, c, t, g, unknown or other
  misc_feature (212)..(212): n is a, c, g, or t
  modified_base (310)..(310): a, c, t, g, unknown or other
  misc_feature (310)..(310): n is a, c, g, or t
  modified_base (347)..(347): a, c, t, g, unknown or other
  misc_feature (347)..(347): n is a, c, g, or t
  modified_base (352)..(352): a, c, t, g, unknown or other
  misc_feature (352)..(352): n is a, c, g, or t
  modified_base (412)..(412): a, c, t, g, unknown or other
  misc_feature (412)..(412): n is a, c, g, or t
  modified_base (418)..(418): a, c, t, g, unknown or other
  misc_feature (418)..(418): n is a, c, g, or t
  modified_base (654)..(654): a, c, t, g, unknown or other
  misc_feature (654)..(654): n is a, c, g, or t
tcagagctcacgtacacgaccggtgctcgatttagactcatctacagggaaagggggagaactgctcagttaggacccagacggaaccatggaacgccccagcgcagcttctcttctcctgctactcgtgctcccagataccactgganaaactagtgatgacgcagtcctcgancccaaccttgtacctcgtctctccggaaggggtaaanggccctaaccagtccctacgtggtacggccgtcagagtacttacggcaactctaacgtttagcccgtcggtaaccaggcaagtacggaccgtggaccncggtaccttccccgaggtccctactaccgtagtctanacgtnttacggccaccgtacgaccgggaccacgtacggtacctcccgaggccttaggcgtacggngtacgngggttacggtgacggtacgagtacgttcaactccttacgacctacgttacgacgacctacgtcgtcgtacgtcgtaagttacgacgttagtttaacgtactttagtttactaacttcgtagcgtaactagtttaacttacgtaaccgttcgtacgtaccgttcgtacccggtaacgtacggaccgtagtaacgacggtaaactacggtaaacgtacgcgttacggactaggtaccncgtactcgttacttccg

SEQ ID NO: 84881 - DNA, 891 bp, Homo sapiens
  misc_feature: GYAE6OF02JR2FT.47.46.E02.1.454.CMB.1.raw
  modified_base (205)..(205): a, c, t, g, unknown or other
  misc_feature (205)..(205): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggcctccagacgaccactggagaaatagtgatgacgcagtctccagccacctgtctgtcctcgtcgaagggaacgngacccacacttctccgtaggtacgggcccggtcaaggtagttaacttacgactaactactaacgttacggtccgttacggacctaggacgaaggaccggtaaccggtcggggacctaacgggtcccctaccggaggtccctacccttactacgtaccgtttacgtagtaccgtctaacccggaccttaaacccggaacccggtacgggtaccccgtaacgttccgggaacccttaaaccgtaccccggaaaggtaacccggttagggttaacccgggtaagggtcgggtaacgggtttacgggggttacggggttacgggtaccgggtaacctaacccgggtttactacccgttacccgttccaaacccgtacgtaaccgtacgtaaccggaccgtaaaccgtccggtaaacggtacgttaccgggtaacgttaaaccggttaccggtttaacggttttactttaacgttacggttacgttaacggaccggttacgtaacgggttacccgtttaggtttaaccgttccgggtcgtttaccccgttacctccggttacccgtttaccgggtcccgggggttaccggaacggggtaccggttaagggggtaaccggtggttaaacccggaaccggttaaacggttaccgggtaccgggcggtacccttagggtaccctaccggttcgg

SEQ ID NO: 84882 - DNA, 749 bp, Homo sapiens
  misc_feature: GYAE6OF02GSYXS.47.46.E02.1.454.CMB.1.raw
tcagagctcacgtacacgaccggtgctcgatttagactcatctacagggaaaggggtctgagagaggagcccagccctgggattttcaggtgttttcatttggtgatcaggactgaaccgagagaactcaccatggagtttgggctgagctggctctttcttgtggtctttttaaaaggtgtccagtgtgaggtgctaactgttggagtcgtgggggagtacgttacgtacacccgtcgggggtccctgagactctcctgtcgcacgcctctggacctacctaccgtttagactaacttcgtcgtacacgtggcgtgggtcccaccgagggtccggtaccgggggaagggtccgtagggtaggtcgggtctacgtaagttattacggatacggaaggtaacgttgggtaggaacgtacgtaacgtacgttcgttaccgggtacggtaccgttccgggaacgggtaaccggggtcccggtttaccgacccgtacgttccgtaccgtaaggaacgtaactaacgtttacgaggtacgcgtaacgtctagtactccgtaaacgtaaactacgtaaacgtacgtaccgtagtaacgacgggtaccgtacggaccgacggtaaccgttattaccgtttacgtagtacgtacgtaacggtacttaacggtacggaccgtttaacggtccctaccccggtaacgtaccggtacctttaccgtttcctttacggtacccgttacgggttacccgggg

SEQ ID NO: 84883 - DNA, 657 bp, Homo sapiens
  misc_feature: GYAE6OF02HM33D.47.46.E02.1.454.CMB.1.raw
  modified_base (300)..(300): a, c, t, g, unknown or other
  misc_feature (300)..(300): n is a, c, g, or t
  modified_base (447)..(447): a, c, t, g, unknown or other
  misc_feature (447)..(447): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaataggtgatgacgcagtctcacgccacctgtctgtcctctccgaggggaaacagcccaccatcctcctggtacgggccgtcagagttattagctactacaacttacgccgttacggaccagcaaggacgtaccgtgggacacggtccnccccgaggcctacctacactctaagttcggtatccggaccgtccaaccggacgggtacctcgttccggttacccaggtcctacgggttcaggtcggacaggttcgcgttcgagggactaggtacgtcactctaccactatacaaacncgtacctcgactcgtacgtagaagtttcttacgtacgttacgttttatacgttcgtactagacgtattacgactaacgtacgtcggtaccttcccgtagtacccgttacggaccgtaagggaccgtaaccggtacgtaacgggtaacgtaacgttaaacggtaacgttcggtacggaccgtaccggtacctacctacgttaccgttaccg

SEQ ID NO: 84884 - DNA, 770 bp, Homo sapiens
  misc_feature: GYAE6OF02JMZXW.47.46.E02.1.454.CMB.1.raw
  modified_base (140)..(140): a, c, t, g, unknown or other
  misc_feature (140)..(140): n is a, c, g, or t
  modified_base (263)..(263): a, c, t, g, unknown or other
  misc_feature (263)..(263): n is a, c, g, or t
tcagagctcacgtacacgaccggtgctcgatttagactcatctacagggaaagggggaggaactgctcagttaggacccagagggaaccagtggaagccccagctcagtctctcttcctcctgctactctggcctcccanataccagtcggagtagttgtgttgacacgatctaccacgaccctacccttgttctttcgtctaccgaaggggaaacacgacccacccgttctccgtagcgtacggaccacgtcaagtaacttnttaccaccgttcccgtactacggtcctacggtaacccaagtaaccggaactggtaccaacggtccctaccgacggtcctaccgtactagttctaatccggaatcggactaccgtaaccgaaccgcgggtacccacgtgaccgtactacccagtaaccgttcggttaccggaggtaccggtacgtacggtttgggtacccgagggaccgtacggtaccttacccgtactacccgtactaaacccgatacgggaccgtacacccgtacgtacgacgtacccgtagttaaccgttacgttaacgttacttcgttagtactacgagtctaacgttctacgtcgttccggacgtcccgtttccgaacttacccgggtttacgtacccgggggtaccggacggttaacccgggtagggtaacggttacggacttaacgggaagttaaccggtaccgggtttaggaccggtaccttaccggacccggtaccttaacgttcggttacccgttccg

SEQ ID NO: 84885 - DNA, 775 bp, Homo sapiens
  misc_feature: GYAE6OF02G3LAV.47.46.E02.1.454.CMB.1.raw
  modified_base (202)..(202): a, c, t, g, unknown or other
  misc_feature (202)..(202): n is a, c, g, or t
  modified_base (279)..(279): a, c, t, g, unknown or other
  misc_feature (279)..(279): n is a, c, g, or t
  modified_base (769)..(769): a, c, t, g, unknown or other
  misc_feature (769)..(769): n is a, c, g, or t
tcagagctcacgtacacgaccggtgctcgatttagactcatctacagggaaagggtctgagagaggagcccagcccgtgggtattttcaggttgttttcatttggtgatcaggactgaacagagagaactcaccagtggtagttggctgaccgtggtcttttcgtgtggtacttaattttaaaagtgtcctagtgtgaggtncgtagtcgttggtggtaggtcggtggggacgtcgttagtacgagtccgggttggggtccctgacgtacgtcctccgngcctcgacgtccgtacgtcggtactttcccttagttttaacgtagttacttcgaccgttaggttacggtccggttacggtcccgccgtaccgggacgttaccgggaaggggttacgggcgttaggggtacggttagggtcgttacggacggttagttaggttttacggggaggggttgtaccggttagacccgtaaagtccggaaacctttaagtttaacccggtaaccgttaccgcgtaccggtacggtaccgttaacgttttcgtttaccgttacgtaccgtaagaccgtaacgttaccgacgtaaacgttactaacgttacgtcgtagtacctgtaccgtgttacgaacgtagccgtagacgtacgtacgacgtaccgtcggtacttacgttaacgtagttgttaaagttacggtacgttggtacggtcttacggtaaccgtaggttccgggtccgggtaacggtccttccggtaagttccccgttntcccgg

SEQ ID NO: 84886 - DNA, 860 bp, Homo sapiens
  misc_feature: GYAE6OF02I6HHS.47.46.E02.1.454.CMB.1.raw
tcagagctcacgtacacgaccggtgctcgatttagactcatctacaggggaaagggggaggaactgctcagttaggacccagagggaaccatggaagccccagctcagcttctcttcctcctgctactctggctcccagataccatcggagtaagttgtgttagacactagtctccagcccaccctgttcctttgtcctccggaaggggaaacacggccctaccccgtctccgtggccgagggccagtacaggtaattacgtctacctccttacttacgccgttacgtaaccaacgaacgtaaccctggtaccgacggcctaccggtacggccttccactacgttcttatacgagtacgacctactacccgaaacggcgggtacccacgtcggacctacgtacccgagttaacggcggtttacgacggtggaccgttacgggttcggggtacgtaccggggacgttaacggttcctaccgtaccgtttccaaccgtaaccgtactttaaccgacgtactaacccggtccgtaacggtacccgtaacgtttacggtaaaccgtttaggtttaacggttaacctttttaacggttaccgtaacgtttaccgaccggtacggtaccggtccgtttaagggttccggtttacccggttcgttaccccggttccgttaccggtttaacccgttcggggtttaccggggaccgggtaaaccggggtacggttaacgggggtaaccggtccggtttaaaacgtcccggggtaaaccgtttaccggttacgggtaaacggttcccgtacccggtttaaccctaacccggttaaccgttttcccggtttaccttccccggtttaacccg

SEQ ID NO: 84887 - DNA, 755 bp, Homo sapiens
  misc_feature: GYAE6OF02HZ63P.47.46.E02.1.454.CMB.1.raw
  modified_base (749)..(749): a, c, t, g, unknown or other
  misc_feature (749)..(749): n is a, c, g, or t
tcagagctcacgtacacgaccggtgctcgatttagactcatctacaggggaaagggggaggaactgctcagttaggacccagacggaaccatggaagccccagcgcagcttctcttcctcctgctactctggctccagacgaccactggagaaatagtgatgacgcagtctcagccaccctgtctgtctcgtccgaagggggaaacacgtcccaacctagttccttaccgttggaaccgggggtcccggtacgtaggtagttaagtttacgcctaacttaccgttaaactttacggcccgtaggttaaccgacggcgaacggtacggaaccggttcgggacgtacgggtccttacccggacggtcccgttaccctagttaaacgtttcgtacggtacctaagtaaccgaaacgtacgggtaccctacgtacggtaaccacttccccgaagtaccgaggttaaccttacggcggtaccgggtacgtaaggtcggtacggtccggtagggaccgtactaccgttactacccttacgtacctaacctacgtacgacgaccgtaagtacggtacgtagacctaggtaacgttacgttttacgacgtactacgttactacgtcgtcgtacgacgtacgttagtagttacgggtacacgtacgtaccggtacggttccgacgggtacggacggtaacgggtacgtaacgtacgtaacggtaacgtacgtcggtccgtacgaccgacgttaaccgngttacg

SEQ ID NO: 84888 - DNA, 677 bp, Homo sapiens
  misc_feature: GYAE6OF02GB0FT.47.46.E02.1.454.CMB.1.raw
  modified_base (643)..(643): a, c, t, g, unknown or other
  misc_feature (643)..(643): n is a, c, g, or t
tcagagctcacgtacacgaccggtgctcgatttagactcatctacaggggaaagggggaggaactgctcagttaggacccagacggaaccatggaagccccagcgcagcttctcttcctcctgctactctggctcccagactaccagtcggagaagttgtgttagacactagtctccacgcctaccctggttctttcgtcctaccggaaggggaaacgcgccctaccgttctccgtcgacggacgggcctaagtcaacgtaattactccaccttcctaacttacgccgtagtaaccaacgtaacgaaccgttcggtcgacgggtcctaccgtacggtcctcctacgtacttaccgttagtcgtactcgacctacgtaaccaacggtaccggcctaacgcgtactaccaccaacgtacggtaggttcgacggtcggtacgtacggtcgggtacgtacggtaacgacggttctaaccgtctaccgtactaccgtataccacgacgacgtacgtacgacgtacgtacggaacgttacgttacgttactttacgtacgttctaccgatcgacgtcgtcgtcgtcgtcgccttcgctcgtcgtcgacggaccggtcgacggtacgagaacgaacgtaacgtacgggtntgtacgcgtaacaccgtgtccgttcgtcggttcc

SEQ ID NO: 84889 - DNA, 870 bp, Homo sapiens
  misc_feature: GYAE6OF02GPT3D.47.46.E02.1.454.CMB.1.raw
  modified_base (294)..(294): a, c, t, g, unknown or other
  misc_feature (294)..(294): n is a, c, g, or t
tcagagctcacgtacacgaccggtgctcgatttagactcatctacagggaaaggggtctgagagaggagcccagcccgtgggattttcaggtgttttcatttggtgatcgaggactgaaccgagagaactcaccatggaggtttgggctgagcgtggcttctttcgttggtggttacttttttaaaaggtgtcctagtgtgtacggtgactacgtgttggagtcggtagggggacgtacgttaaggtaccgacccggtcgggggtcccctgacgtactccgtccgtggtcgccncgcctcgtcggccttacctaccttagacctaccgttcgtgtacgacgttcgggcgttcggggtccggccgacgggcccggtcggggggaacgggtcgtagggcgggtcggtacgtacgtaagttacgtttggtagtaggtaagtaaggttgggtacggaacgtcgtaacgttacgttaccgttacggtacggtaaccggttccgggttaagggaaccgggggtttacccgtcccgtaaccggtaccgttaccgtaccgtaaacggacgtaaaccgttacgtttaccggaccgggtacgaccgacggttacgtcccgttaacttaacggtaacgtaacgtaacgtaacccgtatagggtacgtaaggaacccgggtaccgggaaaccgtaccccgggacggtttaaccccgttaacggttttccgttacggttaacgggttacgtaacggtttaacgttccggtttaagaacggttcccgttaccgggtacccccgggttacccctaaccgggtccgtttacccgttaacgtttttaccccgggttgtttacccgggttacccgggtaaccccgggg

SEQ ID NO: 84890 - DNA, 803 bp, Homo sapiens
  misc_feature: GYAE6OF02FNDX5.47.46.E02.1.454.CMB.1.raw
  modified_base (173)..(173): a, c, t, g, unknown or other
  misc_feature (173)..(173): n is a, c, g, or t
  modified_base (201)..(201): a, c, t, g, unknown or other
  misc_feature (201)..(201): n is a, c, g, or t
  modified_base (244)..(244): a, c, t, g, unknown or other
  misc_feature (244)..(244): n is a, c, g, or t
  modified_base (612)..(612): a, c, t, g, unknown or other
  misc_feature (612)..(612): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccacgtggagaaatgtgatgacgcagtctccngcccacctgctgtctctccgagggaacngcctacatccgtctcggtacgggccgtacaggtagtattacgntactacaacgttggccctggaccagcaggaacgccgtaggggccaacggccctaccgaggcccttccctacgtcttacgtagtcgtacgtcggacccgtaccgaacccggcgggaccccgttaaccggtttcgggttttacccccgacgggtacccgttacgggtttaccgagggtttccgggacgtacggtttccggccgggtttccgggaacgggggtaactaagtttaccggttccctaacccgtttccgttaacccgaactaaccgtacccgttaaccgaacccgttcggtacgtaccggttacggtaccgtttaaggtaaccggtttattttacggtacttttaaggtttttaccttacgttnttaaccggattaccgttaagttaccttacgttaaactaccggggttccggtacccgttacccttaacccgttaccccggaccgggttacccggaaggacccgggtaaccgtacggttaacgggaacttaaacggtaaccgttacggttcggggacttaccggtacccgtaccgtaccttaccggttatccg

SEQ ID NO: 84891 - DNA, 922 bp, Homo sapiens
  misc_feature: GYAE6OF02FKDXL.47.46.E02.1.454.CMB.1.raw
  modified_base (185)..(185): a, c, t, g, unknown or other
  misc_feature (185)..(185): n is a, c, g, or t
  modified_base (875)..(875): a, c, t, g, unknown or other
  misc_feature (875)..(875): n is a, c, g, or t
  modified_base (896)..(896): a, c, t, g, unknown or other
  misc_feature (896)..(896): n is a, c, g, or t
tcagagctcacgtacacgaccggtgctcgatttagactcatctacagggaaagggggctctgagagaggagcccagccctgggattttcaggtgttttcatttggtgatcaggactgaaccgagagaacctcaccatggtaggtttgggctgagctggcttctttctgtggttacttttaaaggntcagtgtgagtgactaagttgtggtaggtcgtaggggactacgttagtactacccggtgggggtccctggacgtaccttcctaccgtgtcgacgtaccgtccgtcgtacggtacctccgttacctttaacgccttaaaccgttctttacgtccgtaacggttcggggtccgttccgggggtacccgtaccggacccggggttaccgggggacccgggggggtaacggggttcccggttggggtaaacggggtttcgggtttaaccgttaacggtaaacggtttaggtttacggaagtttaacggggtaaacgtacgggttaagggtacggaaaccggtccgttaaacgtttacccgtttaaccgggtaccggggtttacggtaccccgggttaccgggttaacggggtaaccccgggggtttacccgttaacccgttaacccggttaccgttacccggttaaccgtaaacggtaacccgttaaacggttaaacgttttcgggaaacgggtaccaaccggtccggtacgtttaactttacccgtaagtaaaaccgtacgtaccggaaacttccgggacttaacgggaccgggaccggtaacgaacgggtacccgttaacgggttcccgtttaaattcgtttacgaggttacgacggttaattaaccggcttaaccgacgtcccggtacccnccgtgtacccttacccgtttntttacccggttgtccgttaaccgggg

SEQ ID NO: 84892 - DNA, 592 bp, Homo sapiens
  misc_feature: GYAE6OF02FNHFE.47.46.E02.1.454.CMB.1.raw
  modified_base (204)..(204): a, c, t, g, unknown or other
  misc_feature (204)..(204): n is a, c, g, or t
  modified_base (289)..(289): a, c, t, g, unknown or other
  misc_feature (289)..(289): n is a, c, g, or t
  modified_base (328)..(328): a, c, t, g, unknown or other
  misc_feature (328)..(328): n is a, c, g, or t
  modified_base (398)..(398): a, c, t, g, unknown or other
  misc_feature (398)..(398): n is a, c, g, or t
  modified_base (408)..(408): a, c, t, g, unknown or other
  misc_feature (408)..(408): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagcccaccctgtctgtctctccgaggggaaangccaccatctcctggtagggccgtcagagtattagcatcaacttgcctggtaccagcagagacctgggcaggctcccaggctccncatctatgtgcgtccacagggccactggtttcccagccnggttcagtcggcagtgcggtctgggacagtagttccgactctctaccatacaactacgcctgctacggtntagaacgttntttcgacttagtttaattactgttcaagtctacgtatactaattacgtccgggccgtccttaccgtacccgtttccggaccgaacggggtaacccaccgggaaccggtagtaaaccggttaaaccgtaacgttcgggtcggtaccgtacgacccgtaaccacggttccttcggttaccttaccg

SEQ ID NO: 84893 - DNA, 986 bp, Homo sapiens
  misc_feature: GYAE6OF02HRO2B.47.46.E02.1.454.CMB.1.raw
  modified_base (96)..(96): a, c, t, g, unknown or other
  misc_feature (96)..(96): n is a, c, g, or t
tcagagctcacgtacacgaccggtgctcgatttagactcatctacagggaaagggggaggaactgctcagttaggacccagacggaaccatggaanccccagcgcagcttctcttcctcctgctactctggcctcccagagaccactggagaaatagtgatgacgcagtctccacgcccaccctgtctgtcctctaccgaaggggaaacacgcccaaccattcctccgtaggtacgggtccggtacaaggtagttattacgactaagttacctaaacgttacgtacccggttacggttaccccgaaggtaccgaaaacgggaccggtacccggtttacgggggacccgtacggggtacccccttaccccccggtaacgggggtcccccttttacccctaccgtacggttacccttaaagttcggtacgttaccgacccttaccttaacccccggaaacggttaccggggaccccttaacggtaccggtaacccgaccccgttaaccccggaacgtaaccggttacgttaaccggttacgggtacggggtaccggtttacgggtttcgggggtaacccgggtagggtaacccgttaacggttacccgtttacctaaccggtttacccctaacccgtaacccaaccggtttaaccgaacccggtaaccggtaacccggttaaccggtaacgggtacccgtacggttaaacgggttaaacggttttaaccggttttaacggttttaacttttaacccgtttacggttaccgggtacgttaacggcgtaacccggttacgggttacgttaaccggtttcggtacccggttacccgttccccggtacgttaccgtttacccgggtaccggggttaacgggtacccggggtaacccgggttgggtaaccggtaacgggtaaccgttaaaccggtaaacgttaccgggttaacggtaccgggttacccgtacgtaaccccgtgtttaaacccg

SEQ ID NO: 84894 - DNA, 856 bp, Homo sapiens
  misc_feature: GYAE6OF02FMTM5.47.46.E02.1.454.CMB.1.raw
  modified_base (151)..(151): a, c, t, g, unknown or other
  misc_feature (151)..(151): n is a, c, g, or t
  modified_base (204)..(204): a, c, t, g, unknown or other
  misc_feature (204)..(204): n is a, c, g, or t
tcagagctcacgtacacgaccggtgctcgatttagactcatctacagggaaagggggaggaactgctcagttaggacccagacggaaccatggaagccccagcgcagcttctcttcctcctgctactctggcctcccagagaccactgganaaatagtgatgacgcagtctccagcccaccctgtctgtctctaccgagggaangccacctatccgtctggtacgggccgtacaaggtagtaattacgactaacttacctaaacgtttagcccgttaggtaacccagacgaaggacgtaccggtggggacacggtccctacccggacggtcctacccgtctaacttcctaagttcgtactccgaccgtacccaccggtaccggtacctaccgtttcggttaccccgaacggtacccgtacgggtttaccgaggttaccggtacgtacggttccggtaccggtttacgggtacggggtaactaacggttaaccgtttccaaacccgttcctaaccgtaaccgtaaccgtaccgaaaaccgcccggttacctaggtaacccgttacggttacgttaacgggttaaagttttcgttttacggtaacctttttaaggttttaaccgttttacccgttacggtttaacgtacggtaacccttaagttacccttaacggttaactttaacccggggtccggtacccgttaaccctttaacccggtaccgggttacccggtaacccgtaaccggggttacccaccgggtaaccgtaagggttaaaccttaaaccggttaaaccggtacgttacggttaacggtccggttaaaccgtcccgttaaacgttccgttacgttaccg

SEQ ID NO: 84895 - DNA, 422 bp, Homo sapiens
  misc_feature: GYAE6OF01AHDC0.34.46.E02.1.454.CMB.1.raw
  modified_base (418)..(422): a, c, t, g, unknown or other
  misc_feature (418)..(422): n is a, c, g, or t
tcagtacacgtgatcacgaccggtgctcgatttagactcatctacagggaaagggactggagtggattgggtatatctttcacagtgggaccaccacctacaacccttccctcgagagtcgagtcaccatctcaatagacacgtccaagaagcagttctccctacagctgacctctgtgaccgctgcggacacggccgtatattactgtgcgagaggtttcgataccttgacctactccaactactttgactactggggccagggaaccctgatcaccgtctcctcaacctccaccaagggcccatcggtctccccctggcaccctcctccaagagcacctctggggcacagcggccctggctgcctggtcaggactactccatcacgtgtactgagcgggctggcaaggcgcatagnnnnn

SEQ ID NO: 84896 - DNA, 424 bp, Homo sapiens
  misc_feature: GYAE6OF01ENRA7.34.46.E02.1.454.CMB.1.raw
  modified_base (421)..(424): a, c, t, g, unknown or other
  misc_feature (421)..(424): n is a, c, g, or t
tcagtacacgtgatcacgaccggtgctcgatttagactcatctacagggaaagggactggagtggattgggtatatctttcacagtgggaccaccacctacaacccttccctcgagagtcgagtcaccatctcaatagacacgtccaagaagcagttctccctacagctgacctctgtgaccgctgcggacacggccgtatattactgtgcgagaggtttcgataccttgacctactccaactactttgactacgtggggccagggaccctgatcaccgtctcctcaacctccaccaagggcccatcggtcttccccctggcaccctcctccaagagcacctctggggcacagcggccctgggctgcctggtcaaggctacttccatcacgtgtactgagcgggctggcaaggcgcatagnnnn

SEQ ID NO: 84897 - DNA, 423 bp, Homo sapiens
  misc_feature: GYAE6OF01CP7VZ.34.46.E02.1.454.CMB.1.raw
  modified_base (420)..(423): a, c, t, g, unknown or other
  misc_feature (420)..(423): n is a, c, g, or t
tcagtacacgtgatcacgaccggtgctcgatttagactcatctacagggaagggactggagtggattgggtatatctttcacagtgggaccaccacctacaacccttccctcgagagtcgagtcaccatctcaatagacacgtccaagaagcagttctccctacagctgacctctgtgaccgctgcggacacggccgtatattactgtgcgagaggtttcgataccttgacctactccaactactttgactactggggccagggaacctgatcaccgtctcctcaacctccaccaagggcccatcggtcttcccccctggcaccctcctccaagagcacctctgggggcacagcgccctgggctgcctggtcaaggactactccatcacgtgtactgagcgggctggcaaggcgcatagnnnn

SEQ ID NO: 84898 - DNA, 425 bp, Homo sapiens
  misc_feature: GYAE6OF01BI0DJ.34.46.E02.1.454.CMB.1.raw
  modified_base (420)..(425): a, c, t, g, unknown or other
  misc_feature (420)..(425): n is a, c, g, or t
tcagtacacgtgatcacgaccggtgctcgatttagactcatctacagggaagggactggagtggattgggtatatctttcacagtgggaccaccacctacaacccttccctcgagagtcgagtcaccatctcaatagacacgtccaagaagcagttctccctacagctgacctctgtgaccgctgcggacacggccgtatattactgtgcgagaggtttcgataccttgacctactccaactactttgactactggggccagggaaccctgatcaccgtctcctcaacctccaccaagggcccatcggtcttcccctggcaccctcctccaagagcacctctggggcacagcggccctgggctgccgtggtcaaggactactccatcacgtgtactgagcgggctggcaaggcgcatagnnnnnn

SEQ ID NO: 84899 - DNA, 426 bp, Homo sapiens
  misc_feature: GYAE6OF01DAAAX.34.46.E02.1.454.CMB.1.raw
  modified_base (418)..(426): a, c, t, g, unknown or other
  misc_feature (418)..(426): n is a, c, g, or t
tcagtacacgtgatcacgaccggtgctcgatttagactcatctacagggaagggactggagtggattgggtatatctttcacagtgggaccaccacctacaaccccttccctcgagagtcgagtcaccatctcaatagacacgtccaagaagcagttctccctacagctgacctctgtgaccgctgcggacacggccgtatattactgtgcgagtaggtttcgataccttgacctactccaactactttgactacgtggggccagggaaccctgatcaccgtctcctcaacctccaccaaggcccatcggtcttccccctggcaccctcctccaagacgcacctctggggcacagcgcctggctgctggcaaggactactccatcacgtgtactgagcgggctggcaaggcgcatagnnnnnnnnn

SEQ ID NO: 84900 - DNA, 429 bp, Homo sapiens
  misc_feature: GYAE6OF01D5DWK.34.46.E02.1.454.CMB.1.raw
  modified_base (183)..(183): a, c, t, g, unknown or other
  misc_feature (183)..(183): n is a, c, g, or t
  modified_base (417)..(417): a, c, t, g, unknown or other
  misc_feature (417)..(417): n is a, c, g, or t
  modified_base (419)..(429): a, c, t, g, unknown or other
  misc_feature (419)..(429): n is a, c, g, or t
tcagtacacgtgatcacgaccggtgctcgatttagactcatctacagggaagggactggagtggattgggtatatctttcacagtgggaccaccacctacaacccttccctcgagagtcgagtcaccatctcaatagacacgtccaagaagcagttctccctacagctgacctctgtgaccgntgcggacacggccgtatattactgtgcgagtaggtttcataccttgacctactccaacttactttgactacgtggggccagggaccctgatcaccgtctcctcaacctccaccaggccatcggtctcccctggcaccctcctccagcgcacctctggggcacacgcggccctggctgcctggcaaggctacttccatccacgtgtactgagcgggctggcaagggcgcagtagngnnnnnnnnnnn

SEQ ID NO: 84901 - DNA, 424 bp, Homo sapiens
  misc_feature: GYAE6OF01AMNQH.34.46.E02.1.454.CMB.1.raw
  modified_base (421)..(424): a, c, t, g, unknown or other
  misc_feature (421)..(424): n is a, c, g, or t
tcagtacacgtgatcacgaccggtgctcgatttagactcatctacagggaagggactggagtggattgggtatatctttcacagtgggaccaccacctacaacccttccctcgagagtcgagtcaccatctcaatagacacgtccaagaagcagttctccctacagctgacctctgtgaccgctgcggacacggccgtatattactgtgcgagaggtttcgataccttgacctactccaactactttgactactggggccagggaaccctgatcaccgtctcctcaacctccaccaagggcccatcggtcttccccctggcaccctcctccaagagcacctctgggggcacagcggccctgggctgcctggtcaggactacttccatcacgtgtactgagcgggctggcaaggcgcatagnnnn

SEQ ID NO: 84902 - DNA, 438 bp, Homo sapiens
  misc_feature: GYAE6OF01EQU29.34.46.E02.1.454.CMB.1.raw
  modified_base (319)..(319): a, c, t, g, unknown or other
  misc_feature (319)..(319): n is a, c, g, or t
  modified_base (329)..(329): a, c, t, g, unknown or other
  misc_feature (329)..(329): n is a, c, g, or t
  modified_base (421)..(438): a, c, t, g, unknown or other
  misc_feature (421)..(438): n is a, c, g, or t
tcagtacacgtgatcacgaccggtgctcgatttagactcatctacagggaagggactggagtggattgggtatatctttcacagtgggaccaccacctacaacccttccctcgagagtcgagtcaccatctcaatagacacgtccaaagaagcagttctccctacagctgacctctgtgaccgctgcggacacggccgtatattactgtgcgagtaggtttcgattaccttgaacctactaccaacttactttgactacgtggggccaagggacctgatcaccgtctcctcacctccacaacggccatcggtctccccngccacctccnccagacgcacctcgtggggcacacgcggccctggctcgctggtcaaggctactcatcacgttgactgagcggcgtggacaagcgcagtacgnnnnnnnnnnnnnnnnnn

SEQ ID NO: 84903 - DNA, 467 bp, Homo sapiens
  misc_feature: GYAE6OF01CSCEK.34.46.E02.1.454.CMB.1.raw
  modified_base (316)..(316): a, c, t, g, unknown or other
  misc_feature (316)..(316): n is a, c, g, or t
  modified_base (320)..(320): a, c, t, g, unknown or other
  misc_feature (320)..(320): n is a, c, g, or t
  modified_base (327)..(327): a, c, t, g, unknown or other
  misc_feature (327)..(327): n is a, c, g, or t
  modified_base (333)..(333): a, c, t, g, unknown or other
  misc_feature (333)..(333): n is a, c, g, or t
  modified_base (446)..(446): a, c, t, g, unknown or other
  misc_feature (446)..(446): n is a, c, g, or t
  modified_base (452)..(467): a, c, t, g, unknown or other
  misc_feature (452)..(467): n is a, c, g, or t
tcagtacacgtgatcacgaccggtgctcgatttagactcatctacagggaagggactggagtggattgggtatatctttcacagtgggaccaccacctacaacccttccctcgagagtcgagtcaccatctcaatagacacgtccaagaagcagttctccctacagctgacctctgtgaccgctgcggacacggccgtatattactgtgcgagaggtttcgataccttgacctactccaactctttgactacgtggggccagggaacctgatcaccgtctcctcaacctccaccaaggcccatcggtccttccccngccnccctccncagacncacctcgtcggggcacgacggccggtcccgtcggggctcggccgtgggtacaaacgggtacctaccgtccaactcaacggttcgtacgtgacggcgggtcgtggcgaaggcgnactagnnnnnnnnnnnnnnnn

SEQ ID NO: 84904 - DNA, 500 bp, Homo sapiens
  misc_feature: GYAE6OF01A7Q0A.34.46.E02.1.454.CMB.1.raw
  modified_base (337)..(337): a, c, t, g, unknown or other
  misc_feature (337)..(337): n is a, c, g, or t
  modified_base (470)..(470): a, c, t, g, unknown or other
  misc_feature (470)..(470): n is a, c, g, or t
  modified_base (472)..(500): a, c, t, g, unknown or other
  misc_feature (472)..(500): n is a, c, g, or t
tcagtacacgtgatcacgaccggtgctcgatttagactcatctacagggaagggactggagtggattgggtatatctttcacagtgggaccaccacctacaacccttccctcgagagtcgagtcaccatctcaatagacacgtccaagaagcagttctccctacagctgacctctgtgaccgctgcggacacggcctatattactgtgcgagaggtttcattaccttgaccttactccaacttactttgacttacgtggggccagggaaccctgatcaccgtctcctcaacctccaccaggcccatcggtcctccccctgccaccctcctccaagcncaccctcgtcggggcacgacgccgggccctgggcctcgcctcgggtacaacggtacctaaccgttccacgtaccacggttcggtacttggacggtcgggccgtaggaccgtaacggggcctacgaagttcggncnnnnnnnnnnnnnnnnnnnnnnnnnnnnn

SEQ ID NO: 84905 - DNA, 473 bp, Homo sapiens
  misc_feature: GYAE6OF01A651A.34.46.E02.1.454.CMB.1.raw
  modified_base (345)..(345): a, c, t, g, unknown or other
  misc_feature (345)..(345): n is a, c, g, or t
  modified_base (442)..(473): a, c, t, g, unknown or other
  misc_feature (442)..(473): n is a, c, g, or t
tcagtacacgtgatcacgaccggtgctcgatttagactcatctacagggaagggactggagtggattgggtatatctttcacagtgggaccaccacctacaacccttccctcgagagtcgagtcaccatctcaatagacacgtccaagaagcagttctccctacagctgacctctgtgaccgctgcggacacggccgtatattactgtgcgagaggtttcgaataccttgacctactccaacttctttgactacgtggggaccagggaaccctgatcaccgtctcctcaacctccaccgaaggcccatccggtccttccccctggcccaccctcctaccaagacnccacctcgtggggcacgacgccggcccgtggctcgcctggcaaggactactccatcacgtgtactgaggcgggctggacaacgggtcgcaagtacgnnnnnnnnnnnnnnnnnnnnnnnnnnnnnnnn

SEQ ID NO: 84906 - DNA, 548 bp, Homo sapiens
  misc_feature: GYAE6OF01ART76.34.46.E02.1.454.CMB.1.raw
  modified_base (513)..(548): a, c, t, g, unknown or other
  misc_feature (513)..(548): n is a, c, g, or t
tcagtacacgtgatcacgaccggtgctcgatttagactcatctacagggaagggactggagtggattgggtatatctttcacagtgggaccaccacctacaaccccttccctcgagagtcgagtcaccatctcaatagacacgtccaagaagcagttctccctacagctgacctctgtgaccgctgcggacacggccgtatattactgtgcgagtaggtttcgattaccttgaccttactccaacttactttgactacgtggggccagggaaccctgatcaccgtctcctacaacctccaccaacgggccccagtccggttccttccccccgtcggccacccctcctccgaagacgccacccgtcgtcgggggaccacgacggccggcccgtggggcctcggcccgttcgggtcaaacgggacccttaccttcctaatcccgtaacggttcggtacgtacgggacgggccggggtcgtgggaccggaacggggtccgacgtaacgtagtcgannnnnnnnnnnnnnnnnnnnnnnnnnnnnnnnnnnn

SEQ ID NO: 84907 - DNA, 434 bp, Homo sapiens
  misc_feature: GYAE6OF01BI608.34.46.E02.1.454.CMB.1.raw
  modified_base (342)..(342): a, c, t, g, unknown or other
  misc_feature (342)..(342): n is a, c, g, or t
  modified_base (397)..(397): a, c, t, g, unknown or other
  misc_feature (397)..(397): n is a, c, g, or t
  modified_base (419)..(434): a, c, t, g, unknown or other
  misc_feature (419)..(434): n is a, c, g, or t
tcagtacacgtgatcacgaccggtgctcgatttagactcatctacagggaagggactggagtggattgggtatatctttcacagtgggaccaccacctacaacccttccctcgagagtcgagtcaccatctcaatagacacgtccaagaagcagttctccctacagctgacctctgtgaccgctgcggacacggccgtatattactgtgcggagtaggtttcgattaccttgacccttactcccaaacttacctttgaccttactggggccagggaaccctgactcaccgtctcctcacctcaccaaggcccatcggtctcccctggcacctcctcagcgcncctctgggcacgagcggccctggctgcctgtcaaggcacttccatcactgtactnagcggctggcaggcgcatacgnnnnnnnnnnnnnnnn

SEQ ID NO: 84908 - DNA, 428 bp, Homo sapiens
  misc_feature: GYAE6OF02GQQ2U.34.46.E02.1.454.CMB.1.raw
  modified_base (423)..(428): a, c, t, g, unknown or other
  misc_feature (423)..(428): n is a, c, g, or t
tcagtacacgtgatcacgaccggtgctcgatttagactcatctacagggaagggactggagtggattgggtatatctttcacagtgggaccaccacctacaacccttccctcgagagtcgagtcaccatctcaatagacacgtccaagaagcagttctccctacagctgacctctgtgaccgctgcggacacggccgtatattactgtgcgagaggtttcgataccttgacctactccaactactttgactactggggccagggaaccctgatcaccgtctcctcagcctccaccaagggccccatcggtcttccccctggcgccctgctccaggagcacctccgagagcacagcggccctggggctgcctggtcaaggctacttccatcacgtgtactgagcgggctggcaaggcgcatagnnnnnn

SEQ ID NO: 84909 - DNA, 433 bp, Homo sapiens
  misc_feature: GYAE6OF02IXU2E.34.46.E02.1.454.CMB.1.raw
  modified_base (287)..(287): a, c, t, g, unknown or other
  misc_feature (287)..(287): n is a, c, g, or t
  modified_base (424)..(433): a, c, t, g, unknown or other
  misc_feature (424)..(433): n is a, c, g, or t
tcagtacacgtgatcacgaccggtgctcgatttagactcatctacagggaaagggactggagtggattgggtatatctttcacagtgggaccaccacctacaacccttccctcgagagtcgagtcaccatctcaatagacacgtccaagaagcagttctccctacagctgacctctgtgaccgctgcggacacggccgtatattactgtgcgagaggtttcgataccttgacctactccaaacttacttgactactggggccagggaaccctgatcaccgtctcctnaacctccaccaaggcccatcggtctccccctggcaccctcctccaagagcacctctgggggcacagcggccctggctgccctggtcaaggactacgttccatcacgtgtactgagcgggctggcaaggcgtcatagnnnnnnnnnn

SEQ ID NO: 84910 - DNA, 449 bp, Homo sapiens
  misc_feature: GYAE6OF02JWZEJ.34.46.E02.1.454.CMB.1.raw
  modified_base (402)..(402): a, c, t, g, unknown or other
  misc_feature (402)..(402): n is a, c, g, or t
  modified_base (432)..(449): a, c, t, g, unknown or other
  misc_feature (432)..(449): n is a, c, g, or t
tcagtacacgtgatcacgaccggtgctcgatttagactcatctacagggaagggactggagtggattgggtatatctttcacagtgggaccaccacctacaacccttccctcgagagtcgagtcaccatctcaatagacacgtccaagaagcagttctccctacagctgacctctgtgaccgctgcggacacggccgtatattactgtgcgagaggtttcgataccttgacctactccaactactttgactactgggggccagggaaccctgatcaccgtctcctcaacctccaccaacggccatcggtccttccccctggccacccctcctccaacgacgcaccctcgtcggggcaccgagccggcccgtggctcgcctggtcaaggctactcatcacgtntactgacgcgggctggacaggcgcagtagnnnnnnnnnnnnnnnnnn

SEQ ID NO: 84911 - DNA, 428 bp, Homo sapiens
  misc_feature: GYAE6OF02HYJB2.34.46.E02.1.454.CMB.1.raw
  modified_base (422)..(428): a, c, t, g, unknown or other
  misc_feature (422)..(428): n is a, c, g, or t
tcagtacacgtgatcacgaccggtgctcgatttagactcatctacagggaagggactggagtggattgggtatatctttcacagtgggaccaccacctacaacccttccctcgagagtcgagtcaccatctcaatagacacgtccaagaagcagttctccctacagctgacctctgtgaccgctgcggacacggccgtatattactgtgcgagaggtttcgataccttgacctactccaactactttgactactggggccagggaaccctgatcaccgtctcctcaacctccaccaagggcccatcggtcttccccctggcaccctcctccaagagcacctctgggggcacagcggccctgggctgcctggtcaaggactacttccatcacgtgtactgagcgggctggcaaggcgcatagnnnnnnn

SEQ ID NO: 84912 - DNA, 441 bp, Homo sapiens
  misc_feature: GYAE6OF02HVP0G.34.46.E02.1.454.CMB.1.raw
  modified_base (429)..(441): a, c, t, g, unknown or other
  misc_feature (429)..(441): n is a, c, g, or t
tcagtacacgtgatcacgaccggtgctcgatttagactcatctacaggggaagggactggagtggattgggtatatctttcacagtgggaccaccacctacaacccttccctcgagagtcgagtcaccatctcaatagacacgtccaagaagcagttctccctacagctgacctctgtgaccgctgcggacacggccgtatattactgtgcgagaggttttcgataccttgaccctactccaacttactttgactacgtggggccagggaaccctgatcaccgtctcctcaacctccaccaagggcccatcggtcttccccctggcaccctcctccaagagaccacctctgggggcacagcggccctgggctgcctggtcaaggactacttccatcacgtgtactgagcggctggacaaggcgcatagnnnnnnnnnnnnn

SEQ ID NO: 84913 - DNA, 467 bp, Homo sapiens
  misc_feature: GYAE6OF02G9JY4.34.46.E02.1.454.CMB.1.raw
  modified_base (207)..(207): a, c, t, g, unknown or other
  misc_feature (207)..(207): n is a, c, g, or t
  modified_base (334)..(334): a, c, t, g, unknown or other
  misc_feature (334)..(334): n is a, c, g, or t
  modified_base (431)..(431): a, c, t, g, unknown or other
  misc_feature (431)..(431): n is a, c, g, or t
  modified_base (436)..(467): a, c, t, g, unknown or other
  misc_feature (436)..(467): n is a, c, g, or t
tcagtacacgtgatcacgaccggtgctcgatttagactcatctacagggaagggactggagtggattgggtatatctttcacagtgggaccaccacctacaacccttccctcgagagtcgagtcaccatctcaatagacacgtccaagaagcagttcctccctacagctgacctctgtgaccgctgcggacacggccgtatattacngtgcgagaggtttcgattaccttgacctactccaaacttactttgactacgtggggccaagggaaccctgatcaccgtctcctcaacctccacaaggccatcggtctcccctggcacctcctccaanacgcacctcgtggggcacgagcggcctggctgacctggtcaaggtactacttccgatcaacgtgtacttgaggacggctggacaaggcgaccatagncagtnnnnnnnnnnnnnnnnnnnnnnnnnnnnnnnn

SEQ ID NO: 84914 - DNA, 475 bp, Homo sapiens
  misc_feature: GYAE6OF02H794V.34.46.E02.1.454.CMB.1.raw
  modified_base (450)..(450): a, c, t, g, unknown or other
  misc_feature (450)..(450): n is a, c, g, or t
  modified_base (452)..(475): a, c, t, g, unknown or other
  misc_feature (452)..(475): n is a, c, g, or t
tcagtacacgtgatcacgaccggtgctcgatttagactcatctacagggaagggactggagtggattgggtatatctttcacagtgggaccaccacctacaaccccttccctcgagagtcgagtcaccatctcaatagacacgtccaagaagcagttctccctacagctgacctctgtgaccgctgcggacacggccgtatattactgtgcgagaggtttcgataccttgacctactccaactactttgactacgtggggccagggaaccctgactccaccgtctcctacacctccaccaaggcccatcggtctccccctggccacccctcctaccaagacgccacctcgtgggggcacgaggccggcccgtgggcctcgtccgtggtacgaaggtacctacttccatcacgtgtacctggacggtcgggctcggcaacgggcgcagtangnnnnnnnnnnnnnnnnnnnnnnnn

SEQ ID NO: 84915 - DNA, 443 bp, Homo sapiens
  misc_feature: GYAE6OF02HVMM4.34.46.E02.1.454.CMB.1.raw
  modified_base (165)..(165): a, c, t, g, unknown or other
  misc_feature (165)..(165): n is a, c, g, or t
  modified_base (344)..(344): a, c, t, g, unknown or other
  misc_feature (344)..(344): n is a, c, g, or t
  modified_base (428)..(428): a, c, t, g, unknown or other
  misc_feature (428)..(428): n is a, c, g, or t
  modified_base (434)..(443): a, c, t, g, unknown or other
  misc_feature (434)..(443): n is a, c, g, or t
tcagtacacgtgatcacgaccggtgctcgatttagactcatctacagggaaagggactggagtggattgggtatatctttcacagtgggaccaccacctacaacccttccctcgagagtcgagtcaccatctcaatagacacgtccaagaagcagttctccctanagctgacctctgtgaccgctgcggacacggccgtatattactgtgcgagtggttttcgattaccttgaccctactcccaacttactttgacctacgtggggccagggaaccctgatcaccgtctcctcaacctccaccaagggcccatcggtcttccccctggcaccctcctccaaganccacctcgtgggggcacacgcggccctgggctgcctggtcaggacttacttccatcacgtgtactgagcgggctggcgaaggcncatagnnnnnnnnnn

SEQ ID NO: 84916 - DNA, 199 bp, Homo sapiens
  misc_feature: GYAE6OF02GRARH.34.46.E02.1.454.CMB.1.raw
tcagtacacgtgatcacgaccggtgctcgatttagactcatctacagggaagggactggagtggattgggtatatctttcacagtgggaccaccacctacaacccttccctcgagagtcgagtcaccatctcaatagacacgtccaagaagcagttctccctacagctgacctctgtgaccgctgcggacacggctata

SEQ ID NO: 84917 - DNA, 430 bp, Homo sapiens
  misc_feature: GYAE6OF02FGUG6.34.46.E02.1.454.CMB.1.raw
  modified_base (325)..(325): a, c, t, g, unknown or other
  misc_feature (325)..(325): n is a, c, g, or t
  modified_base (329)..(329): a, c, t, g, unknown or other
  misc_feature (329)..(329): n is a, c, g, or t
  modified_base (338)..(338): a, c, t, g, unknown or other
  misc_feature (338)..(338): n is a, c, g, or t
  modified_base (345)..(345): a, c, t, g, unknown or other
  misc_feature (345)..(345): n is a, c, g, or t
  modified_base (391)..(391): a, c, t, g, unknown or other
  misc_feature (391)..(391): n is a, c, g, or t
  modified_base (405)..(405): a, c, t, g, unknown or other
  misc_feature (405)..(405): n is a, c, g, or t
  modified_base (411)..(411): a, c, t, g, unknown or other
  misc_feature (411)..(411): n is a, c, g, or t
  modified_base (413)..(430): a, c, t, g, unknown or other
  misc_feature (413)..(430): n is a, c, g, or t
tcagtacacgtgatcacgaccggtgctcgatttagactcatctacagggaagggactggagtggattgggtatatctttcacagtgggaccaccacctacaacccttccctcgagagtcgagtcaccatctcaatagacacgtccaagaagcagttctccctacagctgacctctgtgaccgctgcggacacggccgtatatactgtgcgagaggtttcgattaccttgacctactccaaactactttgactactgggggccaggggaaccctgatcaccgtctcctcaacctcaccaaggcccatcgcttcccctgcaccctcncagngtcacctgnggggcanagcgcctgggctgcctgtcaaggctactccatcacgtgactgacgngggctggcaaggcncatagntnnnnnnnnnnnnnnnnnn

SEQ ID NO: 84918 - DNA, 522 bp, Homo sapiens
  misc_feature: GYAE6OF02FI59J.34.46.E02.1.454.CMB.1.raw
  modified_base (482)..(483): a, c, t, g, unknown or other
  misc_feature (482)..(483): n is a, c, g, or t
  modified_base (486)..(522): a, c, t, g, unknown or other
  misc_feature (486)..(522): n is a, c, g, or t
tcagtacacgtgatcacgaccggtgctcgatttagactcatctacagggaagggactggagtggattgggtatatcttttcacagtgggaccaccacctacaacccttccctcgagagtcgagtcaccatctcaatagacacgtccaagaagcagttctccctacagctgacctctgtgaccgctgcggacacggccgtatattactgtgcgagaggtttcgattaccttgacctactccaactactttgactcgtggggccacgggaccctgatcaccgtctcctcaacctccaccaacgggcccagtccgtccttcccccctggccacccctcctccaagacgcaccctcgtgggggccacgacggccggcccgtggggcctggccgtgggtaccaagggtaccttacttccataccgtaccggttggtaccttgggacgggtccggggtcgtcgggacgtaacgggccgacactagcgnnagnnnnnnnnnnnnnnnnnnnnnnnnnnnnnnnnnnnnn

SEQ ID NO: 84919 - DNA, 682 bp, Homo sapiens
  misc_feature: GYAE6OF02JAMK2.34.46.E02.1.454.CMB.1.raw
  modified_base (604)..(604): a, c, t, g, unknown or other
  misc_feature (604)..(604): n is a, c, g, or t
  modified_base (609)..(609): a, c, t, g, unknown or other
  misc_feature (609)..(609): n is a, c, g, or t
  modified_base (611)..(611): a, c, t, g, unknown or other
  misc_feature (611)..(611): n is a, c, g, or t
  modified_base (615)..(615): a, c, t, g, unknown or other
  misc_feature (615)..(615): n is a, c, g, or t
  modified_base (617)..(617): a, c, t, g, unknown or other
  misc_feature (617)..(617): n is a, c, g, or t
  modified_base (624)..(624): a, c, t, g, unknown or other
  misc_feature (624)..(624): n is a, c, g, or t
  modified_base (635)..(635): a, c, t, g, unknown or other
  misc_feature (635)..(635): n is a, c, g, or t
  modified_base (645)..(645): a, c, t, g, unknown or other
  misc_feature (645)..(645): n is a, c, g, or t
  modified_base (648)..(648): a, c, t, g, unknown or other
  misc_feature (648)..(648): n is a, c, g, or t
  modified_base (655)..(656): a, c, t, g, unknown or other
  misc_feature (655)..(656): n is a, c, g, or t
  modified_base (668)..(668): a, c, t, g, unknown or other
  misc_feature (668)..(668): n is a, c, g, or t
  modified_base (682)..(682): a, c, t, g, unknown or other
  misc_feature (682)..(682): n is a, c, g, or t
tcagtacacgtgatcacgaccggtgctcgatttagactcatctacagggaaagggactggagtggattgggtatatctttcacagtgggaccaccacctacaacccttccctcgagagtcgagtcaccatctcaatagacacgtccaagaagcagttctccctaacagctcgacctctgtcgaccgctgcggacacggccgtatacttactgtagcgtagtcggtttcacttaccttagacctactcctaacttacttcgacttacgtcggggcctaacgggaccctgacgtaccaccgtccttacctaccaaccgtccccaaccgaaacgggccccctaacgtcccggttccctttaccccccgcggtaccctacccctaccctacccgaaaccgacgccctacccgtacggtcggggggacctaaccgacgggtccgggtcccggtacggggtccttacgggtcccggttaacgggttaccgaaaccggtacccttaccgttaccgaacgttccgtaaccggttcgtaaaccgttcgggacgggccgggtacgtacgggccggtaaagggccaacgtacgtaacgctcacgatagtacgtcncgtancntacncncgacacnctacgtctacncacgacgcanacncgagcgnnagtcgcgtctcnccacacgacgtctn

SEQ ID NO: 84920 - DNA, 147 bp, Homo sapiens
  misc_feature: GYAE6OF01B4VD3.4.13.B02.1.454.CMB.1.raw
  modified_base (126)..(147): a, c, t, g, unknown or other
  misc_feature (126)..(147): n is a, c, g, or t
tcagagcactgtagcacgaccggtgctcgatttagtctagcgacttccgcgggctggcaaggcgcatagctgcctggtcaaggactattccctacagtgctctgagcggctggcaaggcgcatagnnnnnnnnnnnnnnnnnnnnnn

SEQ ID NO: 84921 - DNA, 149 bp, Homo sapiens
  misc_feature: GYAE6OF01EGWQ1.4.13.B02.1.454.CMB.1.raw
  modified_base (128)..(149): a, c, t, g, unknown or other
  misc_feature (128)..(149): n is a, c, g, or t
tcagagcactgtagcacgaccggtgctcgatttagtctagcgacttccgcgggctggcaaggcgcatagctgcctggtcaaggactacttccctacagtgctctgagcgggctggcaaggcgcatagnnnnnnnnnnnnnnnnnnnnnn

SEQ ID NO: 84922 - DNA, 131 bp, Homo sapiens
  misc_feature: GYAE6OF01AR1PA.4.13.B02.1.454.CMB.1.raw
  modified_base (128)..(131): a, c, t, g, unknown or other
  misc_feature (128)..(131): n is a, c, g, or t
tcagagcactgtagcacgaccggtgctcgatttagtctagcgacttccgcgggctggcaaggcgcatagctgcctggtcaaggactacttccctacagtgctctgagcgggctggcaaggcgcatagnnnn

SEQ ID NO: 84923 - DNA, 143 bp, Homo sapiens
  misc_feature: GYAE6OF01A48UU.4.13.B02.1.454.CMB.1.raw
  modified_base (128)..(143): a, c, t, g, unknown or other
  misc_feature (128)..(143): n is a, c, g, or t
tcagagcactgtagcacgaccggtgctcgatttagtctagcgacttccgcgggctggcaaggcgcatagctgcctggtcaaggactacttccctacagtgctctgagcgggctggcaaggcgcatagnnnnnnnnnnnnnnnn

SEQ ID NO: 84924 - DNA, 131 bp, Homo sapiens; identical to SEQ ID NO: 84922
  misc_feature: GYAE6OF02I44JS.4.13.B02.1.454.CMB.1.raw
  modified_base (128)..(131): a, c, t, g, unknown or other
  misc_feature (128)..(131): n is a, c, g, or t

SEQ ID NO: 84925 - DNA, 152 bp, Homo sapiens
  misc_feature: GYAE6OF02GKXDP.4.13.B02.1.454.CMB.1.raw
  modified_base (128)..(152): a, c, t, g, unknown or other
  misc_feature (128)..(152): n is a, c, g, or t
tcagagcactgtagcacgaccggtgctcgatttagtctagcgacttccgcgggctggcaaggcgcatagctgcctggtcaaggactacttccctacagtgctctgagcgggctggcaaggcgcatagnnnnnnnnnnnnnnnnnnnnnnnnn

SEQ ID NO: 84926 - DNA, 139 bp, Homo sapiens
  misc_feature: GYAE6OF02FXWNS.4.13.B02.1.454.CMB.1.raw
  modified_base (96)..(96): a, c, t, g, unknown or other
  misc_feature (96)..(96): n is a, c, g, or t
  modified_base (123)..(123): a, c, t, g, unknown or other
  misc_feature (123)..(123): n is a, c, g, or t
  modified_base (129)..(131): a, c, t, g, unknown or other
  misc_feature (129)..(131): n is a, c, g, or t
  modified_base (133)..(139): a, c, t, g, unknown or other
  misc_feature (133)..(139): n is a, c, g, or t
tcagagcactgtagcacgaccggtgctcgatttagtctagcgacttccgcgggctggcaaggcgcatagctgcctggtcaaggactacttccctanagtgctctagagcgggctggcaaggcncatagnnngnnnnnnn

SEQ ID NO: 84927 - DNA, 252 bp, Homo sapiens
  misc_feature: GYAE6OF01DFX2H.37.66.F11.1.454.CMB.1.raw
  modified_base (251)..(252): a, c, t, g, unknown or other
  misc_feature (251)..(252): n is a, c, g, or t
tcagtagtgtagatcacgaccggtgctcgatttagtcacgcgagaaagggggaatctttactattattactacatggacgtctggggcaaagggaccacggtcaccgtctcctcagcctccaccaagggcccatcggtcttccccctggcaccctcctccaagagcacctctgggggcacagcggccctgggctgcctggtcaaggactacttccatctacactactgagcgggctggcaaggcgcatagnn

SEQ ID NO: 84928 - DNA, 253 bp, Homo sapiens
  misc_feature: GYAE6OF01BWHM2.37.66.F11.1.454.CMB.1.raw
  modified_base (251)..(253): a, c, t, g, unknown or other
  misc_feature (251)..(253): n is a, c, g, or t
tcagtagtgtagatcacgaccggtgctcgatttagtcacgcgagaaagggggaatctttactattattactacatggacgtctggggcaaagggaccacggtcaccgtctcctcagcctccaccaagggcccatcggtcttccccctggcaccctcctccaagagcacctctgggggcacagcggccctgggctgcctggtcaaggactacttccatctacactactgagcgggctggcaaggcgcatagnnn

SEQ ID NO: 84929 - DNA, 264 bp, Homo sapiens
  misc_feature: GYAE6OF01BCSVF.37.66.F11.1.454.CMB.1.raw
  modified_base (252)..(264): a, c, t, g, unknown or other
  misc_feature (252)..(264): n is a, c, g, or t
tcagtagtgtagatcacgaccggtgctcgatttagtcacgcgagaaagggggaatcgtttactattattactacatggacgtctggggcaaagggaccacggtcaccgtctcctcagcctccaccaagggcccatcggtcttccccctggcaccctcctccaagagcacctctgggggcacagcggccctgggctgcctggtcaaggctacttccatctacactactgagcgggctggcaagggcgcatagnnnnnnnnnnnnn

SEQ ID NO: 84930 - DNA, 257 bp, Homo sapiens
  misc_feature: GYAE6OF01EJ0UR.37.66.F11.1.454.CMB.1.raw
  modified_base (252)..(257): a, c, t, g, unknown or other
  misc_feature (252)..(257): n is a, c, g, or t
tcagtagtgtagatcacgaccggtgctcgatttagtcacgcgagaaaggggggaatctttactattattactacatggacgtctggggcaaagggaccacggtcaccgtctcctcagcctccaccaagggcccatcggtcttccccctggcaccctcctccaagagcacctctgggggcacagcggccctgggctgcctggtcaaggactacttccatctacactactgagcgggctggcaaggcgcatagnnnnnn

SEQ ID NO: 84931 - DNA, 259 bp, Homo sapiens
  misc_feature: GYAE6OF01EP6FS.37.66.F11.1.454.CMB.1.raw
  modified_base (252)..(259): a, c, t, g, unknown or other
  misc_feature (252)..(259): n is a, c, g, or t
tcagtagtgtagatcacgaccggtgctcgatttagtcacgcgagaaaggggggaatctttactattattactacatggacgtctggggcaaagggaccacggtcaccgtctcctcagcctccaccaagggcccatcggtcttccccctggcacccctcctccaagagcacctctgggggcacagcggccctgggctgcctggtcaaggctacttccatctacactactgagcgggctggcaaggcgcatagnnnnnnnn

SEQ ID NO: 84932 - DNA, 252 bp, Homo sapiens
  misc_feature: GYAE6OF02IEKLN.37.66.F11.1.454.CMB.1.raw
  modified_base (250)..(252): a, c, t, g, unknown or other
  misc_feature (250)..(252): n is a, c, g, or t
tcagtagtgtagatcacgaccggtgctcgatttagtcacgcgagaaagggggaatctttactattattactacatggacgtctggggcaaagggaccacggtcaccgtctcctcagcctccaccaagggcccatcggtcttcccctggcaccctcctccaagagcacctctgggggcacagcggccctgggctgcctggtcaaggactacttccatctacactactgagcgggctggcaaggcgcatagnnn

SEQ ID NO: 84933 - DNA, 265 bp, Homo sapiens
  misc_feature: GYAE6OF02ILNF1.37.66.F11.1.454.CMB.1.raw
  modified_base (251)..(265): a, c, t, g, unknown or other
  misc_feature (251)..(265): n is a, c, g, or t
tcagtagtgtagatcacgaccggtgctcgatttagtcacgcgagaaagggggaatctttactattattactacatggacgtctggggcaaagggaccacggtcaccgtctcctcagcctccaccaagggcccatcggtcttccccctggcaccctcctccaagagcacctctgggggcacagcggccctgggctgcctggtcaaggactacttccatctacactactgagcgggctggcaaggcgcatagnnnnnnnnnnnnnnn

SEQ ID NO: 84934 - DNA, 265 bp, Homo sapiens
  misc_feature: GYAE6OF02F9O1O.37.66.F11.1.454.CMB.1.raw
  modified_base (253)..(265): a, c, t, g, unknown or other
  misc_feature (253)..(265): n is a, c, g, or t
tcagtagtgtagatcacgaccggtgctcgatttagtcacgcgagaaaggggggaatctttactattattactacatggacgtctggggcaaagggaccacggtcaccgtctcctcagcctccaccaagggcccatcggtcttccccctggcaccctcctccaagagcacctctggggggcacagcggccctgggctgcctggtcaaggactacttccatctacactactgagcgggctggcaaggcgcatagnnnnnnnnnnnnn

SEQ ID NO: 84935 - DNA, 298 bp, Homo sapiens
  misc_feature: GYAE6OF02FHKPZ.37.66.F11.1.454.CMB.1.raw
  modified_base (259)..(264): a, c, t, g, unknown or other
  misc_feature (259)..(264): n is a, c, g, or t
  modified_base (266)..(270): a, c, t, g, unknown or other
  misc_feature (266)..(270): n is a, c, g, or t
  modified_base (272)..(298): a, c, t, g, unknown or other
  misc_feature (272)..(298): n is a, c, g, or t
tcagtagtgtagatcacgaccggtgctcgatttagtcacgcgagaaagggggggaatctttactattattactacatggacgtctggggcaaagggaccacggtcaccgtctcctcagcctccaccaagggcccatcggtccttccccctggcaccctccctccaagacgcacctcgtgggggcacagccggccctgggctgcctggtcaaggactacttccatctacactatgaggcggctggacgaaggcgcatagnnnnnngnnnnntnnnnnnnnnnnnnnnnnnnnnnnnnnn

SEQ ID NO: 84936 - DNA, 137 bp, Homo sapiens
  misc_feature: GYAE6OF01DXJZT.53.9.A09.1.454.CMB.1.raw
  modified_base (136)..(137): a, c, t, g, unknown or other
  misc_feature (136)..(137): n is a, c, g, or t
tcagcgcgtatacacacgaccggtgctcgatttagcgagacgcgcagggcacgaccggtgctcgatttagtacacgtgattagggattgggtgatagggtaggcactcgtctgagcgggctggcaaggcgcatagnn

SEQ ID NO: 84937 - DNA, 141 bp, Homo sapiens
  misc_feature: GYAE6OF01EZQ9C.53.9.A09.1.454.CMB.1.raw
  modified_base (141)..(141): a, c, t, g, unknown or other
  misc_feature (141)..(141): n is a, c, g, or t
tcagcgcgtatacacacgaccggtgctcgatttagcgagacgcgcagggcacgaccggtgctcgatttagtagtgtagattcgcgggggatggcctccctcgagtctacagtgctctgagcgggctggcaaggcgcatagn

SEQ ID NO: 84938 - DNA, 141 bp, Homo sapiens; identical to SEQ ID NO: 84937
  misc_feature: GYAE6OF01AM9ID.53.9.A09.1.454.CMB.1.raw
  modified_base (141)..(141): a, c, t, g, unknown or other
  misc_feature (141)..(141): n is a, c, g, or t

SEQ ID NO: 84939 - DNA, 173 bp, Homo sapiens
  misc_feature: GYAE6OF01C5SJL.53.9.A09.1.454.CMB.1.raw
  modified_base (170)..(173): a, c, t, g, unknown or other
  misc_feature (170)..(173): n is a, c, g, or t
tcagcgcgtatacacacgaccggtgctcgatttagcgagacgcgcagggcgacgaccggtgctcgatttacgctctacgctcaggcacgaccggtgctcgatttagctctacgctcaggcacgaccggtgctcgatttagcagacgtctgagcggctggcaggcgcatgnnnn

SEQ ID NO: 84940 - DNA, 138 bp, Homo sapiens
  misc_feature: GYAE6OF02I7XGF.53.9.A09.1.454.CMB.1.raw
  modified_base (137)..(138): a, c, t, g, unknown or other
  misc_feature (137)..(138): n is a, c, g, or t
tcagcgcgtatacacacgaccggtgctcgatttagcgagacgcgcagggcacgaccggtgctcgatttagctctacgctcaggcacgaccggtgctcgatttagcagacgtctgagcgggctggcaaggcgcatagnn

SEQ ID NO: 84941 - DNA, 162 bp, Homo sapiens
  misc_feature: GYAE6OF02I752D.53.9.A09.1.454.CMB.1.raw
  modified_base (140)..(162): a, c, t, g, unknown or other
  misc_feature (140)..(162): n is a, c, g, or t
tcagcgcgtatacacacgaccggtgctcgatttagcgagacgcgcagggcacgaccggtgctcgatttagtatgtagattcgcgggggatggcctccctcgagtctacagtgctctgagcgggctggcaaggcgcatagnnnnnnnnnnnnnnnnnnnnnnn

SEQ ID NO: 84942 - DNA, 131 bp, Homo sapiens
  misc_feature: GYAE6OF01C2ZO8.4.34.D01.1.454.CMB.1.raw
  modified_base (130)..(131): a, c, t, g, unknown or other
  misc_feature (130)..(131): n is a, c, g, or t
tcagagcactgtagcacgaccggtgctcgatttagatcgtctgtgttgggttgggctggcaaggcgcatagctgcctggtcaaggactacttccctacagtgctctgagcgggctggcaaggcgcatagnn

SEQ ID NO: 84943 - DNA, 407 bp, Homo sapiens
  misc_feature: GYAE6OF01B2REU.4.34.D01.1.454.CMB.1.raw
  modified_base (405)..(407): a, c, t, g, unknown or other
  misc_feature (405)..(407): n is a, c, g, or t
tcagagcactgtagcacgaccggtgctcgatttagatcgtctgtgttgggtttgggacagcagacctgagagcgctgggcccacagcctcccctcagagccctgctgtctcctccggtcagccctggacatcccaggtttccccaggcctgccggtaggtgtagaatgaggtctgtgtcactgtggtattacgatattttgactggttaagattactactactccggtatggacgtctggggccaagggaccacggtcaccgtctcctcagcctccaccaagggcccatcggtctccccctggcgccctgctccaggagcacctccgagagcacagcggccctgggctgcctggtcaaggactacttccctacagtgctctgagcgggctggcaaggcgcatagnnn

SEQ ID NO: 84944 - DNA, 132 bp, Homo sapiens
  misc_feature: GYAE6OF01DIQBQ.4.34.D01.1.454.CMB.1.raw
  modified_base (131)..(132): a, c, t, g, unknown or other
  misc_feature (131)..(132): n is a, c, g, or t
tcagagcactgtagcacgaccggtgctcgatttagatcgtctgtgttgggtttgggctggcaaggcgcatagctgcctggtcaaggactacttccctacagtgctctgagcgggctggcaaggcgcatagnn

SEQ ID NO: 84945 - DNA, 411 bp, Homo sapiens
  misc_feature: GYAE6OF01C2I6N.4.34.D01.1.454.CMB.1.raw
  modified_base (408)..(411): a, c, t, g, unknown or other
  misc_feature (408)..(411): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgatattttgactggttaagattactactactccggtatggacgtctggggccaagggaccacggtcaccgtctcctcagcctccaccaagggcccatcggtcttccccctggcacccctcctccaagagcacctctgggggcacagcggccctgggctgcctggtcaaggactacttccctacagtgctctgagcgggctggcaaggcgcatagnnnn

SEQ ID NO: 84946 - DNA, 509 bp, Homo sapiens
  misc_feature: GYAE6OF01C6P86.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctcagggatccctgagcgattctctggctccagctcagggacaacagtcacgttgaccatcagtggagtccaggcagaagacgaggctgactattactgtcaatcagcagacagcggtgggacttaagtaaagagttacggcggagggaccaaggcctggaacccgtctaggtcacgccccaaaggcctggtccccccg

SEQ ID NO: 84947 - DNA, 408 bp, Homo sapiens
  misc_feature: GYAE6OF01BPWXF.4.34.D01.1.454.CMB.1.raw
  modified_base (405)..(408): a, c, t, g, unknown or other
  misc_feature (405)..(408): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgatattttgactggttaagattactactactccggtatggacgtctggggccaagggaccacggtcaccgtctcctcagcctccaccaagggcccatcggtcttccccctggcaccctcctccaagagcacctctggggcacagcggccctgggctgcctggtcaaggactactccctacagtgctctgagcgggctggcaaggcgcatagnnnn

SEQ ID NO: 84948 - DNA, 521 bp, Homo sapiens
  misc_feature: GYAE6OF01DI2PN.4.34.D01.1.454.CMB.1.raw
  modified_base (406)..(406): a, c, t, g, unknown or other
  misc_feature (406)..(406): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctcagggatccctgagcgattctctggctccagctcagggacaacagtcacgttgaccatcagtgagtcaggcagaagacgaggctgactattacngtcaatcagcagacagcggtagggacttaagtaaagtagttacggacggaagggacccgaaagcgtcgacccggtcttaacgggtcaaggccccaaagggcctacggtccccccg

SEQ ID NO: 84949 - DNA, 500 bp, Homo sapiens
  misc_feature: GYAE6OF01BKFTZ.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatggattgccagaccaatatgcttactggtaccagcagaagccaggccaggcccctgtgttgttgttatataaagacagtgagaggccctcagggatccctgagcgattctctggctccagctcagggacaacagtcacgttgaccatcagtggagtccaggcagaagacgaggctgactattactgtcaatcagcagacagcggtggacttagaaagagttcggcggagggaccgaagctggaccgtcgtaggtcagcccaaggctcgccccgtcgg

SEQ ID NO: 84950 - DNA, 411 bp, Homo sapiens
  misc_feature: GYAE6OF01CBLMA.4.34.D01.1.454.CMB.1.raw
  modified_base (406)..(411): a, c, t, g, unknown or other
  misc_feature (406)..(411): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgatattttgactggttaagattactactactccggtatggacgtcgtggggccaagggaccacggtcaccgtctcctcagcctcaccaagggcccatcggtcttcccctggcaccctcctccaagcgcacctcgtggggcacacgcggccctggctgcctggtcaaggactacttcccacagtgctctgacgcgggctggcaaggcgcatagnnnnnn

SEQ ID NO: 84951 - DNA, 508 bp, Homo sapiens
  misc_feature: GYAE6OF01DJ2BR.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtcccaggacagacggccaggatcacctgctctggagatgcattgccagaccaatatgcttactggtaccagcagaagccaggccaggcccctgtgttgttgttatataaagacagtgagaggccctcagggatccctgagcgattctctggctcagctcagggacaacagtcacgttgaccatcagtggagtccaggcagaagacgaggctgactattactgtacaatcagcagacaggcggtagggtacttaagtaaagagttcgggacggagggaaccaaggctgacccgtctaggtcaacgcccaaggcctcgtcccccg

SEQ ID NO: 84952 - DNA, 486 bp, Homo sapiens
  misc_feature: GYAE6OF01EIZS8.4.34.D01.1.454.CMB.1.raw
  modified_base (445)..(445): a, c, t, g, unknown or other
  misc_feature (445)..(445): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctcaggatccctgagcgattctctggctcagctcagggacaacagtcacgttgaccatcagtggagtccaggcagaagacgagctgactattactgtcaatcagcagacaggcggtggacttagaagagttcggnggaggaccagctgaccgtcaggtcagccaaggctcgccccg

SEQ ID NO: 84953 - DNA, 557 bp, Homo sapiens
  misc_feature: GYAE6OF01BVSMV.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggccctgtgttgttgttatataaagacagtgagaggccctgagggactccctgagcgattctctggctccgagctcgagggacaacgagtcacgttgaccatcgagtggagtccgggacaagaagacgaggctagaacttattacgtgtacaatcagcagacaggcggtaggacttaagaaaggtaggttaccgggacgggaacgggaaccgaaggtccgtacggaccccgttaccgtaagggtacccgacggacccgaaaggcctcccggccccccgttaccggg

SEQ ID NO: 84954 - DNA, 410 bp, Homo sapiens
  misc_feature: GYAE6OF01B6AZ0.4.34.D01.1.454.CMB.1.raw
  modified_base (407)..(410): a, c, t, g, unknown or other
  misc_feature (407)..(410): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgatattttgactggttaagattactactactccggtatggacgtctggggccaagggaccacggtcaccgtctcctcagcctccaccaagggcccatcggtcttccccctggcacccctcctccaagagcacctctggggcacagcggccctgggctgcctggtcaaggactacttccctacagtgctctgagcgggctggcaaggcgcatagnnnn

SEQ ID NO: 84955 - DNA, 406 bp, Homo sapiens
  misc_feature: GYAE6OF01E2K7P.4.34.D01.1.454.CMB.1.raw
  modified_base (321)..(321): a, c, t, g, unknown or other
  misc_feature (321)..(321): n is a, c, g, or t
  modified_base (404)..(406): a, c, t, g, unknown or other
  misc_feature (404)..(406): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgatattttgactggttaagattactactactccggtatggacgtctggggccaagggaccacggtcaccgtctcctcagcctccaccaagggcccatcggtcttccccctggcaccctcctccaagancacctctggggcacagcgccctgggctgcctggtcaaggactactccctacagtgctctgagcgggctggcaaggcgcatagnnn

SEQ ID NO: 84956 - DNA, 554 bp, Homo sapiens
  misc_feature: GYAE6OF01EISY4.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgccagaccaatatgcttactggtaccagcagaagccaggccaggcccctgtgttgttgttatataaagacagtgagagccctgagggatccctgagcgattctctggctccagctcgagggacaacgagtcacgttgaccatcagtggagtccgaggcagaagacgaggctgactattactgtacaatcagcagacaggcggtagggacttaagtaaaggtacggttcgggacgggaacgggacccgaaaggccgtaggaaccccggttaccgtaacgggtccgaacggaccccgaaacgggtcccgtccggtaccccccccgg

SEQ ID NO: 84957 - DNA, 573 bp, Homo sapiens
  misc_feature: GYAE6OF01C87Z4.4.34.D01.1.454.CMB.1.raw
  modified_base (379)..(379): a, c, t, g, unknown or other
  misc_feature (379)..(379): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgtcagaccaatatgcttactggtaccagcagaagccaggccaggcccctgtgttgttgttaatataaaagacagtagagacggccctcgaaggacttcccgagacgacgtacttctcgtggtcctaccagctacgaagggaaccaaacngtaccacgttcgaacctatacgaggtggagtccaggcaagaagacgagctagacttattactgtacaatcagcgaagacgaggcggtaggtaacttaagtaaaggtaggttacgggaggaacgggaaccgaaggaccgtcggtaacccggtcgtaacggtcaaacggaccccgaaaggccgtccgtaccccccg

SEQ ID NO: 84958 - DNA, 530 bp, Homo sapiens
  misc_feature: GYAE6OF01BDBC4.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctcagggatccctgagcgattctctggctccagctcagggacaacagtcacgttgaccatcagtggagtccaggcagaagacgaggctgactattactgtcaatcagcagacagcggtagggacttaagtaaagaggtttacgggacgggaaggggaacccaaggcgtacggacccgtccgtagggtacacggacccgaaacgggccgtcggtccccccg

SEQ ID NO: 84959 - DNA, 501 bp, Homo sapiens
  misc_feature: GYAE6OF01E2Q89.4.34.D01.1.454.CMB.1.raw
  modified_base (358)..(358): a, c, t, g, unknown or other
  misc_feature (358)..(358): n is a, c, g, or t
  modified_base (444)..(444): a, c, t, g, unknown or other
  misc_feature (444)..(444): n is a, c, g, or t
  modified_base (451)..(451): a, c, t, g, unknown or other
  misc_feature (451)..(451): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctcagggactcccgtgagcgattctctggctccagctcagggacaacngtcacgttgacatcgagtgacgtcaggcagaagacgaggctagactatactgtacaatcagcagacagcggtaggacttaagaagngttcggnggagggaccaagctgaccgtcgtacggtcagacccaggcgtcgtcccccg

SEQ ID NO: 84960 - DNA, 512 bp, Homo sapiens
  misc_feature: GYAE6OF01E34WE.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctcagggatccctgagcgattctctggctccagctcagggacaacagtcacgttgaccatcagtggagtccaggcagaagacgaggctgactattactgtcaatcagcagacagcggtaggacttagtaaagagttacgggacggagggaccaagctcggaccgtaccgtaggtccacgacccgaacggtctcggtcccccg

SEQ ID NO: 84961 - DNA, 408 bp, Homo sapiens
  misc_feature: GYAE6OF01B7PXB.4.34.D01.1.454.CMB.1.raw
  modified_base (406)..(408): a, c, t, g, unknown or other
  misc_feature (406)..(408): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgatattttgactggttaagattactactactccggtatggacgtctggggccaagggaccacggtcaccgtctcctcagcctccaccaaggcccatcggtcttccccctggcaccctcctccaagagcacctctgggggcacagcggccctgggctgcctggtcaaggactacttccctacagtgctctgagcgggctggcaaggcgcatagnnn

SEQ ID NO: 84962 - DNA, 548 bp, Homo sapiens
  misc_feature: GYAE6OF01DDRIW.4.34.D01.1.454.CMB.1.raw
  modified_base (312)..(312): a, c, t, g, unknown or other
  misc_feature (312)..(312): n is a, c, g, or t
tcagagcactgtagcacgaccggtgctcgatttagatcgtctgtgttgggtttgggggtgggtccaggaggcagaactctgggtgtctcaccatggcccggatccctctacttctcccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctnagggactccctgagcgattctctggctccagctcagggacaacagtcacgttgaccatcagtggagtcaggcaagaagacgagctgactattactgtacaatcaagcaagacagcgggtagggtaacttagtaaaaggtggttacgggacgggtaagggaccgtaaaggccgtacggaacccggtccgtaagggtccaacggaccccgaaggtccctccggtccccccgtaccggg

SEQ ID NO: 84963 - DNA, 541 bp, Homo sapiens
  misc_feature: GYAE6OF01D0X2P.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctcgagggatccctgagcgattctctggctccagctcgagggacaacagtcacgttgaccatcagtggagtccaggcaagaagacgaggctgactattactgtacaatcagacagacgaggcggtagggacttaagtaaaggacggttcgggacgggaagggacccgaaggccgtaggacccgtcgtaacggtccaacggaccccaaagggtccgtccggtacccccccgg

SEQ ID NO: 84964 - DNA, 543 bp, Homo sapiens
  misc_feature: GYAE6OF01DAFYV.4.34.D01.1.454.CMB.1.raw
  modified_base (428)..(428): a, c, t, g, unknown or other
  misc_feature (428)..(428): n is a, c, g, or t
tcagagcactgtagcacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataagacagtgagaggccctagcgggatcccgtgagtcgattctctcggctccagctcaggacaacagtcacgttgaccatcgagtggagtcccaaggcaggaacgacgaggctgacttatacttcgtcaatcagtanagacgaggacggttaggacttaagtaaaggacggttcgggacggagggaccaaggccgtacggacccgtcctacgggtaccacggaccccgaacggcccgtccggtaccccccgg

SEQ ID NO: 84965 - DNA, 409 bp, Homo sapiens
  misc_feature: GYAE6OF01CSXP7.4.34.D01.1.454.CMB.1.raw
  modified_base (404)..(409): a, c, t, g, unknown or other
  misc_feature (404)..(409): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgatattttgactggttaagattactactactccggtatggacgtctggggccaagggaccacggtcaccgtctcctcagcctccaccaagggcccatcggtctccccctggcaccctcctccaagagcacctctggggcacagcgccctgggctgcctggtcaaggactacttccctacagtgctctgagcgggctggcaaggcgcatagnnnnnn

SEQ ID NO: 84966 - DNA, 509 bp, Homo sapiens
  misc_feature: GYAE6OF01C2KUP.4.34.D01.1.454.CMB.1.raw
  modified_base (313)..(313): a, c, t, g, unknown or other
  misc_feature (313)..(313): n is a, c, g, or t
  modified_base (408)..(408): a, c, t, g, unknown or other
  misc_feature (408)..(408): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctnagggatccctgagcgattctctggctccagctcgagggacaacagtcacgttgaccatcagtggagtcaggcaagaagacgagctgactattacngtcaatcaagcagacaggcggtaggacttaagaagacgttcgggacggagggaaccaagctacgaccgtactaggtcacgacccgaaggcctcgtcccccg

SEQ ID NO: 84967 - DNA, 515 bp, Homo sapiens
  misc_feature: GYAE6OF01AXEC4.4.34.D01.1.454.CMB.1.raw
  modified_base (416)..(416): a, c, t, g, unknown or other
  misc_feature (416)..(416): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacaggtgagaggccctcgagggactcccgtgagcgtattctcgtggctccagctcgagggacaacagtcacgttagaccatcagtggagtccaggcagaagacgaggctgactattacngtacaatcagcagacaggcggtaggacttaagaaagcgttaggacggagggaccaaggctgtacccgtctaggtcacgacccgaggcctcgtacccccg

SEQ ID NO: 84968 - DNA, 674 bp, Homo sapiens
  misc_feature: GYAE6OF01COH8A.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacaggacggccaggactcacctgctctggagatgcattgccagaccaatatgcttactggtaccagcagaacgccgaggccaggcccctgttcgttgttgttatataaagcagtgagacgtccctacgagggactcccgtagacgcgtattcgtcgtcggctccgacgtccgtacggaacggaccaaacgtacgtaccgtacggttacgaccgtatacggtagggtacggacgtacggaacggacgaaaggaacggaacggacggtacgtaacgtactttaacgttacgttacggtaacctaacgttaccgaacgtcgaaacggtaacggtacgggtacgggggtaacgttaacgttaaaggttaaacgggtacgggttccggggaacgggaacggaaccgtaacggtaccggtacggtacccgggttacgttacggtacccgacggacccggaacggtcccggccccgttacccccggg

SEQ ID NO: 84969 - DNA, 531 bp, Homo sapiens
  misc_feature: GYAE6OF01B7KMO.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggccctgtgttgttgttatataaagacagtgagagccctgagggactccctgagcgattctctggctccagctcgagggacaacagtcacgttgaccatacagtggacgtccaggacaagaagacgaggctagacttatactgtacaatcagcagacaggcggtagggacttaagtaaaggaggttcgggacggacgggaaccaaggcgtcggaacccgtacgtacggtcaacggacccgaaggtccgtccgtacccccg

SEQ ID NO: 84970 - DNA, 410 bp, Homo sapiens
  misc_feature: GYAE6OF01C6WOS.4.34.D01.1.454.CMB.1.raw
  modified_base (405)..(410): a, c, t, g, unknown or other
  misc_feature (405)..(410): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgatattttgactggttaagattactactactccggtatggacgtctggggccaagggaccacggtcaccgtctcctcagcctccaccaaggcccatcggtctcccctggccaccctcctccaagagcacctctggggcacagcggccctgggctgcctggtcaaggactacttccctacagtcgctctgagcgggctggcaaggcgcatagnnnnnn

SEQ ID NO: 84971 - DNA, 536 bp, Homo sapiens
  misc_feature: GYAE6OF01B1J1L.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgtttgttgttatataaagacagtgagaggccctcgagggactcccgtgacgcgtattctcgtggctccagctcgagggacaacagtcacgttgaccatcagtggagtccaggcaagaagacgaggctagactattactgtacaatcagcagacgagcggtaggacttaagtaaaggaggttcgggacgggaagggaccgaaggccgtacggacccgtccgtaggtccacggacccgaacggtccgtcgtccccccg

SEQ ID NO: 84972 - DNA, 503 bp, Homo sapiens
  misc_feature: GYAE6OF01B4QO5.4.34.D01.1.454.CMB.1.raw
  modified_base (440)..(440): a, c, t, g, unknown or other
  misc_feature (440)..(440): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgccagaccaatatgcttactggtaccagcagaagccaggccaggcccctgtgttgttgttatataaagacagtgagaggccctcagggatccctgagcgattctctggctccagctcagggacaacagtcacgttgaccatcagtggatcgagcagagacgaggctgactattactgtacaatcagcagacagcggtaggacttagaagngttacggacggaggacgagctcggacgtccgtaggtcacgacccgaaggcccgtcgtcccccg

SEQ ID NO: 84973 - DNA, 410 bp, Homo sapiens
  misc_feature: GYAE6OF01B6YJF.4.34.D01.1.454.CMB.1.raw
  modified_base (405)..(410): a, c, t, g, unknown or other
  misc_feature (405)..(410): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgatattttgactggttaagattactactactccggtatggacgtctggggccaagggaccacggtcaccgtctcctcagcctccaccaagggcccatcggtcttccccctggccaccctcctccaagacgcacctctggggcacagcgcctggctgcctggtcaaggactacttccctacagtgcctgacgcgggctggcaaggcgcatagnnnnnn

SEQ ID NO: 84974 - DNA, 558 bp, Homo sapiens
  misc_feature: GYAE6OF01ELU8H.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcaagaagccaggccaggcccctgtgttgttgttatataagacagtgagagccctgaggactccctgagcgtattctcgtgctccgagctacgagggacaacgagtctacgttcgaacctatcgaagtcggacgtccgaaggacaaggaacgacgaggctagacttattactgtacaatcagccagacgaggcggtagggacttaagtaaaggtggttacgggacgggaggaaccgaaggtcgtacggacccggttactacgggtacaacggaccccgtaagggtccctccggtaccccccg

SEQ ID NO: 84975 - DNA, 415 bp, Homo sapiens
  misc_feature: GYAE6OF01AOKA9.4.34.D01.1.454.CMB.1.raw
  modified_base (404)..(404): a, c, t, g, unknown or other
  misc_feature (404)..(404): n is a, c, g, or t
  modified_base (409)..(415): a, c, t, g, unknown or other
  misc_feature (409)..(415): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgattattttgactggttaagattactactactccggtatggacgtctggggccaagggccacggtcaccgtctcctcagcctccaccaagggcccatcggtccttccccctggccacccctcctccaagacgcacctcgtggggcacagcggcctgggctgcctggtcaaggactacttccctacagtgctctgagcggctggcaaggcgnatagnnnnnnn

SEQ ID NO: 84976 - DNA, 540 bp, Homo sapiens
  misc_feature: GYAE6OF01DMF35.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctcgagggactccctgagcgtattctctggctcagctcgagggacaacagtcacgttgaccatcaggtggagtccgaggacaagaagacgaggctgactattactgtacaatcagacgagacgaggacggtagggacttaagtaaacggtaggtacgggacgggacgggaaccaaggccgtacggacccgtcgtacgggtcacgacccgaacgggcctccggtccccccg

SEQ ID NO: 84977 - DNA, 527 bp, Homo sapiens
  misc_feature: GYAE6OF01D24F8.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctcagggatccctgagcgattctctggctccagctcagggacaacagtcacgttgaccatcagtggagtccaggcagagacgaggctgactattactgtcaatcagcagacaggcggtagggacttaagtaaaggagttcgggacggaggggaacccaaggcgtcggacccgttcctaacgggtccaacggacccgaagggtcctcggtccccccgg

SEQ ID NO: 84978 - DNA, 521 bp, Homo sapiens
  misc_feature: GYAE6OF01B7S2R.4.34.D01.1.454.CMB.1.raw
  modified_base (360)..(360): a, c, t, g, unknown or other
  misc_feature (360)..(360): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattgccagaccaatatgcttactggtaccagcagaagccaggccaggccccctgtgtttgttgttatataaagacagtgagaggccctgagggatcccgtgagcgattctctggctccagctcgaggacaacngtcacgttgaccatcagtggagtccgaggcaagaagacgaggctagactattactgtacaatcagcagacaggcggtaggacttaagtaagtaggtcggacgggaggaccaagcgtcgacccggtacgtacggtcacgacccgaggcgtccgtacccccgg

SEQ ID NO: 84979 - DNA, 547 bp, Homo sapiens
  misc_feature: GYAE6OF01D0NUH.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctacgagggatccctgaagcgattctctggctcagctcgagggacaacagtcacgttgaacctatcgagtggagtccgaggacaaggaacgacgaggtctaggacttaattacttgtacaagtcagcagacaggtcgggtaggacttaagaaaggtacggttacggacgggacggaacgaagacgtcggacccgttcgtacggtacgacgacccgaacggccgtccggtccccccgg

SEQ ID NO: 84980 - DNA, 732 bp, Homo sapiens
  misc_feature: GYAE6OF01C87O4.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggactccactgctcgtggatagtgctagtcgacaacgaacctaatatcgtacttacgtacggtaaccgacgacgaagaacgaccgacggaccgaccggtccccttaggttgtttagtttagttaataaagtaaacgacgtaggtaggaaggtaccggtccctacggagggtaccttcccgtaggacgtacgttacttccgtcggtcggtcctacgacgtccacgggaacgggaaccaacggtacgtaccgttaacggttaccgaacctacgtacgtagggtacgggtaccgtaccggaacggaacgaagggaaaccggacgggacggttcgtaaccgtaacgtttaacgtttacgtacgtaactaacgtacgacgaacgaacggtaacgtacgggttacgggttaacggttaacttaaaggtaaaggtcggggttaccgggaacggggtaaccggaaaccgtaggtcggtaccggacccgttacggtaccgacgaccgtaaccggaccgtccgtccccggtaccccgg

SEQ ID NO: 84981 - DNA, 413 bp, Homo sapiens
  misc_feature: GYAE6OF01D2US2.4.34.D01.1.454.CMB.1.raw
  modified_base (408)..(413): a, c, t, g, unknown or other
  misc_feature (408)..(413): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgatattttgactggttaagattactactactccggtatggacgtctggggccaagggaccacggtcaccgtctcctcagcctccaccaagggcccatcggtcttccccctggccaccctcctccaagagccacctctggggcacagcggccctgggctgcctggtcaaggactacttccctacagtgctctgagcgggctggcaaggcgcatagnnnnnn

SEQ ID NO: 84982 - DNA, 473 bp, Homo sapiens
  misc_feature: GYAE6OF01CEEXC.4.34.D01.1.454.CMB.1.raw
  modified_base (213)..(213): a, c, t, g, unknown or other
  misc_feature (213)..(213): n is a, c, g, or t
  modified_base (464)..(473): a, c, t, g, unknown or other
  misc_feature (464)..(473): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgattattttgactggttaanattactactactccggtatggacgtcgtggggaccaagggaccacggtcaccgtctcctcacgcctccaccgaacgggcccacgtccggtccttcccccgtcggccaccctccctaccaacgacgccacctccgtggggcacgacggccggcccgtcgggctcggcccgtggtaccgaaacggtacctaccgttccctaacacgtcgtcctcgtcggacgccgggcgtcgggacgaacggccgacagtagnnnnnnnnnn

SEQ ID NO: 84983 - DNA, 534 bp, Homo sapiens
  misc_feature: GYAE6OF01BKKG5.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagagccctgaggatccctgagcgattctcgtggctccgagctcgagggacaacgacgtcacgttacgaccatacaggtggacgtccgaggacgaagaagtacggaggctaggactattactagtactaatcaagcaagacgagcggtaggactaagtaagtagttcggaggacggacgaaggctacggaccgttccgaggtaccacgacccgaggccgtccgtacccccgg

SEQ ID NO: 84984 - DNA, 407 bp, Homo sapiens
  misc_feature: GYAE6OF01C9518.4.34.D01.1.454.CMB.1.raw
  modified_base (405)..(407): a, c, t, g, unknown or other
  misc_feature (405)..(407): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgatattttgactggttaagattactactactccggtatggacgtctggggccaagggaccacggtcaccgtctcctcagcctccaccaagggcccatcggtctccccctggcaccctctccaagagcacctctgggggcacagcggccctgggctgcctggtcaaggactacttccctacagtgctctgagcgggctggcaaggcgcatagnnn

SEQ ID NO: 84985 - DNA, 531 bp, Homo sapiens
  misc_feature: GYAE6OF01CEDMN.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctcaggactccctgagcgattctcgtggctccagctcgagggacaacagtcacgttgaccatcagtggacgtcgaggcaagaagacgaggctgactattactgtacaatcagcaagacgaggcggtaggacttaagtaaagtaggttcggacgggagggaaccgaaggcgtacggacccgtccgtacggtccacgacccaacggtccgtccggtccccccg

SEQ ID NO: 84986 - DNA, 661 bp, Homo sapiens
  misc_feature: GYAE6OF01A591W.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgccagaccaatatgcttactggtaccagcaagaacgccgacggccgacggcccctgtgtttgttgttatataaagcagtgagaggccctgaggctcccgtgacgcgtattctcgtcggcctccgagcctacgacgggaacaacgtagtaccgtacggttacgacctaagtacgtaggtcgggtacggtacccgaagggaccgaagggaaacgacgggtaacggtccgtagtaacttactttacgtacggtaacctaagtaccgagtacctaacgaaccggtaacggtcggggttaacggtaacgttaaggtaaacggtacgggttaccggggacgggtaacgggaccgtaaagtaccggtacgggtaacccgttacggtaccggttaccgacccggtaacccgaaccgggtcccgtccccggtacccccgg

SEQ ID NO: 84987 - DNA, 579 bp, Homo sapiens
  misc_feature: GYAE6OF01BJVLV.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgccagaccaatatgcttactggtaccagcagaagccaggccacggcccctgtgttgttgttatataaagacagtgagacggccctgaggactcccgtagacgcgtattctctcggctccagctcgacgggacaacagtacgacgttcgacctatcgaggtcggagtccaaggcgaagaacgacgaggctagtactacttactgtactaatcagacagacgaggcggtacggaacttaagtaaacggtaggttaccgggaacgggtaacgggtaaccgaacggtacgttccggaaccgttcccgtaagggtccaacgggaccccgaagggtcccgtcccggtaccccccg

SEQ ID NO: 84988 - DNA, 720 bp, Homo sapiens
  misc_feature: GYAE6OF01BN2F8.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagccaccctggtgtcagtcgtcccaggacagacggccaggatcacctgctcgtggagatgcattcgccagaccaatatgtacttacgtggtaccagacaagaacgccgaggccacggccccgttgttcgttttgttagtttaataagtaaaagacgtaggtaggaacgacggccctacggagggtaccttcccgtaggacggtcgtacgtttccgtcgtcggcctaccgagccgttacggaacgggtaaccaacgtacggtacctaacggttacgaacccgtagttacgaagggttacggacggtaccgaagggacgaaagggaaacgacggacggtcgttaacgaactttaacgttacgtacgtaactaacgtaccgaaggtacgaacgaccgtagggtacggtaagggtaacttaaggaaaggttacgggttacgggaacgggtaacgggaaccgtaagggtcccgttaaccggaaccccgggttaccgttaacggggtaccccgaacgggtaacccccggtaacgggtccccggtccccggttaacccccggg

SEQ ID NO: 84989 - DNA, 500 bp, Homo sapiens
  misc_feature: GYAE6OF01BWD9V.4.34.D01.1.454.CMB.1.raw
  modified_base (412)..(412): a, c, t, g, unknown or other
  misc_feature (412)..(412): n is a, c, g, or t
  modified_base (491)..(491): a, c, t, g, unknown or other
  misc_feature (491)..(491): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctcgagggatcccgtgagcgattctctggctccagctcgagggacaacagtcacgttgaccatcagtggagtccaggcaagaagacgaggctgactattacntcaatcagcagacagcggtaggacttaagaagagttcggcggaggacagcgtgaccgtcgtaggtcacgcccaaggccncgtcccccg

SEQ ID NO: 84990 - DNA, 573 bp, Homo sapiens
  misc_feature: GYAE6OF01AZY2D.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccacggcccctgtgttcgttgttataataaagacagtgagacgccctcgaggactccctgacgcgtacttctcgtcggctaccagctacgagggaaccaacgtagtaccgtacgttacgaaccctagtcgaacggtggacgtaccgaggcgaagaagacggagctagacttattactgtacaatcagcagacgaggcggtaggacttagaagtacgggttaccggagggaacgggtaccgaaggtcctcggtaacccggtcgtaacggtccaccgacccgaaacggtcctacccggtcccccggg

SEQ ID NO: 84991 - DNA, 479 bp, Homo sapiens
  misc_feature: GYAE6OF01CM0BS.4.34.D01.1.454.CMB.1.raw
  modified_base (468)..(479): a, c, t, g, unknown or other
  misc_feature (468)..(479): n is a, c, g, or t
tcagagcactgtagcacgaccggtgctcgatttagatcgtctgtgttgggtttggggacagcagacctgagagcgctgggccccacagccctccccctcagacgcccctgctgtcctcctccggtcacgccctggacatcccaggtttccccaggcctgccggtaggtgtagaatgaggtctgtgtcactgtggtattacgattattttgactggtaagattactactactccggtatggacgtcgtcggggccaagggacccacggtcaccgtctcctcacgccctccaccaaggcccagtccggtcctcccccgtcggcccacccctccctaccaagacgccacctcgtcggggccacacggccggccctgggcctcgcccgtggtaccaaacggaccttaaccgttccccgtaacgacgtcgcctcgtggacggccgggtcgtaggacgaaggccgacgagtagnnnnnnnnnnnn

SEQ ID NO: 84992 - DNA, 468 bp, Homo sapiens
  misc_feature: GYAE6OF01A22BI.4.34.D01.1.454.CMB.1.raw
  modified_base (215)..(215): a, c, t, g, unknown or other
  misc_feature (215)..(215): n is a, c, g, or t
  modified_base (446)..(468): a, c, t, g, unknown or other
  misc_feature (446)..(468): n is a, c, g, or t
tcagagcactgtagcacgaccggtgctcgatttagatcgtctgtgttggggtttggggacagcagacctgagagcgctgggcccacagcctcccctcagagccctgctgtctccctccggtcagccctggacatcccaggtttccccaggcctgccggtaggtgtagaatgaggtctgtgtcactgtggtattacgattattttgactggttaanattactactactccggtatggacgtcgtggggccaaagggaccacggtcaccgttctcctcagccctccaccaacggcccatccggtccttccccctcggccacccctcctccaacgacgcctacctcgtcggggcaccgagccggcccgtgggtctcgccgtcggtacgaacggtaccttacctttcccctacacgtcgctcgtgacgcgggctggcaacggcgcagtannnnnnnnnnnnnnnnnnnnnnn

SEQ ID NO: 84993 - DNA, 673 bp, Homo sapiens
  misc_feature: GYAE6OF01B5KCE.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccacggcccctgtgttgttgttatataaagacagtgagaggccctcgagggactcccgtagagacgtattctcgtgcctaccgagcgtcgaagggaacctaaacgacggtacctaacggtttcggaacctaacgtccgtaaggtacgggtacgtacccgaaggaccgaaaggaaacggaccgggaaggtctaggtaaccttaacgtttaacgtacgtaactaacgtacgtaaggaccgaaggaccgagggtacgggttacgggtaactttaaaggttaaaacggacgggtttaccggggaacggggaacgggaaccgtaagggtacccggtacggtaacccggttaccggtaacgggtccgaaaccgtaccccgggaacgggtcccgtcccggttacccccccgg

SEQ ID NO: 84994 - DNA, 909 bp, Homo sapiens
  misc_feature: GYAE6OF01CGHG0.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctggtgtcagtgtccccaggacagacggccaggatcacatgctctggagatgcattgccagaccaatatgcttactggtaccagcagaagccaggccacggcccctgtgttgttgttatataaagacagtgagacggccctacgacggggtaactccccgtaggacgtaccgtaactttccgttccgttcggggtccctttacccgaacggtcccgtttacccggaaaacgggggaaaccctaaaaaccggtacggtttaacccgtaaccggggtttttaccggaaacccccgttaaacgtttaaccccggtaaaggggtttaccgggggtaaaccggtttaccccggaaaacgggggtaacccgtaaacggggtaaaaacgggaaacccggggtaaacggggttaacccgtttaacgggtaaacccgtttttaaacgttttaaacccgtttacggttaaaccgtaaaacgtttacccggaaacggtaaccggtaaacggtaaacccggtaacggggtacccgggggtttaacgggggtaaaaccgtttttaaaacgggttaaaaaacggggttaccggggttttaacccgggggaccgggggtaaaacggggggtaaaccccgtaaaaggggtacccggttaaccgggtaaacccccgggtttacccggttaaacggggtttaccccggaaacggtacccccccggtaaaaggggtccccgtttaaccccccgggg

SEQ ID NO: 84995 - DNA, 719 bp, Homo sapiens
  misc_feature: GYAE6OF01B025G.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccacccgtcggtgtcagtcgtccccaggacagaccggccaggactcacctgctcgtggagatgctattcgaccagaccaatatgcttactcggtaccagcaagaacgccgacggccgacggccccttgtcgtttggtttagttaataagtaaagacgagtggagacggccctacggaggtactcccgtagacggtcgtacttcgtcgtcggtccttacccgaggtacccgttaccggaagggtaaacccaaaccgtaacggttacccgtaaccggttacgaaccctacggttaccgtaagggttacggtacgtacccgaagggaccgaaaggaaacggaacggtacggtaccgtacgtaaccttagtttaaccgtagtaactaagttacgaacgaccacgggtacgaagggttacgggtaaggtaacgttaaacggttaaaggtacggtacgggaacgggacgggtaaaccgacgggacgttacccggaaccggttaccggtaacgggtaccaccggtaaccccgcggtcccgtccccgtaaccccccggg

SEQ ID NO: 84996 - DNA, 506 bp, Homo sapiens
  misc_feature: GYAE6OF01BBAVS.4.34.D01.1.454.CMB.1.raw
  modified_base (429)..(429): a, c, t, g, unknown or other
  misc_feature (429)..(429): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctcagggatcccgtgagcgtattctctggctccagctcgagggaacaacagtcacgttgacatcagtggagtcaggcaagaagacgaggcgtgacttatactgacaatcagcagacagnggtaggattagtaagagttcggaggagggaccaggctggaccgtcgaggtcgacgaccgaggtcgtccgtaccccgg

SEQ ID NO: 84997 - DNA, 614 bp, Homo sapiens
  misc_feature: GYAE6OF01BCV94.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagacggccctcgagggactccccgtgacgcgtattcctctggctccgagctcgagggacaacggtcacggttcgacctatccaggtgggacgtaccgaggccgaagaacggacgaggctagacttattactgtacaattcgagacagacgacgggtcgggtacgggtaacttaagtaaacgggtacgggttcgggaccgggtaacggggaacccgaaggtccgttacgggtaaccccggttaccgtaacggtacccgtaaccggaccccggtaaacgggcccgttacccgggtcccccccgttaacccggg

SEQ ID NO: 84998 - DNA, 739 bp, Homo sapiens
  misc_feature: GYAE6OF01ENC7V.4.34.D01.1.454.CMB.1.raw
  modified_base (231)..(231): a, c, t, g, unknown or other
  misc_feature (231)..(231): n is a, c, g, or t
tcagagcactgtagcacgaccggtgctcgatttagatcgtctgtgttgggtttgggggtgggtccaggaggcagaactctgggtgtctcaccatggcctggatccctctacttcctccccctcctcactctctgcacaggctctgaggcctcctatgagctgacacacgcccaccctcggtgtcagtcgtccccaggacaggaccggccaggactccacctgctcgtgganatgctattcgaccagaaccaatatgacttactggtaccagacaagaacgccgacggccgacggcccccgttgtgtttcgttgttaataataaagactagtaggagacggtccctacgagggactcccgtagacgtcgtattctcgtcggcctccgagtcctcgaacgggacctaacgacgtaccgtacgtttacgaacctagtaccgtaggtacggtaacgtacccgaagggacgtaagggaaacgtacggaggtcctacgtaaacttacgttaacgttcggtacaacgttcgaagtaccgaacgaacgtacgggacggggttaacgggttaaccgtttaaaggtaaaacgggtacgggtttaccgggggaacggggtaaacccgggggtaaacccgtaaacgggttaccggtaaccgggtaacccccggttaccggttaacgggtacccgtaacccgggtaaccccggtaaccgggttccccgtcccccgggttaaccccccccggg

SEQ ID NO: 84999 - DNA, 493 bp, Homo sapiens
  misc_feature: GYAE6OF01DPQVQ.4.34.D01.1.454.CMB.1.raw
  modified_base (395)..(395): a, c, t, g, unknown or other
  misc_feature (395)..(395): n is a, c, g, or t
  modified_base (406)..(406): a, c, t, g, unknown or other
  misc_feature (406)..(406): n is a, c, g, or t
  modified_base (441)..(441): a, c, t, g, unknown or other
  misc_feature (441)..(441): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagagccctcagggatccctgagcgattctctggctccagctcagggacaacagtcacgttgaccatcagtgagtccaggcagaagacgaggntgactattacngtcaatcaagcagacaggcggtggactaagaaagngtcggaggagggaccaagctgaccgtctacggtcagcccaaggctgcccccg

SEQ ID NO: 85000 - DNA, 436 bp, Homo sapiens
  misc_feature: GYAE6OF01EN2YU.4.34.D01.1.454.CMB.1.raw
  modified_base (314)..(314): a, c, t, g, unknown or other
  misc_feature (314)..(314): n is a, c, g, or t
  modified_base (429)..(436): a, c, t, g, unknown or other
  misc_feature (429)..(436): n is a, c, g, or t
tcagagcactgtagcacgaccggtgctcgatttagatcgtctgtgttgggtttggggacagcagacctgagagcgctgggcccacagccctccccctcagagccctgctgtctcctccggtcagccctggacatcccaggtttccccaggcctgccggtaggtgtagaatgaggtctgtgtcactgtggtattacgatattttgactggttaagattactactactccggtatggacgtcgtggggaccaagggaccacggtcaccgtctcctcacgcctccaccaagggcccatcggtccttccccctggccnccctccctccaagacgccacctcgtcgggggcacgacggcggccctgggctgcctggtcaaggtacctacttccctacacgtgcctctgacgcgggctggacaaggcgcgatagnnnnnnnn

SEQ ID NO: 85001 - DNA, 693 bp, Homo sapiens
  misc_feature: GYAE6OF01B97EL.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctcccctctcactctctgcacaggctctgaggcctcctatgagctgacacagccaccctcggtgtcagtcgtccccaggacagacggcaggatcacctgctctggagatgcattgccaagaccaatatgcttaactggtaccagcagaagccaggccacggcccctgtgttgttgttaatataaaagacagtgagacgcctcgaggatccctgaacgtcgaattctcgtggcctccaaggccttacgacgggacaaacgtacgtacgtacgtttacgaccaagttacgaaggttggacgtccgaacgggaacgaaacggaaggaacggtacggtacgtaacgtaaacgtttaacgttaacgttacgttaaactaaacgttaccgaacggtaccggaaacggaacggtaacgggtacggggttaacgggttaaacgtttaaaacggtaaaagggttaacggggttaccgggaaacggggaaaccgggtaaaccgtaaacggtaccgttaccggtaacccgttaccggttaacggaaccgaacccggaaccccgtaaacgggtcccgtacccggtcccccgg

SEQ ID NO: 85002 - DNA, 688 bp, Homo sapiens
  misc_feature: GYAE6OF01CY657.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttcctcccccctcctcactctctgcacaggctctgacggcctcctatgagctgacacacgcccacccgtggtgtcagtcgtccccaggacagacggccaggatcacctgctcgtggagatgctattcgaccaagacctaatatgtccttacgtacggtaccagcaagaacgccgacggccgacggccccttggttcgtttagtttagttaataagtaaacgacgaggttaggagaccgggtccctacggacggacctcccgtagacgtcgtacttcctcgtcggcctacgcgcgtacggacgggaaccaacgtacgtcgtacgttcgaacctactcgaggtcggtacgtccgaggacgaaggaggacgaggactacgattagttacgagtacatcgaagtacgacggacacgggtacgggtaggttaacgttaaaggtaaacggttacggggttacgggacgggtaaaccggggaaccgaagggttacccgtaccgggtaccccggttaaccggttacgggtaacccgaacccggtacccggaaaccgggtcccggttacccccggtaccccccggg

SEQ ID NO: 85003 - DNA, 460 bp, Homo sapiens
  misc_feature: GYAE6OF01ASKC9.4.34.D01.1.454.CMB.1.raw
  modified_base (432)..(432): a, c, t, g, unknown or other
  misc_feature (432)..(432): n is a, c, g, or t
  modified_base (439)..(439): a, c, t, g, unknown or other
  misc_feature (439)..(439): n is a, c, g, or t
  modified_base (442)..(460): a, c, t, g, unknown or other
  misc_feature (442)..(460): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgattattttgactggttaagattactactactccggtatggacgtctggggccaagggaccacggtcaccgtctcctcacgcctccaccgaacgggcccactccggtccttcccccgtcggccacccctccctaccaagacgcacctcgtggggcacgacgccggcccgtgggctcgcctggtcaacggacctaccttccctacgagtcgctctcgacggcgggcgtggacgacgggcncagtagncgnnnnnnnnnnnnnnnnnnn

SEQ ID NO: 85004 - DNA, 545 bp, Homo sapiens
  misc_feature: GYAE6OF01BMSVR.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccacggcccctgtgttgttgttataataaagacagtgagagccctgaggactcctgagcgattctctgctccagctacgagggacaacgagtacacgttagaccatcgagtggacgtccgaggcaaggaacgacgaggctagtaactattacgtagtacaatcagacgagaccgaggtcggtagggtaacgttaagtaaaggtaggttcgggacgggacggaccgagactcggaccgtcgtacggtcacgacccgaacggtccgtccggtacccccg

SEQ ID NO: 85005 - DNA, 469 bp, Homo sapiens
  misc_feature: GYAE6OF01CXTAL.4.34.D01.1.454.CMB.1.raw
  modified_base (212)..(212): a, c, t, g, unknown or other
  misc_feature (212)..(212): n is a, c, g, or t
  modified_base (342)..(342): a, c, t, g, unknown or other
  misc_feature (342)..(342): n is a, c, g, or t
  modified_base (427)..(427): a, c, t, g, unknown or other
  misc_feature (427)..(427): n is a, c, g, or t
  modified_base (449)..(469): a, c, t, g, unknown or other
  misc_feature (449)..(469): n is a, c, g, or t
tcagagcactgtagcacgaccggtgctcgatttagatcgtctgtgttgggtttggggacagcagacctgagagcgctgggcccacagccctcccctcagagccctgctgtctcctccggtcagccctggacatcccaggtttcccccaggcctgccggtaggtgtagaatgaggtctgtgtcactgtggtattacgatatttgattggtaanattactactacgtcggtatggacgtcgtggggaccaagggaccacggcaccgtctcctcacgcctccgaccgaaacgggccctacgtccggtcccttcccccgcggcccaccccgtccctaccaacgacnccgacctcgcggggacacgacgccggcccgtgggctcgccgtggtcaacggactacttcccacacgtcgctctaggacgccgggntcggacaagggccgcaagtggnnnnnnnnnnnnnnnnnnnnn

SEQ ID NO: 85006 - DNA, 778 bp, Homo sapiens
  misc_feature: GYAE6OF01CRKO6.4.34.D01.1.454.CMB.1.raw
  modified_base (210)..(210): a, c, t, g, unknown or other
  misc_feature (210)..(210): n is a, c, g, or t
tcagagcactgtagcacgaccggtgctcgatttagatcgtctgtgttgggtttggggtgggtccaggaggcagaactctgggtgtctcaccatggcctggatccctctacttctcccctctcactctctgcacaggctctgagcctctatgagctgacacagccaccctggtgtcagtcgcccaggacagacggcaggatcactgctcgnggagatgctagttcgaccaagtaaccaagttatcgtacttacgtggtaccaagacaaggaacgccgaaggccacggcccttggtgtttgttagtttataataaagacgaggtagaacggaacggtcccaggacgggtaactcccgtagacgtaccgtattccgtcgtcggtacctccgacgcgtacggaagggtaaccaaacgtacgtacgtaacgtttacgaaccctagtaccgtaggttacggaacgttacccgaaggaacgtaaacgggaaacgacgggacggtactaaggtaacctttaagtttacgtacgtaaactaacgttaccgaaacggtaccgaaacggtaacggaacggggttaccggggttaacgggtaaaccttttaaaggggtaaaacggttacccgggggttaaccgggggaaccggggaaaaccggggtaaacccgtaaacgggtacccggttaacccggttaaacccggggtccccggttaaacgggttacccgaaacccgggtaacccgggtaaaccgggtccccggttaccccggttaaccccccccggg

SEQ ID NO: 85007 - DNA, 542 bp, Homo sapiens
  misc_feature: GYAE6OF01EN0KL.4.34.D01.1.454.CMB.1.raw
  modified_base (462)..(462): a, c, t, g, unknown or other
  misc_feature (462)..(462): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctgaggactccctggagcgattctcgtggctccgagctcaacgggtacaaacgagtccgaacgttcgaaccatccagtggacgtccgaaggcaagaacgacgaggctgactattactgtacatcagcagagagcggtgggaacttagaaagngttacgggacggagggaacaagccgtcgaaccggtcctaacgggttccaacggcccaaaggtccgtcccggtaccccccg

SEQ ID NO: 85008 - DNA, 646 bp, Homo sapiens
  misc_feature: GYAE6OF01BRIF2.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggactcacctgctcgtggagatgctagttcgccaagaccaatatgtacttactacggtaccagcaagaacgccgaggccgacggtcccctgtcgtttgttagttaataataaagacacgtgacggacgccctacgagggtactcccgtaggacgtcgtattcctcgtcggtcctccgacgtcgtacgacgggaacaacgtacgtacgtacgttacgacctagtacgaggtcggacgtaccgaaggacgaaggaacggacgtacggactacgtacttattacgtagttacaatcgacgacgacggaacgacggtacgggtaggtacgttaaagtaacggtacggttacgggaacgggtaacggtaacgaacggtcgtaccgggacccgttacgacgggttaccgaccggaccggaaccggtcccgtcccgtaccccccggg

SEQ ID NO: 85009 - DNA, 686 bp, Homo sapiens
  misc_feature: GYAE6OF01CWC2Q.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgacggcctctatgagctgacacacgcccacccgtcggtgtcagtccgtaccccgaggacaggaccgccgaggactccacctgctcgtggagtatgctagttcgaccaagacctaatagtcgtaccttacgtacggtaccagacgaaggaacgccgacggaccgaccggtccccgtggttcgtttgtttagttaataagtaaagacgtagtagacggacgccctacgacggtacctccgtgacgcgtacttcgtcgtcgtcctaccgacgtccgtacggaacgggaaccaacgtacgtaccgtacgttacgaacctacgtacgtagggtacggacgtaccgaggacgaaaggaacggacggaggtacgtagtacttattacgcgtaacaatacgacgtacgaggacgtagggtacgggtaaggtacttaaaggtaaacggtcgggttacgggacgggtaacgggaacgtaacggtccgtaccggtacccggttacgtacggtaccgaaccggacccgtaaccggtccgtccccggtacccccgg

SEQ ID NO: 85010 - DNA, 573 bp, Homo sapiens
  misc_feature: GYAE6OF01DLLUJ.4.34.D01.1.454.CMB.1.raw
  modified_base (539)..(539): a, c, t, g, unknown or other
  misc_feature (539)..(539): n is a, c, g, or t
  modified_base (541)..(573): a, c, t, g, unknown or other
  misc_feature (541)..(573): n is a, c, g, or t
tcagagcactgtagcacgaccggtgctcgatttagatcgtctgtgttggggtttggggacagcagacctgagagcgctgggcccacagccctccccctcagacgccctgctgtcctccctccggtcagccctggacactccccgtacggtttcccccaggcctggccgggtaggtgtagaagtggaggtctggtgtcacgtggtaggttattacgatttattttgaacttaggttaagtattactactacgtccggtagtcggacgtcggtcggggaccaagggacccacggtcaccgtcctcctcacgccctcccgaaccgaacgggcccacgtccggttcccttccccccgtcggcccctacccctcccgtaccgaacgacgccaacccgtccggtcgggggaccaccgacggcccggtcccgtgggccgtcgcccgtacggtaccgaaacggtaccttaacccttccctacgtacgtcgtcctacgtacgggtacggccggggtcgtacgggaccgaacgggccgtacaacgtagngnnnnnnnnnnnnnnnnnnnnnnnnnnnnnnnnn

SEQ ID NO: 85011 - DNA, 811 bp, Homo sapiens
  misc_feature: GYAE6OF01DVI20.4.34.D01.1.454.CMB.1.raw
tcagagcactgtagcacgaccggtgctcgatttagatcgtctgtgttgggtttggggtgggtccaggaggcagaactctgggtgtctcaccatggcctggatccctctacttcctccccctcctcactctctgcacaggctctggacggcccttacctatgagctagaccacgacgccctacccgttcggtgtaccagttccgacccgaaaggaccaggaccggccgaaggtactaccaccgtgccttcgaggagatcggacctagttcgaccaacgaacctaaattgtacgtacctttaacgtacgtaaccgagacgaagaaccggccgacggacccgaccggtcccgtttgggttgttttacgtttagtttaaactaagttaaacgacgtaggtaggacggtaccgcccgtagacggtacctccgaggtacgtcgtacgttctcgtcggtcctcgaacggtcgacggtaaacggaacctaaacgtaccgttacgtaacggttacgaaccgtagtaccggagggtacgtaaccggtacgaacggacgaaacggaaacggaccggtagtccgttaaagtaaccgttaacgttacgtacgtaactaaggtaccgtaacgacggtaacgtaacggtacgggttaacgggttaggttaaacgttaaggttaaacgggttaccgggtacggggaaaccgggtaggtaaaccccggtaaggttcccggttaaccgggtaacccggttaacccggtacgggtacccgaaaccgggttccccggtaaaccggtccccgtaccccggggttacccccgg

SEQ ID NO: 85012 - DNA, 591 bp, Homo sapiens
  misc_feature: GYAE6OF01ERIGY.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcactgctctggagatgcattgccagaccaatatgcttactggtaccagcagaacgcaggccacggcccctgtgtttgttgttataactaaagacaggtgaggacggccctgagggactcccgtgacgcgtatttcctagtcggctccgacgcctacgacgggaacaacgagtacacggttcgaacctatcgagtggacgtccgaggacgaaggaacgacggagctagacttattactgtacaagtcagacagacgaggcggtagggtacttaagtaaggtacggtttcggggacgggtaacgggaccgaaggtccgtacggtaacccggtccgttaacgggtccaaccggaccccgaacggggtccctccggtacccccccgg

SEQ ID NO: 85013 - DNA, 816 bp, Homo sapiens
  misc_feature: GYAE6OF01CN9JT.4.34.D01.1.454.CMB.1.raw
  modified_base (284)..(284): a, c, t, g, unknown or other
  misc_feature (284)..(284): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctctatgagctgacacacgcccacccgtcggtgtcagtcgtccccaggacagacggccaggactcacctgctcgtggagatgctattcggaccaagaccaatagtgtaccttacgtagtaaccagacgaacgaacnccgaacggccaccggtccccgtggttcggtttagtttagttaataagtaaacggactaaggtgaacggtacggtaccccgttaggaacgggtaccttcccgtaggaacgtccgtaacgtttccgtccgttcggacccttaccgaaggtccctacggtaacgggtaaactaaacgtacgttaccgtaaccggttcgaacccgttacgtacgtagggttaccggacgtacccgaggacgaaaaggtaacgacggtaaggtccgttaacggaaacttttacgttaacgtagtaaccgtaaaacgttccgaacggaccgaaacgggtaccggtaacggggtaacggggtttaacgggtaaactttaaaacgggtaaacgggtaccggtttcccggggggaaacgttaacccggggaaaccgtaacgggttacccggttaacccggggtaaaccccggtttaccgtaacgggggtacccgtaaccgggaaccccccgggttaacgggtccccggttcccccggttaaccccccgggg

SEQ ID NO: 85014 - DNA, 454 bp, Homo sapiens
  misc_feature: GYAE6OF01B4727.4.34.D01.1.454.CMB.1.raw
  modified_base (178)..(178): a, c, t, g, unknown or other
  misc_feature (178)..(178): n is a, c, g, or t
  modified_base (445)..(454): a, c, t, g, unknown or other
  misc_feature (445)..(454): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtntcactgtggtattacgattattttgactggttaagattactactactccggtatggacgtcgtggggaccaagggccacggtcaccgtctcctcacgcctccaccaacgggcccatccgtccttcccccctcggccacccctccctccaacgacgccaccctccgtcggggggccacgacggccggcccgtgggcctcgccgtcggtacaacggtacctaccttcccctacagtcgtctctggagcgggctggcgaaggcgcatagnnnnnnnnnn

SEQ ID NO: 85015 - DNA, 508 bp, Homo sapiens
  misc_feature: GYAE6OF01DXVN4.4.34.D01.1.454.CMB.1.raw
  modified_base (479)..(508): a, c, t, g, unknown or other
  misc_feature (479)..(508): n is a, c, g, or t
tcagagcactgtagcacgaccggtgctcgatttagatcgtctgtgttgggtttggggacagcagacctgagagcgctgggcccacacgccctccccctcagagccctgctgtctcctccggtcagccctggacatcccaggtttccccaggcctgccggtaggtgtagaatgaggtctgtgtcactgtggtattacgattattttgacttggttaagattactactactccggtatggacgtcgtggggccaagggaccacggtcaccgtctcctcacgccctccaccgaacgggcccatccggtccttccccctcggccacccctccctaccaagacgccaccgtcgtcgggggccacgacgccggcccgtgggcctcgccgtcggtaccgaaacggtaccttaccttcccctaacgacgtcgccttcgtggacgggccggggtacgtcgggaccgaaacgggccgtacgaagtaggnnnnnnnnnnnnnnnnnnnnnnnnnnnnnn

SEQ ID NO: 85016 - DNA, 495 bp, Homo sapiens
  misc_feature: GYAE6OF01CO039.4.34.D01.1.454.CMB.1.raw
  modified_base (478)..(488): a, c, t, g, unknown or other
  misc_feature (478)..(488): n is a, c, g, or t
  modified_base (492)..(495): a, c, t, g, unknown or other
  misc_feature (492)..(495): n is a, c, g, or t
tcagagcactgtagcacgaccggtgctcgatttagatcgtctgtgttgggtttggggacagcagacctgagagcgctgggcccacagccctcccctcagagccctgctgtctcctccggtcagccctggacatcccaggtttccccaggcctgccggtaggtgtagaatgaggtctgtgtcactgtggtattacgatattttgactggttaagattactactactccggtatggacgtctggggaccaagggaccacggtcaccgtctcctcacgcctccaccgaaacgggcccagttccggtcccttcccccctcggtcccacccctccctaccgaaagacgccaccgtcgtgggggaccacgacggccggcccgtgggctcgcccgtggtaccgaaacggtacctaccttacccctaacgtacgtcgccgtcgtaggacggccggggacgtcgggacgaacgggccgacgagtagnnnnnnnnnnngggnnnn

SEQ ID NO: 85017 - DNA, 538 bp, Homo sapiens
  misc_feature: GYAE6OF01EBC0N.4.34.D01.1.454.CMB.1.raw
  modified_base (217)..(217): a, c, t, g, unknown or other
  misc_feature (217)..(217): n is a, c, g, or t
  modified_base (522)..(538): a, c, t, g, unknown or other
  misc_feature (522)..(538): n is a, c, g, or t
tcagagcactgtagcacgaccggtgctcgatttagatcgtctgtgttgggtttggggacagcagacctgagagcgctgggccccacagcctccccctcagagccctgctgtcctcctccggtcagccctggacatcccaggtttccccaggcctgccggtaggtgtagaatgaggtctgtgtcatgtggtattacgattattttgacttaggttaanattactactactccggtatggacgtcgtggggaccaagggccacggtcaccgtctcctcacgccctccaccgaacgggccccacgtccggttcccttccccccgtcggcccctacccccttccctacccgaaacggacgcccgtacccgtccggtcggggggaccaccggacggccccgggccccgttaggggccgtcgcccgttacgggtaccgaaacggtaccttaacccgtttcccctacgtacggtcgccttcgtaggacgggccggggtcgtcgggaccggaagggccgacgaacgtagnnnnnnnnnnnnnnnnn

SEQ ID NO: 85018 - DNA, 691 bp, Homo sapiens
  misc_feature: GYAE6OF01C1D27.4.34.D01.1.454.CMB.1.raw
  modified_base (225)..(225): a, c, t, g, unknown or other
  misc_feature (225)..(225): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggactcacctgctctgganatgcattcgccaagacctaatattcgcttacgtcggtaaccagacaagaacgccgacggccacggtcccccgttagttcggtttagtttaggttaataacgtaaaagacgtagtaggacggacggccccgtacgagggtactcccgtagacgtcgtacttccgtgtcggtcctcgacgccgtacgaacgggaacaaacgacgttaccgtaacgttcgaacctacgtacgacggggttaggaccgtaccggaacgggaccgaaaaggaacgggtaacggacggtaccgtacggtaacttaacgttactacgtacaatccgagtaccaggacgtacggtcgggtaacgggtacttaaggtaaggtcggtaccggggtagggaaccggtaaccgaggtaccggtccggtaacccgttacggtacggtaccgaaccgacccggtaacggtcccgtcccggtaccccccgg

SEQ ID NO: 85019 - DNA, 597 bp, Homo sapiens
  misc_feature: GYAE6OF01EXR3X.4.34.D01.1.454.CMB.1.raw
  modified_base (285)..(285): a, c, t, g, unknown or other
  misc_feature (285)..(285): n is a, c, g, or t
  modified_base (435)..(435): a, c, t, g, unknown or other
  misc_feature (435)..(435): n is a, c, g, or t
tcagagcactgtagcacgaccggtgctcgatttagatcgtctgtgttgggtttgggggtgggtccaggaggcagaactctgggtgtctcaccatggcctggatctctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggtcccctgtgttngttgttataataagagagtgagacggccgtcgaggacgtccgtgacgcgtacgttctcgtcggctccgacgctacgacggaacgaacgtacgtacgtacgttacgtaccgacgtacgtagtaggtacgtaccgaacggacgaaggaacgnaacggacggtacgtacgtacgttaacttaactacgtacgtaacgtacgacgacgacgacgacggtacgggtagggtaacgttaagtaaacggtacggtacgggacgggtacgggaaccggaacggacgtacggaccgtaccgtaccggtacgacggtacccg

SEQ ID NO: 85020 - DNA, 653 bp, Homo sapiens
  misc_feature: GYAE6OF01EBZL6.4.34.D01.1.454.CMB.1.raw
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
  modified_base (350)..(350): a, c, t, g, unknown or other
  misc_feature (350)..(350): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctctatgagctgacacagcccaccctggtgtcagtcgtccccaggacagacggccaggactcacctgctcgtgganatgcattgccaagaccaatntgtactactacggtacaggcaagaacgccaggccgacggtcccctagttcgtttgttagttaagtagtaaagaccgagtgagacggccctacgaggtacttcccgngacgtcgtatttaccgtcgtggtcctcaacgtctacgacgggaaccaacgtacgtaccgtacgttacgacctacgtacgtaggtacgacgttaccgacggtaacgaaggaacgaacggaggtccgtacgtacgttattaacgttctacgtaacgtcgtaacgactagtaacccgaggtaccgggtacgggttaacgtaagttaaaagggtacggtaacgggtacgggtaacgggaaccgtaaggccgttacggaccgtaccggtaacgtcgaacggtacccgacggtccgtcccggtaccccg

SEQ ID NO: 85021 - DNA, 671 bp, Homo sapiens
  misc_feature: GYAE6OF01DOH2Z.4.34.D01.1.454.CMB.1.raw
  modified_base (642)..(671): a, c, t, g, unknown or other
  misc_feature (642)..(671): n is a, c, g, or t
tcagagcactgtagcacgaccggtgctcgatttagatcgtctgtgttgggtttggggacagcagacctgagagcgctgggccccacacgccctccccctcagacgccctgctcgtcctccctccggtcacgcccctggaccactccccgtacggtttcccccaggccctcggccggtaggtgtagaatggaggtctgtcgtcactggtggttattacgtatttattttagacttaaggttaagtactttaacctacttaccgttccgggttaatcgggtaccgttcggtacgggggacccgaaacggggacccgtaccggtaccgtaccccgttcctcccctccgaccgcccctacccgaacccggaaacccgggcccctaaccgttcccggttcccctttccccccgtcggtacccccctacccccgttcccccgtaacccgaaacgacccgtacccgtaaccccgttccgggtaccgggggacccaaccggacccgggtccccgggtccccggtcggggtccgtccggtacccgtacgggtaccgtaaacggtacccctttaacccgttaccccgtacgtacgtccgtcctcggtcgggacggtccgggtcggtaggaccgacgggccaacgtagtgacnnnnnnnnnnnnnnnnnnnnnnnnnnnnnn

SEQ ID NO: 85022 - DNA, 607 bp, Homo sapiens
  misc_feature: GYAE6OF01ADBS3.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagacgccctcgagggactccctgagcgtattctctggctccagctcgagggacaacgtagtactacgttacgaccatcgaaggtggacgtcccgaaggcaaggtaacggacggaggtctaggtacttaagttactgtacaatcgaagcaagtacgaggtcgggtacggtaacttaaaggtaaaggtaggttaccgggacgggtaacgggaacccgaaaggtaccggtacggtaaccccggttacccgttaacgggtacccgtaacgggaacccccgaaagggtcccgtcccggtacccccccgg

SEQ ID NO: 85023 - DNA, 582 bp, Homo sapiens
  misc_feature: GYAE6OF01D16F3.4.34.D01.1.454.CMB.1.raw
  modified_base (335)..(335): a, c, t, g, unknown or other
  misc_feature (335)..(335): n is a, c, g, or t
tcagagcactgtagcacgaccggtgctcgatttagatcgtctgtgttggggtttgggggtgggtccaggaggcagaactctgggtgtctcaccatggcctggatccctctacttctcccctcctcactctctgcacaggctctgaggcctcctatgagctgacacagccaccctcggtgtcagtgtcccaggacagacggccagagggtcacctgctctggagatgcattgccagaccatatgcttactggtaccagcagaagccaggccaggcccctgtgttgttcgttatataaagacagtgagacggcctcagggactccctgagcgattcnctggctccagcctcgagggacaacgagtcaacgttgaaccatcagtggaagtccaaggcaagaacgacgaggctagactattactgtacaatcgagacgagaacgtacggacggtagggtaactttaaggtaaaggtacggttccgggaacgggtacgggtaaccgaaaggtcgtacgggtaaccccggttccgttaaacgggtccaaacggtaccccgaaacgggcccgtcccggtacccccccgg

SEQ ID NO: 85024 - DNA, 699 bp, Homo sapiens
  misc_feature: GYAE6OF01C5ZH4.4.34.D01.1.454.CMB.1.raw
  modified_base (223)..(223): a, c, t, g, unknown or other
  misc_feature (223)..(223): n is a, c, g, or t
  modified_base (229)..(229): a, c, t, g, unknown or other
  misc_feature (229)..(229): n is a, c, g, or t
tcagagcactgtagcacgaccggtgctcgatttagatcgtctgtgttgggtttgggggtgggtccaggaggcagaactctgggtgtctcaccatggcctggatccctctacttcctcccctcctcactctctgcacaggctctgaggcctcctatgagctgacacacgcccacccgtcggtgtcagtcgtccccaggacaggacggccaggatcactgctcgnggaagntgcatcgaccagaaccaatatcgtacttaactacgggtaaccaaggacaaggaacgaccgacgggacccaacggtccccgttggttaggtttgtttacgttaataagtaaaagacgaggtagaggtacgcccgtagaggtactccgtaggacgacgtatcgtactcggacctcgaagctaacggaggtaacaacgtaggtacctacggttacacgtaactcgtaacgggtacggaacgtacccggaagggtacgaaaggaacggaacggacgggtaccttaaggtaactttaactacgttagtaacaagtacaggacgtaacggacgtacgggtacggtagggtaacttaaagaaacgggttagggtaccgggaacgggaaaccgggtaacgaaacggttcgaaacgggtaacccggttacgtaaggacccggaacggtaccccgaagggtcccgtccgtaccccccggg

SEQ ID NO: 85025 - DNA, 573 bp, Homo sapiens
  misc_feature: GYAE6OF01CF4LJ.4.34.D01.1.454.CMB.1.raw
  modified_base (342)..(342): a, c, t, g, unknown or other
  misc_feature (342)..(342): n is a, c, g, or t
tcagagcactgtagcacgaccggtgctcgatttagatcgtctgtgttgggtttggggggtgggtccagggaggcagaactctgggtgtctcaccatggcctggatccctctacttcctccccctcctcactctctgcacaggctctgaggcctcctatgagctgacacagcccaccctcggtgtcagtcgtccccaggacagacggccaggatcacctgctctggagatgctattgccagaccaatatgcttactcggtaccagcaagaacgccacggccacggcccctgttgtttgttagttataataaagacagtgagacggtccctagaggactcccgngagcgtattctcgtcggcctccagcctacggagggacaacgtagtcacgttcgactatacgagtaggtacgtacgaggcaaggacgacgaggctagtacttattactgtacactcagcacgagacggcggtaggtacttaagaaggtacggtacggacgggacggtaaccgaggcgtacggacccgtaccggtagtaccgacggaccgtaacggcgtcccggtaccccccg

SEQ ID NO: 85026 - DNA, 539 bp, Homo sapiens
  misc_feature: GYAE6OF01CH9KQ.4.34.D01.1.454.CMB.1.raw
  modified_base (366)..(366): a, c, t, g, unknown or other
  misc_feature (366)..(366): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgccagaccaatatgcttactggtaccagcagaagccaggccaggcccctgtgttgttgttataataaagacagtgagaggccctgagggatccctgagcgattctcgtcggctccgagctcgaaagggacaaacgngttacgaacgttcgaaccatcgagtggatcgaggacaagaagacgagctagactaagttactgtacaatcaagtcgaagacaggcggtaggaacttaagaaagtggtacggacggagggaacccaaggctacggaccgtccgaggtccacgcccgaaggccgtcgtacccccg

SEQ ID NO: 85027 - DNA, 626 bp, Homo sapiens
  misc_feature: GYAE6OF01AY6KV.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacgccaggatcacctgctctggagatgcattgccagaccaatatgcttactggtaccagcagaagccaggccaggcccctgtgtttgttgttactataaagacagtgagacggccctgagggactcccgtgacgcgtattcctcgtcggacctcgacgtctacgagggaccaacgacgtcgacgttcgacctagtacgaggtcggacgtaccgaggactaaggaacgacgagctagtactattactacgtacaagtcaagtcgaagacgtaggtacgggtacggtaacgttaaagtaaacgggtacggttaccgggaacggggtaacgggtaacccgtaagggtacccggttacggtaaccccggttaccgtaacgggttaccgaaccggtaccccggaaacgggtcccgtcccggttacccccccggg

SEQ ID NO: 85028 - DNA, 652 bp, Homo sapiens
  misc_feature: GYAE6OF01EWKY9.4.34.D01.1.454.CMB.1.raw
  modified_base (227)..(227): a, c, t, g, unknown or other
  misc_feature (227)..(227): n is a, c, g, or t
  modified_base (411)..(411): a, c, t, g, unknown or other
  misc_feature (411)..(411): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgagcctcctatgagctgacacacgcccaccctcggtgtcagtcgtcccccaggacagacggccaggactcacctgctcgtgganatgactattcgccaagaacctaatactgacttacgtggtaccagacaagaacgccgacggcccgacggccccgttgtcgtttgttagttaactaagtaaagacgtagtggagacggtccctacggacggtacgtcccgtagacgacgttacttccgtcgtcgcctcacgctacggaggacaacngtactaccgtgacctatcctaggtgacgtacccgaggacaaggaacggacggacgtctacgtacttaacttacgtacgtactaagacaacgtacgacgaacgtacggtaggtacgggaaacttaacggtaacggtaggggttacccggaacggtaaccgggaaccgaaggtacccggtacggttaccccggtaacgtacggtcccgaacgtacccgacggtccgtacccggtaccccccgg

SEQ ID NO: 85029 - DNA, 608 bp, Homo sapiens
  misc_feature: GYAE6OF01CBTTJ.4.34.D01.1.454.CMB.1.raw
  modified_base (179)..(179): a, c, t, g, unknown or other
  misc_feature (179)..(179): n is a, c, g, or t
  modified_base (222)..(222): a, c, t, g, unknown or other
  misc_feature (222)..(222): n is a, c, g, or t
  modified_base (494)..(494): a, c, t, g, unknown or other
  misc_feature (494)..(494): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtntcagtcgtccccaggacagacggccaggatcactgctctgganatgctattcgccagaccaatactcgtacttacgtcggtaccagacaagaacgccgacggccacggtcccctggttcgtttgttagttataataaagcaggtgagacgcccgtgacggtctccgtgacgtcgtacttcgtcgtcggctaccgcgtcctacggaacggaacaacgtcgtaccgtacgttacgacctaggtacaggtacggcgtacgacggtacgaaggaagacggaggtctagtacttattacgtagtaccatcagcaagacgnggtcgggtagtacttaaggtaacggtaggtcgggacggaacggaccgtaaggccggttacgacccggttacgtacggtacccgacgacccgacggtcccgtcccggtaccccgg

SEQ ID NO: 85030 - DNA, 633 bp, Homo sapiens
  misc_feature: GYAE6OF01EWQ96.4.34.D01.1.454.CMB.1.raw
  modified_base (223)..(223): a, c, t, g, unknown or other
  misc_feature (223)..(223): n is a, c, g, or t
  modified_base (264)..(264): a, c, t, g, unknown or other
  misc_feature (264)..(264): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtccagtcgtccccaggacagacgccaggatcacctgctctgganatgcattcgcagaccaatatgcctactggtacagcagaacncaggccagcccctgtgttgtgttatataagacagtgagacgcctagaggactcctagagccgtattccgtcgtgctcagctcgacggaccaacgtagtactacggttcaccagtcgaaggtcggtaacgtcccgtaagggccgaacggtaaacggacggtacgggtctaaccgtacttaacgtttacttcgtacaaacgtcaacggtacgacgaaccgacggtacggttaagggacgttaaagtaaacggacggtttaccgggacgggtaacgggtaccgtaagggacccgttacggtaccccgggttacgttaccgggtacgaaccgggtacccctaaacggggtcccgtacccgttacccccccggg

SEQ ID NO: 85031 - DNA, 706 bp, Homo sapiens
  misc_feature: GYAE6OF01BK4LN.4.34.D01.1.454.CMB.1.raw
  modified_base (237)..(237): a, c, t, g, unknown or other
  misc_feature (237)..(237): n is a, c, g, or t
tcagagcactgtagcacgaccggtgctcgatttagatcgtctgtgttgggtttgggggtgggtccaggaggcagaactctgggtgtctcaccatggcctggatccctctacttcctcccctcctcactctctgcacgaggctctggacggcctcctatgagctgacacacgcccacccgtcggtgtcagtcgtccccgaggacagaccggaccaggactccaccgtgctcgtagganagtgctagttcgaccaacgaaccaatagtcgtacttacgtacggtaccagacgaagaacgccgacggccgacggtcccctggttcgttggtttagttaataagtaaagacgaggtggaaggacgccctaggaggtacctccgagacgtcgtattcctcgtcggcctacgacgtctacggaacgggaaccaacgtacgtacgtacgttaccgaaccgtagtacgtaagggtcggtaacggtaccgaaggacgaaaggaaacggacgggtacgtacgttacggtaacctttaagttacgttacgtaacctaacgttacgaacgtacgaacggtaacggacggttacgggttacggtaaacgttaaaggtaaggtacggtcggggaacgggtaaacggaccgaaggacggtccggtaccgttacgtaacggtacgaacccgaccggtaacggtcccgtcccggtacccccgg

SEQ ID NO: 85032 - DNA, 510 bp, Homo sapiens
  misc_feature: GYAE6OF01DBGN5.4.34.D01.1.454.CMB.1.raw
  modified_base (485)..(510): a, c, t, g, unknown or other
  misc_feature (485)..(510): n is a, c, g, or t
tcagagcactgtagcacgaccggtgctcgatttagatcgtctgtgttggggttggggacagcagacctgagagcgctgggcccacacgccctccccctcagagcccctgctgtcctccctccggtcagccctggacatcccaggtttccccagtcctgccggtaggtgtagaatgaggtctgtgtcactggtggtattacgattattttgactggtaagattactactactccggtatgggacgtcgtggggaccaagggaccacggtcaccgtctcctacacgccctaccacgaacgggcccagtccggtcctcccccgtggccacccctcctaccaagcgaccaccgtcggtacggggccacgacggcccggtcccgtggggcctcggcccgtaggtaccaaacggtaccttaacccttcccctaagacgtcgtcctcgtcggacggtccggggacctagggacgaacgggccactaagtagnnnnnnnnnnnnnnnnnnnnnnnnnn

SEQ ID NO: 85033 - DNA, 442 bp, Homo sapiens
  misc_feature: GYAE6OF01CSZBM.4.34.D01.1.454.CMB.1.raw
  modified_base (212)..(212): a, c, t, g, unknown or other
  misc_feature (212)..(212): n is a, c, g, or t
  modified_base (426)..(442): a, c, t, g, unknown or other
  misc_feature (426)..(442): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgatattttgactggttaanattactactactccggtatggacgtgtggggaccaagggaccaccggtcaccgtctcctcacgccctccaccaagggcccatccggtccttccccctggccacccctcctccaagcgccacctcgtggggcacgacgccggccctgggctcgcctggtcaacggactacttccctacagtcgctcgtgagcgggcgtcggcaaggcgcatagcnnnnnnnnnnnnnnnnn

SEQ ID NO: 85034 - DNA, 740 bp, Homo sapiens
  misc_feature: GYAE6OF01CMANU.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccacccgtcggtgtcagtcgtcccccgaggacaggaccggccaggactccaccttgcctcgtagggagatcgctagttcgaccaacgacctaatatcggtacttacgtacggtaccagacaagaacgccgacggccacgggccccttggttggtttgtttagttataaagtaaagacgtaggtagaggaccggtcccgtagacgggtactcccggtagacggtacgtacttccgttcgtcggtcctaccgacggtcctaacggacgggaacctaaacgtacgtaccgtaacggttaccgaaccgtacgtacgtacgggtacgggtacgtacccgtaacggacgaaagggtaacggaaccgggaacgggtactaccgtaacgttacgttaaccgttagtaaccaagttccgaacgtaccgaaggtaccggaacgggtcgggttaacgggtacgttaaaggttaacgggtacgggttaccgggacgggaacgggtaaccgtacggacgttacggtacccggtaacggttacggaccgtaccggacccgtaacggcccgtacccggtacccccgg

SEQ ID NO: 85035 - DNA, 794 bp, Homo sapiens
  misc_feature: GYAE6OF01CDPTJ.4.34.D01.1.454.CMB.1.raw
  modified_base (180)..(180): a, c, t, g, unknown or other
  misc_feature (180)..(180): n is a, c, g, or t
  modified_base (236)..(236): a, c, t, g, unknown or other
  misc_feature (236)..(236): n is a, c, g, or t
  modified_base (266)..(266): a, c, t, g, unknown or other
  misc_feature (266)..(266): n is a, c, g, or t
  modified_base (344)..(344): a, c, t, g, unknown or other
  misc_feature (344)..(344): n is a, c, g, or t
  modified_base (354)..(354): a, c, t, g, unknown or other
  misc_feature (354)..(354): n is a, c, g, or t
  modified_base (456)..(456): a, c, t, g, unknown or other
  misc_feature (456)..(456): n is a, c, g, or t
tcagagcactgtagcacgaccggtgctcgatttagatcgtctgtgttgggtttgggggtgggtccaggaggcagaactctgggtgtctcaccatggcctggatccctctacttctccccctctcactctctgcacaggctctgacgcctctatgagctgacacacgccctacccgtggtntacagttcgcccgaggaccaggaccggccaggtactccgacctggcttgtgggaanctgcctagttcggaccaagaacctaaattntcggtacctttacgtcggtaaccgagacgaagaacgccgtaacggccgacggtcccgttgttgtttgttagtattaanaaagcgtagngaggacgccctaggacggtactccgagacgtcgttacgtctcgtcggacctcgacgtccgtacggacggaacaacgtacgtacgtacgttacgaccgttaancggtaacgggttcggacgtacccgaggacgaaaggaacggttaccgggagtaccgttaacgtacggtttaactacgttaacggttaacctaaggtacccgaaggaaccggtttaacgggtaaaccccggttaggggtaccggggttttaaacgggtaaaccgtttttaaaaggggaacgggtttaaccggggttaccggggtaacccggggaaaccggggtttaacccaaaacggggttcccgttaacccggggtaacccgttaaccgggtaaccgggttaacgaaccccgggtacccggtaaacgggtccccgtaaaccccgggtttaccccccggg

SEQ ID NO: 85036 - DNA, 871 bp, Homo sapiens
  misc_feature: GYAE6OF01D3FUL.4.34.D01.1.454.CMB.1.raw
  modified_base (86)..(86): a, c, t, g, unknown or other
  misc_feature (86)..(86): n is a, c, g, or t
tcagagcactgtagcacgaccggtgctcgatttagatcgtctgtgttggggtttgggggtgggtccaggaggcagaactctgggtntctcaccatggcctggatccctctacttcctcccctctcactctctgcacaggtctcgtggacggtccttctaagtggacgtctacgaacacgacgccccgtacccgttcgggtcgtactacggttccgtacccgaaggaacacggaccggccgaaggtactccgtacctggaccgttacgagggaactatcgactacgttacgaccaacgtaaacctaagttcgtcgtaccttacgtacggtaaccacggacgaaacggaaccggaccgacggaccggacccggttccgtttaggtttaggttttaggtttaagtttaaaacgtaaacgtaaacggacgttaacggtacgggtaacggaccggttacccgtaagggtaaccggtacctccggtacgacggttacgttacgtttccgtacggtcgtaacccgttccgtacggtaccgtaacggacgtaaacctaaggtacgttacgtacgtacgtacgtacgtacggtacgggacgtacgggtaccaaggaacggaacggaacggtacgtacgggtacctacggtttaaccgttaacgtttcgtaaccggtaatacgaacggtaaccgtacggaacgggtaaccggtacggggttaacgttaaacggggttacttaaagggtaaacgggtccggggttaaccggaaccgggtaacggaaccggttaggtacccggttaccggttaaccccgggtagaaccgggtaccgtaacccggggtaacccgcgttaacccccgggtcccgttaaccccggg

SEQ ID NO: 85037 - DNA, 689 bp, Homo sapiens
  misc_feature: GYAE6OF01DCVD6.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttcctccccctcctcactctctgcacaggctctgaggcctcctatgagctgacacacgccaccctcggtgtcagtcgtccccaggacagacggccaggactcacctgctctggagatgcattcgaccagaccaatagtgtccttaacgtaggtaccagacaagaacgccgacggaccgacgtccccgtgttgttagtttagtaataataaagacgaggtgagacggccctagacggactcccgtgaacgtcgtattcgtcgtcggtcctaccgacgtcctacgacgggaacaacgtacgtacctaacgttcgaacctagtcgaagtggaacgtacgaaggacgaaaggtaacggacggacgtctaacggtaactttaacgttacgtacgttaacgtaacgtacgtaacgacgtaaacgacgtaagggtaccgggtaacggtaacttaaaggtaaaacgggtacgggttaaccgggacggggtaacggaaaccgtaagtaccggttaaccggtaaccggttcccgtaacgggtacaaacccgggtacccaaaccgggtccctccccgggtaccccccgg

SEQ ID NO: 85038 - DNA, 689 bp, Homo sapiens
  misc_feature: GYAE6OF01BCFCN.4.34.D01.1.454.CMB.1.raw
  modified_base (225)..(225): a, c, t, g, unknown or other
  misc_feature (225)..(225): n is a, c, g, or t
  modified_base (405)..(405): a, c, t, g, unknown or other
  misc_feature (405)..(405): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacacgccaccctcggtgtcagtcgtcccaggacaaacggccaggactcacctactcgtgganatgctattcgccataccagcaagaacgtcacgaccacggtccccttgttccgtggtcattcgtggtggaacgaccaaccgaaaccggtccccgtaccggggacttcccgtaggacgagtactttcgtcgtcggtcctaccgagtcctacgacggacaagtcggaccctacttgacttacncgagggtcgggaccgtagggtaggaggtactacggaaccttagaaccttacttagtttacgttaactacaaacgagacagtcgagtactactaagtcgtagggttcgggtcgtacgggacggaggtatacgacgtcgtaccggtaccgttccgtacggtaccgaccggtacccggaacgggttcccgtaccccgggtccccccggttagggtaccccttaccccggttccgtttaccccccggtttacccccctaccccgtttccccgttacccgttaacccgg

SEQ ID NO: 85039 - DNA, 898 bp, Homo sapiens
  misc_feature: GYAE6OF01ET6CF.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctactgaggcctcctatgagctgacacagcccaccctcggtgtccaggttcgtccccaggacacggaccggccagggtactccgaacccttgccgttccgtagggagtatcggcctaagttcgacccgtaacggaaccctaaattagttcggtaccttttaccggttacggggttaaaccccaagggtaccgtaaacgggtaaaccggtaccccgaaacggggtcccccgtaaaccggggtccccccccgttttagggtttcggtttttacggggttttacggttttaaaagttaaacggtttaaaaaccggaaaccggttaaggttacgggtaaacgggtaccgggtacccccgtttacgggaacggggttaaccgttcccccggtaagggtaccggtacggttaaccttttcccgtacggttacgggtccctttacccgaacggtcccgtacgaaacggggttaaccaacggtacgtaccgtaccgttacggaacctacgttacgacgggtacggtaacgttcccgaacgggaccgaagggttaaaccggacggtacggtaccgtacgtaaccgtatttaccgacgttaacaaggttccgaaggtacaacgggtaaccgtgggtacgggtaggttaaaccttaaggtaaaacggtcggttacccggggaggggtaaccgggtaacctaagggttcgtacccgacccggtacgtaacggtccaccgtacccgaacggtcccgacccggtaccccccgg

SEQ ID NO: 85040 - DNA, 786 bp, Homo sapiens
  misc_feature: GYAE6OF01CICPF.4.34.D01.1.454.CMB.1.raw
  modified_base (179)..(179): a, c, t, g, unknown or other
  misc_feature (179)..(179): n is a, c, g, or t
  modified_base (229)..(229): a, c, t, g, unknown or other
  misc_feature (229)..(229): n is a, c, g, or t
  modified_base (504)..(504): a, c, t, g, unknown or other
  misc_feature (504)..(504): n is a, c, g, or t
tcagagcactgtagcacgaccggtgctcgatttagatcgtctgtgttgggtttgggggtgggtccaggaggcagaactctgggtgtctcaccatggcctggatccctctacttctcccctctcactctctgcacaggctctgacggcctctatgagctgacacacgccacccgttggtntcagtcgtccccaagggaccagacggccaggatccacctgcctgtggaantgctagttcgccaagtaccaattatgcttacgtcggaaccagcaagaacgccgaaggcccacggtcccctggttagtttgtttaggttaataagttaaaacggacgtaggtagaacggacggcccttgaacgggtactcccgtagaacgtcggtaactttcgtcttcggcttaccgacgctaacgaacgggaacaaacgacggtaacctacgggttacaccctagtactaagggttcgtaacggtccaagggacaaaggtaacgacggtaacggngttaacgtacgttaagttaccgttagtaaccgaacgttaccggaacgacggtaaaccggacgttacggggacggggttttaaaccgggtaactttaaaaggggttaaaacccgggtaagggtttacccggggggaaccggggtaaaccggggttaaaaccccgaagggttaaccccgggttaacgggttaaccccccggttaacggtttaacccggggtacccgtaaaaccggacccccgggttaaaggtcccccggttccccgggtttaaccccccccggg

SEQ ID NO: 85041 - DNA, 703 bp, Homo sapiens
  misc_feature: GYAE6OF01D3GG1.4.34.D01.1.454.CMB.1.raw
  modified_base (229)..(229): a, c, t, g, unknown or other
  misc_feature (229)..(229): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacacgcccaccctcggtgtcgagtcgtccccgaggacagacggcaggactcacctgctcgtagganatcgactagtcgaccaacgaacctaatatcgtacttacgtacggtaccagacaaggaacgccgacggccgacggtcccttggttgtttgttagttaataacgtaagacgtagtacgacgacgtcctacgaggtacctcgtgacgtcgtacttcgtcgtacgcctaccgacgtcacggaacgaactaacgtcgtacgtacgttacgaactagtacgtacggtaggacgtacgaacggacgaaggaacgacgggacgtacgtacgtaacttagttacgtagtaaccatacgacgacgaacgaacggtacggtacgggttacgtaacgttaaaggtaaacgggtacgggtaaccggggagggtaaaccggaaccggtaagggtaccggttaccggtaaccccggtaccgggttaacgggtaacccggaacccggtacccggtaaaccgggtccccgttaaccccggtaccccccggg

SEQ ID NO: 85042 - DNA, 869 bp, Homo sapiens
  misc_feature: GYAE6OF01CXGP1.4.34.D01.1.454.CMB.1.raw
  modified_base (502)..(502): a, c, t, g, unknown or other
  misc_feature (502)..(502): n is a, c, g, or t
tcagagcactgtagcacgaccggtgctcgatttagatcgtctgtgttggggtttgggggtgggtccaggaggcagaactcgtgggtgtctcaccatggcctggatccctctacttcctcccctctcactctctgcacgaggctctggacgtcctcctatgagctagacacgacgcccaccgtggtgtcgacgtccgaccccgaaggaccgacggaccggccgaaggactaccgtaccgtggcccgttaggagggaactagttcgaccgtagttaccggaccaaacggtaacctaaagtttacttcggttaccgtttaacggtaccgggtaacccaaggaaccgtaacggaaaccggcccggtaaccggtaccccggtaacccgggttcccgtttagggtttacggttttaggtttaaccgttaaagttaaacgtaaaacggacggtaagggttaacggtaacggaccggtaccccgtacgggtaacggaccgtttacccggnggtaaccgtcgttaaccgttcgttaccggtcgtaaccctcggtaaccgtcgtaacgggaacggaaacctaacgtaccgttacgtacggttaacacgtacgtcggaacgtcgtaacgacggaaggtacgaaaggagaccggtagcgtaaacggtacttagttactaggtaacctaagtacggacgaccggtaacggtaacgggtacgggtacggttaaacggttaacgtaaagggtttaaaccggggtacggttaccggggaaacggggaaccggtaacggttaaccggccgggttaaccggtaccgtaccgtaacggggtacccaaccgggtacccgaaccgttcccgggtaccccgttaccccggg

SEQ ID NO: 85043 - DNA, 846 bp, Homo sapiens
  misc_feature: GYAE6OF01B0SYJ.4.34.D01.1.454.CMB.1.raw
  modified_base (84)..(84): a, c, t, g, unknown or other
  misc_feature (84)..(84): n is a, c, g, or t
  modified_base (748)..(748): a, c, t, g, unknown or other
  misc_feature (748)..(748): n is a, c, g, or t
tcagagcactgtagcacgaccggtgctcgatttagatcgtctgtgttgggtttggggtgggtccaggaggcagaactctgggtntctcaccatggcctggatccctctacttctccccttctcactctctgcacaggctctggacgcctcctatgacgctgacacacgcctaccgtggtctcgacggtccgtacccgaaggacacggaccggtaccgacggtaactaccgtacccgtggtactttcggtagggaacgtcgttcggcttaacgttccgaccgtaacgtaccaaagttcgtcgtacttacgtacgtacagactaacggacgaccgaggccgacgtcccgttgttagtttgttacgtaactaacgaacgacgtagagacggaccgtaccgtaggtacggtacctcgtagacgtacgttacgttacgtcgtaccggtcgttaccgaggttcctaacgggacgtaacgactacggtaccgtacggtactaaccgcgttaacggtacgtacgggttaccgacggttaaacgggaacgttaaacgggaaccgtacgggtaccgggtaacttaacccggtaagtttaccgttaaacgggtcttaaacccgtaagtttccggaaaccgtacggtaaacccggtacggtacggggttacccgggtaaaggtttaacccgtttaaaagggtaaccgggttacgggttaaccgggggaaccgttaaaccgggtacggttaaaccccgggnggtttaaccccgggaccgggtttaacccggtacgggaaaccccgttacccgggtaaacccgggtaaccggttccccggttccccgggtttaaccccgg

SEQ ID NO: 85044 - DNA, 732 bp, Homo sapiens
  misc_feature: GYAE6OF01BSVV1.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgagcctcctatgagctgacacacgccaccctcggtgtcagtcgtccccaggacaggaccggccaggactcaccctgctctggagatgcattcgccagaccaatactgtcttacgtcggtaccagcgaagaacgccgaggcccgacggtcccccttgttgtttagtttgtttaataacgtaaagacaggtacgaggacgcctacgacgggtactccgtaggacgtcgtacttacgtcgtacggtaccctccgtacgtccgtaccggaacgggaaccaaacgtacgttaccgtacggtttacaaccctaagtaccgaagggtcggacgtacccgaggtacgaaggtaacggacgacggtacgtacgtaacttacgttaacgtacgtactaacgttaccgaacgaacgtaccgtaacggacggttacgggtaacggtaaccgtttaaaggtaaacggtaacggggttacgggaacccggggtaacgggaacccgtaacggccgttacccgggtacccgttaacccgggttaaccggtacggtaaccccgggtaacccggtaaccggggtcccgttcccccggtacccccggg

SEQ ID NO: 85045 - DNA, 593 bp, Homo sapiens
  misc_feature: GYAE6OF01C03Q9.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgctattcgccaagaccaatatgcttactggtaccagcaagaagccaggccaggcccctgtgttgttgttatataaagacaggtgagaggccctcagggactcccgtgacgcgtaacttctcgtggcttcagtctcgagggacaaacgagtacacgttcgaacctagtcaggtggagtaccaggacaagaagacgaggctagacttatatgtacaattcagcagacagggtcggtagggtacttaagtaaaagtacggttacgggcgggtaacgggaacgtaaacggtcggtaacggtaacccggttacccgttaaggggtccgtaaacggtaccccgtaaacggggcccgtccgggtaccccccccgg

SEQ ID NO: 85046 - DNA, 695 bp, Homo sapiens
  misc_feature: GYAE6OF01CXPRU.4.34.D01.1.454.CMB.1.raw
  modified_base (374)..(374): a, c, t, g, unknown or other
  misc_feature (374)..(374): n is a, c, g, or t
tcagagcactgtagcacgaccggtgctcgatttagatcgtctgtgttgggtttgggggtgggtccaggaggcagaactctgggtgtctcaccatggcctggatccctctacttcctccccctcctcactctctgcacagctctgacgcctctatgagctgacacacgccacccgtggtgtacagtgtacaaccgaaggaaaacgaccggccaggactccaccgtgcttgaggagactgcattcgaccaagaacctaatatcgactttacgtcggtaaccaagcgaagaacgccgaacggccacggtccccgttgttggtttagttacgttaataacgtaaagacgagtagagcgcctagacggactccgagacncgtatcgtcgtcgcactgcgtacgaacgggaccaaagtacgtacgtacggttacgaaccgtacgtacacgggtgtacgtacccgaggacgtaaggaaggaacgtaggccgtagtaacgtttaacttaacgtagtaaccgtaacgtacgaacgacgaacggtaacggaacgggtacgggtaaggttaaccgttaaaagtaaacggggtaccggtttaccggggaaagggtaaaccgggaaccgaaagggtaccgttacgaacccggtaccggtaacggtaccgaacggtacccgaacggttcccgcccggttaccccccggg

SEQ ID NO: 85047 - DNA, 183 bp, Homo sapiens
  misc_feature: GYAE6OF01DOCTI.4.34.D01.1.454.CMB.1.raw
  modified_base (127)..(127): a, c, t, g, unknown or other
  misc_feature (127)..(127): n is a, c, g, or t
  modified_base (171)..(183): a, c, t, g, unknown or other
  misc_feature (171)..(183): n is a, c, g, or t
tcagagcactgtagcacgaccggtgctcgatttagatcgtctgtgttgggtttgggattcggcggagggaccaaactgaccgtcctaagtcagcccaaggctgccccctggtcactctcgttccccnccctcctcctacagtgctctgagcgggctggcaaggcgcatagnnnnnnnnnnnnn

SEQ ID NO: 85048 - DNA, 633 bp, Homo sapiens
  misc_feature: GYAE6OF01EYNN5.4.34.D01.1.454.CMB.1.raw
  modified_base (302)..(302): a, c, t, g, unknown or other
  misc_feature (302)..(302): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggcccacggcccccttgtcgtttggtttagtttaanttaaagtaaacgaacgtaggtagagacgggtccctcggagggactccgtgacgcgtattcctcgtggtcctccgacgctacgacggtaacaacgtacgtacctacgttaccgaactacgtcgtaggtaggacgtacgaagacgaaggaacgacggacgtacgtacgtaacttaacttaacgtcgtaactaactaacgacgacgaacgtaacgacggtacggggtacggtacgttaaagtaaacggtacggttaccgggacgggtaccggtaacgaacggtcgtacggaccgttaccgtacggtcgaccgacccggtaacgtcgtaccccgg

SEQ ID NO: 85049 - DNA, 728 bp, Homo sapiens
  misc_feature: GYAE6OF01C1OKK.4.34.D01.1.454.CMB.1.raw
  modified_base (185)..(185): a, c, t, g, unknown or other
  misc_feature (185)..(185): n is a, c, g, or t
  modified_base (343)..(343): a, c, t, g, unknown or other
  misc_feature (343)..(343): n is a, c, g, or t
  modified_base (585)..(585): a, c, t, g, unknown or other
  misc_feature (585)..(585): n is a, c, g, or t
tcagagcactgtagcacgaccggtgctcgatttagatcgtctgtgttgggtttgggggtgggtccaggaggcagaactctgggtgtctcacatggcctggatccctctacttcctcccctctcactctctgcacgaggctcgtggacggtcctcctatgacgctagacacacgcccaccgtggtntcagttccgtacccgaggacacggacggccgtaggactccactgctcgtggacatcgctagttcgacgaactactaatgtcgtactttacgacggtacacgacgaacggacgaccgtacggccgtaccggtccgttggtttacgtttgtttaagttanaaagttaaacgcgtaggtacggacgaccggtccgtacggacggtaccgttccgaggcgttacgtcttcgtcggtacggtctacgacgtcctacgggaacgacctaacgtacgttacctacggtaccgtacgacgttacggacgggtaggtacgaacggacggaacgaaggaacgacgggtacgtactaacggttaacttacgttacgtacgtaacttacgaacgagtaacgacggttaacgnggggtaacgttacgggttaactaaacgggtaagggtacgggtaccggggacgtaaacgggtaccgagtcggttaacccgggtccggtaacgtacgggtacccggaacgtacccggtaacggttcccgtaaccccgttcccggg

SEQ ID NO: 85050 - DNA, 830 bp, Homo sapiens
  misc_feature: GYAE6OF01D1X0G.4.34.D01.1.454.CMB.1.raw
  modified_base (516)..(516): a, c, t, g, unknown or other
  misc_feature (516)..(516): n is a, c, g, or t
tcagagcactgtagcacgaccggtgctcgatttagatcgtctgtgttggggtttgggggtggtccaggaggcagaactcgtgggtgtctcaccagtggcctggactccctctacctttcctcccccctctcacttctctgcacgaggtccttcgtggacggcccttccttaagtggacgtctacgaaccaccgaccgcccctacccggttgggttctccgtacggttcccgtaccccgaagggaccgacgggacccggtaccgacggtacctcccgtaccgttcgccgtttacggagggactaacgtcggacttacgttccggaaccaaacgtaacctaagttcgttcgtaccgtttacgtaccggaaccagaccgaacggaaccgccggaccggacccgtaccggttccgtttgtttcggtttagtttaacgttaaataagtaacgagtacggtacggaacggtccgtaccgtaggacggtaccttcgagtcgtacttctcgtcgcgtctacggntaccgtacggaacgtaccgtaacgtaccgtacgtactaaccaacgtacgttcggaaggtaccggtaacgtccggaaagggtaacaacgggaacgggtacggtacgtacgttaaccgtttaacgttaattaccgtaacggtaactacggtaacgtaaggaccggtaacgggtggtaaccgggttagggtaaaccgttagtttaacgggaagggtccggggacgggaacggtaacggtaacctacgggtactacccggttacccgtagggacctacccggaccggtaacccgtccgtcccgtccccggttacccgg

SEQ ID NO: 85051 - DNA, 659 bp, Homo sapiens
  misc_feature: GYAE6OF01DTZAH.4.34.D01.1.454.CMB.1.raw
  modified_base (228)..(228): a, c, t, g, unknown or other
  misc_feature (228)..(228): n is a, c, g, or t
  modified_base (251)..(251): a, c, t, g, unknown or other
  misc_feature (251)..(251): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgagcctctatgagctgacacagcccacccgtcggtgtcagtcgtccccaggacaggacggccaggatccaccgtgctcgtgggantgctattcgccagaaccaagttntcgtacttacgtacggtaccagcaagaacgccgacggccgacggtccccttaggttcgtttgttagttaataagtaaacggatggtagacgacgcccgtagacgggactccaggacgcgtattcgtacgtcgtctaccacggtctacgaggtaacacgtacgtctaacgtcgaacctgacgtaggtgacgtcgaaggactaagaacgagagtctacgtacgttacttagtacgtacgtaactcgaacgtacgaacggtacgtagggcggttacggtaacttaaacgtaacgggttacgggtaccgggaaggggtaacgggtaaacccgaaggttcccggtaaccgggttacccgtacccggttaggaccctaacggcccgtttaaacgcccggtttacccgtcccggg

SEQ ID NO: 85052 - DNA, 897 bp, Homo sapiens
  misc_feature: GYAE6OF01AY2DC.4.34.D01.1.454.CMB.1.raw
tcagagcactgtagcacgaccggtgctcgattttagatcgtctgtggttgggtttggggggtgggtccaggaggcagaacgtctcgggtgtcctcgacctatggtccttggattccctctacttcctcccctcctcactctctgacacacggctcgtggtacggccttctagtcgagtctttcgacacgtacgtacccttaacccgtcggtcgtcgtaggttccgtaccccgaggaccgtacggtaccggtccgaagggtacctccggtacccgttcggtccgttaccggtacgggtacggtacggttccgtacgtacgttccgaccgtaacggtaaccgtaaacgttacgtccggttaccctttacggtacggtaaccctacggtacgtaacggaaccgtacccggacgggtccccgtaccggtccccgttagggttcggtttacggtttacggttaaacgttaaccggtaaacggacggttacgggtacgggaaccgggtaccgggttacccgtagggtaacgggtccgttcccggtaaggtaacggttcgttaacgtttccggttacggtcggtacctaccgtacggtaccgtacgtacgggaccttaacggtacgttaccgtacgggttacgaccgttacgaccgtacgggtaacggttccgaaccggaaggtaacgaaacggaacggtaccgaaggttaccctgttaaccgttacgtttcgtacgttaactaacgtaacgtagtacgaaccgtcgggtaggtaaccggggtacgtaagtaacggtacggtacgggtaccgggtaagaacgggtttaccggacgtacccggtacggttaaccgttaggaccggtccgtaccgtaacccggtcggtcccgtacccgggtcccgg

SEQ ID NO: 85053 - DNA, 656 bp, Homo sapiens
  misc_feature: GYAE6OF01DKGPS.4.34.D01.1.454.CMB.1.raw
  modified_base (616)..(618): a, c, t, g, unknown or other
  misc_feature (616)..(618): n is a, c, g, or t
  modified_base (620)..(656): a, c, t, g, unknown or other
  misc_feature (620)..(656): n is a, c, g, or t
tcagagcactgtagcacgaccggtgctcgatttagatcgtctgtgttgggtttggggacagcagacctgagagcgctgggccccacagccctccccctcagacgcccctgctcgtcctccctccggtcacgccctggaccactccccacggtttccccaggccctggccggtaggtgaagaagtggagtcctgttcgtcacgttgtaggtacttacgatttattttggacttaggttaaagtacttaactactaccgtccggtatgggacgttcggtcggggaccaaacgggaccctaccggtcctaccgttccttcccgtaccgaccgtcccctacccgaacccgaaacggggtcccctaacggttcccggttccccgttccccccgtcggaccccctacccccgttcccctaaccgaacgtaaccgccctaaccggtcggccgggggaccaaccggaccggtccccgggtcccgcggggtccgtacgtacccggtggggtaacccctaaacgggttacccctttaacccgttaccccgtacggtagtcccgtaccgttcgacggggtaccggtccgggtcgtacgggacgaaccgggtccgtaccgaatgccgnnnannnnnnnnnnnnnnnnnnnnnnnnnnnnnnnnnnnnn

SEQ ID NO: 85054 - DNA, 816 bp, Homo sapiens
  misc_feature: GYAE6OF01EHZYJ.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgacgcctctatgagctgacacacgcccacccgtcggtcgtctacggtccgtaccccgaggaccgacggaccggaccaggactccacctgctcgtaggatagtcgactacgttacggaccaagtaaccaaattgtcgtacctttacgtacggtaccacgacgaacggacgaccgacggacccgaccggttccccgttggttcgttttacggtttagtttaaagttaaacgtaaaacgtaccgtaggtaacggacgggtacccggtaccccgtacggtaacggggtaacctccccggtaggacgtacgttacctttcgtcgtcggtacctaccgacgtacgtacggaacggaaccctaacggtaccggttacgtacgttacgaaccgttcgtacggaggttacgggtaactacggtaacggacgaaggaacggacggtacggtaccgttacggtaaacctttaacgtaccggtaactaacgtaccgtaacgaaccggacgaacggaaccggtaggtacgggttaacggtaacgtttaaaggtaaacgggtcgggttaccggggaacgggtaaccgggaacttaccggtcggtaaccgtacccgggttaacccggtacggtaaacccgacccggttaccggtaacccgggtccccgtccccggtttaccccccggg

SEQ ID NO: 85055 - DNA, 760 bp, Homo sapiens
  misc_feature: GYAE6OF01BXP94.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttcctccccctctcactctctgcacaggctctggacggcctcctatgacgctgaacacacgcccacccgtggtgtcagtccgtaccccgaggacacggaccggccaggactccgacctgccgttgaggagatcgctattacgaccgaacgaacctaattactcgtaccttaacgtcggtaaccagaccgaagaaccgccgaacggcccgaccggtccccgttggttcggtttagttacgttaaagtaaacgtaaacgacgtaggtacggacggtaccgtcccgtaggacggtaccgtccgtaggacgtcgtacttccgtacgtcggacctaccgacgtccgtaacggaacggaccaacgtacgtaccgtacgtacgaacctagtacggaggtacgacgtacggaagtacgaaacggtaaggacggtgtacgttaagtaacttacgtacgtagtaactaacgtacgacgaaccgaggtaacgggtaacggtacgggttaaccggttaaagtaacgggtaaacgggtccggggttaccggggaaccgggtaaacgggtaccaacggggttactaacccgggtacccggttaccgtaacgggtaccccgaacgggtaacccggcggttcccccggtccccggttaccccggg

SEQ ID NO: 85056 - DNA, 721 bp, Homo sapiens
  misc_feature: GYAE6OF01CBC9R.4.34.D01.1.454.CMB.1.raw
  modified_base (683)..(683): a, c, t, g, unknown or other
  misc_feature (683)..(683): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacacgcccaccctcggtgtcaggtcgtccccaggaccagacggccaggactcacctgctcgtggagatgctattcgaccagaccaatatgtcttacgtcggtaaccagacgaagaacgccgacggcccgacggtccccgtgttcgtttgttagttaacttaaagtaaagacgtagtaggacggaggtcccctagacgggtacctacccgtaggacgtacgtacttctcgtcggcctaccgaggtcctaacggacggggaaacctaaacggtaccggtaccgtaacggtttacggaaccctacgttacgtacggggtacgggtacggtcccgaaaggacgaaaggaagggaacgaggtaccgtaacgtatttaacgttaactgtaaccaatcgaacggactaacgggtacgtacggggcggttaaccgggttaattaaacggttaaaaggtacggggttaccgggaacggggaaccggggaaaccacgtaccgtacggaacccggttcgtaacgggtaccncccgggtaacccgacggtccccgtcccggtacccccgg

SEQ ID NO: 85057 - DNA, 525 bp, Homo sapiens
  misc_feature: GYAE6OF01EMXUI.4.34.D01.1.454.CMB.1.raw
  modified_base (468)..(468): a, c, t, g, unknown or other
  misc_feature (468)..(468): n is a, c, g, or t
  modified_base (488)..(488): a, c, t, g, unknown or other
  misc_feature (488)..(488): n is a, c, g, or t
  modified_base (500)..(500): a, c, t, g, unknown or other
  misc_feature (500)..(500): n is a, c, g, or t
  modified_base (506)..(525): a, c, t, g, unknown or other
  misc_feature (506)..(525): n is a, c, g, or t
tcagagcactgtagcacgaccggtgctcgatttagatcgtctgtgttggggtttggggacagcagacctgagagcgctgggcccacagcctcccctcagacgccctgctgtcctcctccggtcagccctggacactcccgtacggtttccccaggcctggccggtaggtgtaagaatggaggtctgtgtcacgtggtaggttattaacgtatttagttttgacgttaggttaaagacttttacctaactaccgttccgggtatcgggtaccggttccggtacgggggacccgaaacgggccctaccgggtccaccccgttcctcctacgaccgccctacccaaccgaccggccctacgtccggttcccttccccgcgcccctacccctcccgtaccgagccgccaccgtcggacggggaccacgcggccggccgtggcctcgccgtgtacgaacgtacctacctccancgtcgactgaggacggcggngtcggacgagcngagcgnnnnnnnnnnnnnnnnnnnn

SEQ ID NO: 85058 - DNA, 716 bp, Homo sapiens
  misc_feature: GYAE6OF01CRS6E.4.34.D01.1.454.CMB.1.raw
  modified_base (230)..(230): a, c, t, g, unknown or other
  misc_feature (230)..(230): n is a, c, g, or t
  modified_base (559)..(559): a, c, t, g, unknown or other
  misc_feature (559)..(559): n is a, c, g, or t
tcagagcactgtagcacgaccggtgctcgattttagatcgtctgtgttgggtttgggggtgggtccaggaggcagaactctgggtgtctcaccatggcctggatccctctacttctccccctcctcactctctgcacaggctctgaggcctcctatgagctgacacacgccaccctcggtgtcagttcgtccccaggacagaccggccaggactccacctgctcgtgganatgctattcgaccacgacctaatactgtccttacgtcggtaccacgtacaacggaacgccgacggacccgacggtcccccgttggttcgtttgttttagttaataaagtaaaacgaccgtaaggttaggacggacggtaccccgttacggaaccgggtaccttccccgtaggtaccggtaccgtactttcccgtcgtccggtacccttcccgacgtccgtacggaacgggtaacctaaaccgtacgttaccgtacgtttacgaacctagtaccgagtacggacgtaccgaggacaaggaacgacgagctagactaagttctagactaanctagacgacgtacgagttaccgggtaaggtacttaaaggtaacggtacggttaccggggacgggaacgggtaaccgaacggtacggttacccggaccgttaaccggttacggacccgttaaccggacccgtaacggcccgttcccggtaacccccgg

SEQ ID NO: 85059 - DNA, 814 bp, Homo sapiens
  misc_feature: GYAE6OF01DCKEE.4.34.D01.1.454.CMB.1.raw
  modified_base (138)..(138): a, c, t, g, unknown or other
  misc_feature (138)..(138): n is a, c, g, or t
  modified_base (170)..(170): a, c, t, g, unknown or other
  misc_feature (170)..(170): n is a, c, g, or t
  modified_base (244)..(244): a, c, t, g, unknown or other
  misc_feature (244)..(244): n is a, c, g, or t
tcagagcactgtagcacgaccggtgctcgatttagatcgtctgtgttgggtttgggggtggtccaggaggcagaactcgtgggtgtctcaccatggcctggatccctctaccttcctcccctctcactctctgcacgnggctcgtagacggcctctagtgagctgacacncgccctaccgtcggtcgtacacgtccgtacccgaggacacggaccgtcgaggactcaccgtgcttcgaggagtntcgacgtacgttacggacctaacgaacctaattcgtccgtactttccggacgtaccgagacgaacgaaccgccgacgccgccggtaccgttggttacgtttgttagttaataagttaaagccgtaggtacgaccggtacgaccgtacggaccggtacttaccgagtacggtacgttcttaccggtccgacggtaccctaccgacgtacgtaacgggaccgtaaccgaacgttaggttacccgtacgtttaacgaaccgtttacggacgttaacgggtacgtaacccggttacgggaacgtaaaccggtacgggaacgggtacgtaccgggtaacgttaacccgttatttaaaccccggtttgttaccgaaaccgtaacgggtacctaccgggaaccgtagggtaaccgggtacgggttaacgttaaccggttaaacgttaacggggtaacgggttaccggggtacggaaaccgggtaacgtaacccgtacggggttactaaccccggggtcgttaacccgggttacgcccgggtaccgtaacccggcgtcccccggtccccggttacccg

SEQ ID NO: 85060 - DNA, 814 bp, Homo sapiens
  misc_feature: GYAE6OF01CRP2P.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttcctccccctcctcactctctgcacaggctctggacggcctctagtgcgctgaccacgacgcccctaccccgttgggtacgtcgtacgtccgtaccccccggaagggaccgacgggacccgggaccgaagggtacctcccgtaaccgtcggtccgttcggtagggaacggtacttcggacttacggttccggaccaaacgaccttaaagtgtacgtaccgttacgtacggtaccagtacgaagaccgtccgacggaccgtaccggtcccttggtttacggtttagttacgttaaataaacgtaacggaacgtaggtacggaacggtacccggtacccgttacgggaggtacccgtcccgtaaggccttacgtctttaccggtcggtccgttaccgcccgagtcccgtaacgggaacgaactacggtacgttaccgtacgttacaacgtaggtacgacgggttacgggaccggtaaccgacggtaaagaacgggtaccggaacgggtaggtacctaggtaacttaggtacccgtataccgatcgaacgtacgaagtacggtaggtacgggtaacggttataaaggtaaccgggttcgggcgggtaacgggaaccggtacgtacggtaccgggttaaccgaccgggtttacggacggtaacccgaaccggacccggggtacctcccggtccccgggttaccccg

SEQ ID NO: 85061 - DNA, 741 bp, Homo sapiens
  misc_feature: GYAE6OF01ATPT8.4.34.D01.1.454.CMB.1.raw
  modified_base (99)..(99): a, c, t, g, unknown or other
  misc_feature (99)..(99): n is a, c, g, or t
  modified_base (706)..(741): a, c, t, g, unknown or other
  misc_feature (706)..(741): n is a, c, g, or t
tcagagcactgtagcacgaccggtgctcgatttagatcgtctgtgttgggtttggggacagcagacctgagagcgctcggcccacacgccctccccctnagacgccctgcttcgtcctcccgtccggtcacgccccgtaggacctacttccccgtacggtttcccccgaggtccctcggtccgggtaggttaggtaagtaagtggtaggttccttggtcgtcctaacgttggttaggtttaactttaacgtaagttttagtttttacggaacgtttaagggtttaaaatactttaaccttaccgttaccgttaccggtagtcgggtaccgttcggtacggggacccgaaacgggaccccgtacggtccctacccgttcctcctaccgaccgcccctacccgaacccggaaccggtaccccgtaccggttcccggttccccgtttccccccggtaccggtacccctaccccccgtaccccgtacccgaaacggaccgtacccgtacccggttaccgggtccgggggaaaaaacctccgggtaccgggccccgggtcccggttccggggtccgtccgggtcccggttacgggtaaccggtaaaccggttacccttaaccccttacccgtaaccgtcggttaccgtccgtacggtcgggaccggggtccgggtaccggtacgggaacggaacgggtccgacgtaatagnnnnnnnnnnnnnnnnnnnnnnnnnnnnnnnnnnnn

SEQ ID NO: 85062 - DNA, 771 bp, Homo sapiens
  misc_feature: GYAE6OF01CSGEZ.4.34.D01.1.454.CMB.1.raw
  modified_base (89)..(89): a, c, t, g, unknown or other
  misc_feature (89)..(89): n is a, c, g, or t
  modified_base (143)..(143): a, c, t, g, unknown or other
  misc_feature (143)..(143): n is a, c, g, or t
  modified_base (273)..(273): a, c, t, g, unknown or other
  misc_feature (273)..(273): n is a, c, g, or t
tcagagcactgtagcacgaccggtgctcgatttagatcgtctgtggttggggtttgggggtgggtccagggaggcagaactcgtgggtntctcaccatggcctggactccctctacttcctcccctctcactctctgacacgnggctctggacgcctctatgagctgacacacgccctacccgtcggtctacgacggtccgacccgaggacacggaccggacaggactccaccgtgctcgtaggactatcgactagtcgaccacgtaacaatntcgtacttaacgtcggacagacagaacgaccgtacggacccgtacgggtccgttaggtttcggtttagtttaagttaacgaaaacgttaaacgacggtaggtacggaacggaccggtcccgaaggtacgggtaaccttccggaaggccggttacttacgttccgtacgggcgtacccgtacgaacggtccgtaaacgggaccggtaaaacctaacggtaccttacggtaacgttaccgaacgtacgttacggacggttacggacgaccggaaggaacgaacggaacggacgacggtactacgtaaacgttacttaacggtataacggtaataccgaacggtaacgaacgggtacggtaagggtaccggtaaggttaaacgtaaaggtaacggggtacggtacgggggtaacggaacggtaaaccgacggtaccgtaccgggtaacccgttacgggagtaacccgacggtaccgaacccgggtcccgtcccggtacccg

SEQ ID NO: 85063 - DNA, 675 bp, Homo sapiens
  misc_feature: GYAE6OF01EAEOI.4.34.D01.1.454.CMB.1.raw
  modified_base (245)..(245): a, c, t, g, unknown or other
  misc_feature (245)..(245): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctggtgtcagtcgtccccaggacagaccggccaggactcacctgctctggagatgcattgaccaagaccaatntgcttacgtggtaccagcaagaagccgacggccgacggcccctggtcgtttgttagttataagtaaagacagtgagacgccctgacgggtactccctaggacgtcgtacttcgtacgtcggtcctacacggtcctacggacgggaaccaaacgacgtcgtaaccgttacgaaccagttccgagtaggacgtacgaggtacaaggaacgtacgaggtctacggtacttaacttacgtacgtacaaacgtcaaacggccggaagtaccggaacgggttacggggttaacgggacggttttaaaggaaacggtacgggttaaccggggaaccgggttacgggaaaccctagggtcccggtaaggtaccccggttacccgttacgggtacctaacccgggaccccaaacgggttcccgtcccggtaccccccgg

SEQ ID NO: 85064 - DNA, 646 bp, Homo sapiens
  misc_feature: GYAE6OF01EHJDW.4.34.D01.1.454.CMB.1.raw
  modified_base (440)..(440): a, c, t, g, unknown or other
  misc_feature (440)..(440): n is a, c, g, or t
  modified_base (514)..(514): a, c, t, g, unknown or other
  misc_feature (514)..(514): n is a, c, g, or t
tcagagcactgtagcacgaccggtgctcgatttagatcgtctgtgttgggtttgggggtgggtccaggaggcagaactctgggtgtctcaccatggcctggatccctctacttcctccccctcctcactctctgcacaggctctgaggcctcctatgagctgacacacgcccaccctggtgtcagtcgtccccaggacaggacggccaggactcacctgctcgtggagatgctattcgacctagaaccaatactgtacttactggttaaccagacaaggaagccgaggccacggccccttgttcggtttgtttagttaactaagtaaagacaggtgaagcggccctagacggacttccgaggacgcgtacgttctacggtcgtaccttcgacgtcgtcgaaacggggaaccaaacgacggttctaacggtttcgaacctntaccggtaggtaggaaccggtcgaaggacgaacggaacgacggaacgtcgtacacgttattacgtgtaacactnaacgacaagacacggtcggtagggtaacttaagtaaacggtaggttcgggaacgggacggaaccgtaaggcgtacgggaacccgttcgtaacgggtccaacggacccggtacggccgtacccgtcccccggg

SEQ ID NO: 85065 - DNA, 948 bp, Homo sapiens
  misc_feature: GYAE6OF01A67WC.4.34.D01.1.454.CMB.1.raw
  modified_base (181)..(181): a, c, t, g, unknown or other
  misc_feature (181)..(181): n is a, c, g, or t
tcagagcactgtagcacgaccggtgctcgatttagatcgtctgtgttgggtttggggtgggtccaggaggcagaactctgggtgtctcaccatggcctggatccctctacttcctccccctcctcactctctgcacaggctctgacgcctcctatgagctgacacacgcccacccgtggtntcgagtccgtaccccgaggaccaggaccggccaggactccaccgtgccttgtggagtactcgccgtagttacgcccgaacgaacctaaaagtttgtacggttacctttaaccggtcgtaaaccccgaggaaccgaaggtaaaccgcccgtaacgggtccccccggtaaccgggttcccccttgggtttcgggttttagttttaaccggtttaaataaaaccgtttaaaaacgggaccttaacgggttacgggaaacgggtacccgggtacccccgtttaagggaacccgggggttacccctttacccgggtaggttaaaccggaccggttaccgtttttacccgggttcggttaacccggggtccctttaaccccggaaccggttacccgttaaccggggtaaaaccggggaaacccttaaaccggtaaccggtttacccggttaacggttttaaccggaacccgttaaacggttccgggtaacgggggtttacggaaacccccggtttacggaaacggggttaacccgaaaaggggtaaccgacggggttaacggtagtaccgtaaacggttttacgtacgttaaccggaaaccgttaccagttaaaccgaccgaacgggtccggtaacgggtacgggtttaacggaactttaaggtaaaacgggcgggtaccgggacggaacccgggtaacctaggtacccgtacggtacccgttacgacccggtacgaccctaacccgggtaccgccgtcccgggtaacccccg

SEQ ID NO: 85066 - DNA, 684 bp, Homo sapiens
  misc_feature: GYAE6OF01DVY0E.4.34.D01.1.454.CMB.1.raw
  modified_base (179)..(179): a, c, t, g, unknown or other
  misc_feature (179)..(179): n is a, c, g, or t
tcagagcactgtagcacgaccggtgctcgatttagatcgtctgtgttgggtttgggggtgggtccaggaggcagaactctgggtgtctcaccatggcctggatccctctacttcctccccctctcactctctgcacaggctctgacgcctctatgagctgacacacgccaccctgggtntcagtccgtacccaggacacggacggccaaggactccacctgccttcgaggagtaactgactattcgaccaagaacctaatctgtaccttacgcggtaccagacagaacgccgacggtccgacggtcccttggttgtttagtttagtttaactaaagtaaacggacgtaggtaggaacggtaccgggttaccccagggtaaacgggtcctacccggtaggtaccggtacgttacgttttccgtcggtcggaacccttcgaacgtccgtaacgggaacgggaaccaacggtcggtactaccggttacacgtatacgtagggtacgacggtaacgagaaccaggtaacgagtagctagtactattacgatacatcgaacgacgaagtacgacgggtcggtaagtaagttaagaaggtcgggttacggaacgggacgggtaacgaacggtcgtaccggtaccgtacgtacgaccgaccgacccgtacggtcgtccccggttaccccgg

SEQ ID NO: 85067 - DNA, 862 bp, Homo sapiens
  misc_feature: GYAE6OF01EKH0X.4.34.D01.1.454.CMB.1.raw
  modified_base (183)..(183): a, c, t, g, unknown or other
  misc_feature (183)..(183): n is a, c, g, or t
  modified_base (229)..(229): a, c, t, g, unknown or other
  misc_feature (229)..(229): n is a, c, g, or t
  modified_base (289)..(289): a, c, t, g, unknown or other
  misc_feature (289)..(289): n is a, c, g, or t
tcagagcactgtagcacgaccggtgctcgatttagatcgtctgtgttgggtttgggggtgggtccaggaggcagaactctgggtgtctcaccatggcctggatccctctacttcctccccctcctcactctctgcacaggctctgacggcctcctatgagctgacacacgcccaccctcggtntcagtcgtcccgaggacagcggccaggatccactgctcgtagagangactagttcgaccagaaccaatacgtcgtaccttaacgtcggtaaccagacgaaggaacnccgacggaccgacggtccccttggttgtttagttagttaagtaagtaaaacgacgtaggtaggaacggaccggtaccctaggacggtaacctccgtagacgtacgtacttctcgcgtcctacgagtaccgtagaacgggaacctaacgtacgtaccctaacggttacgaacccgtagtaacggtaacgggttcgggtaaaccggtcccggtaaacgggaaccgtaaagggtaaaccggtaaaccgggtacgggttaccgttaacgggttaaaccgttttaaacgtttaccgggttaaaccttaacggtaaaccgtacggtaacggtaccggaaccggtaacggtaaccggggttaacggggttaacggtttaaaccgtttaaaagggttaaaccgggtaacgggggttcccggggaaaaccggggttaaacggtaaaccccggttaacgggtccggttaaaccccgggttaccccgggttacccggttaaccggggttaaccccgtaaacccggggaaccccccgggtttaaacgggttcccccccggtaacccccgggttaacccccccggg

SEQ ID NO: 85068 - DNA, 669 bp, Homo sapiens
  misc_feature: GYAE6OF01E0D0F.4.34.D01.1.454.CMB.1.raw
  modified_base (231)..(231): a, c, t, g, unknown or other
  misc_feature (231)..(231): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacacgcccacccgtggtgtcagtcgtccccaggacaggaccggccaggactccacctgcctcgtgganatcgctattcgacctagaccaattctgactttacgtcggtacacgtacgagaacgccgaggtcccgacggtccccttggttcggtttagtttacgttaataacgttaaaacggactaagggtaggaacgggtaccgccccgttacggaacgggtacctcccgtggtacgtacgtactttcgtacgtcggtcctacgacgtcgtacggaacggaactaaacgtacgttaccgacgttacgaccactacgtaggtaggacgtacgaagtacgaagtaacggacgtaggtactagtaacgttactagtcgtaacacgtcaacgcgacgacgaggtcggtaaggtacgttaaagaggtacggtacggaacggggtaaccggaactaggtccgtcggtaccgtacgtacggaccgaccgaccgtacggccgtccgtaccccgg

SEQ ID NO: 85069 - DNA, 784 bp, Homo sapiens
  misc_feature: GYAE6OF01EGC07.4.34.D01.1.454.CMB.1.raw
  modified_base (190)..(190): a, c, t, g, unknown or other
  misc_feature (190)..(190): n is a, c, g, or t
  modified_base (592)..(592): a, c, t, g, unknown or other
  misc_feature (592)..(592): n is a, c, g, or t
tcagagcactgtagcacgaccggtgctcgatttagatcgtctgtgttgggtttgggggtgggtccaggaggcagaactctgggtgtctcaccatggcctggatccctctacttcctccccctcctcactctctgcacaggctcgtggacgtcctactagtgagtctagaacacacgccctaccgtcggtntacgtacgtccgacccgaggacgacggaccggacgaaggtactcctaccgttcgaccgttcgtagggatagtacggtactagtccgaacctaacgaacctaagttacgttcgttaacttacggtaccgtaacgacgacgaaaggaccggacgtaccggacccgaccggttccgtttggttcggtttttaggttaacgtttaaagttaaaacgtaaaggaacggtaggtacggaaccggtaccggtacccgtaagggaccggtaccgtaccggtagtacggtaccgttacgtttccgtacgtcggtaccctacggtaccgtaccgtaacgggaaaccggtaaacctaacggaccgtttaaccgtaacgttcgaacccgttagtacggtaagggtcggtaaccncgggaacgaacggaacggaaacgggacgtacggtacttaacgttcgtttaactacggttacaactacggatacgagtaccgagggtacggttacggtaacgttaagtaggtaacggtccgggtagggaacgacggtacaggtacgtaccgacgttacggacgtcgaacccggtagcgtcccgcccgttcccg

SEQ ID NO: 85070 - DNA, 759 bp, Homo sapiens
  misc_feature: GYAE6OF01CS0M3.4.34.D01.1.454.CMB.1.raw
  modified_base (85)..(85): a, c, t, g, unknown or other
  misc_feature (85)..(85): n is a, c, g, or t
  modified_base (179)..(179): a, c, t, g, unknown or other
  misc_feature (179)..(179): n is a, c, g, or t
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (217)..(217): a, c, t, g, unknown or other
  misc_feature (217)..(217): n is a, c, g, or t
  modified_base (238)..(238): a, c, t, g, unknown or other
  misc_feature (238)..(238): n is a, c, g, or t
  modified_base (240)..(240): a, c, t, g, unknown or other
  misc_feature (240)..(240): n is a, c, g, or t
tcagagcactgtagcacgaccggtgctcgatttagatcgtctgtgttgggtttgggggtgggtccaggaggcagaactctgggtntctcaccatggcctggatccctctacttctccccctcctcactctctgcacaggctctgacgcctcctatgagctgacacagcccaccctggtntcagtcgtcccaggacagcgcagntcactgctntggantgctatcgaccagacctaatntntacttacgtacgtacagacagaacgcgacggaccgcggtcccttgttggttagttagttaagtaaagtaaagaacgtaggttacggaacggacggtacccgtagaacggtaaccgtcccgtagaccgtacgtacttacgttccgtacgtacctccgaacggtcctaacggacgggaaaccaacggtacgttaccgaacgtttacgaaccccgtaagtacggtacggtacgggtacgtacccggaacggtacgaaaagggacggtaaccgggacggtacgttaacgtaactttattaaccggtagtaaccaacgtacgaacgtacgaaccgtacggtaacgggtacggttaacgggttaaccttaaagggtaaacggttaacgggtaccggggaaccgggtaaaccgggtaaaccgtaaccggtaccggttaaaccggtaacccgggtacccggttaacggtacccggtaaccccggacccggtaaaccccggttccggccccccgggtttaacccccgg

SEQ ID NO: 85071 - DNA, 694 bp, Homo sapiens
  misc_feature: GYAE6OF01A7FNI.4.34.D01.1.454.CMB.1.raw
  modified_base (227)..(227): a, c, t, g, unknown or other
  misc_feature (227)..(227): n is a, c, g, or t
  modified_base (245)..(245): a, c, t, g, unknown or other
  misc_feature (245)..(245): n is a, c, g, or t
  modified_base (488)..(488): a, c, t, g, unknown or other
  misc_feature (488)..(488): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcctaccctggtgtcagtcgtcccccaggaccagacggccaggactcacctgctctggagntgcattgccagacaatancgcttactggtaccagacaagaacgccaggtcccacggtccccttggtttcgtttaggtttcgtttaataattaaagactagtggacgacggccctacgagtactcccgtgacgcgtattcgtcgtggcctaccgacgtcctacggaacgggaaacaacgtacggtaccgtaacgtttccgaacctgtaccgtaaggtcgggtaaccggtacccaaggggtaccaaagggaaacgggtaacgngggtacctaggttaaacttactttaacgtacggtataacgttcaacgtacggacgacgggacggttcgggttaagggaactttaacggaaaggtacgggttaccggacggggtacggtaaacccggaggttaccggtccggttacccggaacccgttagggtacccaccggaaccccggtaagggttccccacgggttaccccccg

SEQ ID NO: 85072 - DNA, 782 bp, Homo sapiens
  misc_feature: GYAE6OF01BNRC2.4.34.D01.1.454.CMB.1.raw
  modified_base (223)..(223): a, c, t, g, unknown or other
  misc_feature (223)..(223): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacacgccaccctggtgtcagtcgtccccaggacagacggccaggatcactgctcgtgganatgactattcgaccagaccaaatactgtaccttaacgtacggtaccaagacaaggaacgaccgacgggcccaaccgggtcccccgttggtttcggtttaggtttacggtttaagttaaagtaaaacggtaacgaaggttaggaacggtacgggtcccttacggagggtaccttcccgtaggacgtcgtacttccgtcgtcggtcctaccgacgtcgtacggaaacgggtaaacctaaacggtacgttaccgtaacggtttacgaaccctaacgtaccgtaagggtacgggaccggttacccggaagggtaccgaaagggtaaaccggaacgggtacggtaccgttacggtaaactttaacgttaacgttagttaccaacgttcgaacgtcgaacgtaacggtacggtacgggttaacgggtacttaaacggtaaacggtacggttccggggaacgggtaacgggtaaccgtaaggtacccggtcgggttaaccccgttacggtaaccgggtaccgtaaccggaccccggaacgggtccccgtacccggttaccccccgg

SEQ ID NO: 85073 - DNA, 702 bp, Homo sapiens
  misc_feature: GYAE6OF01ET4BO.4.34.D01.1.454.CMB.1.raw
  modified_base (84)..(84): a, c, t, g, unknown or other
  misc_feature (84)..(84): n is a, c, g, or t
  modified_base (202)..(202): a, c, t, g, unknown or other
  misc_feature (202)..(202): n is a, c, g, or t
  modified_base (303)..(303): a, c, t, g, unknown or other
  misc_feature (303)..(303): n is a, c, g, or t
tcagagcactgtagcacgaccggtgctcgatttagatcgtctgtgttgtgtttgggggtggtccaggaggcagaactctgggtntctcaccatggcctggatccctctacttcctccccctctcactctctgcacaggctctggagcctcctagtgacgctgacacacgccctaccgtggtgtcagtccgtacccgaggacnggacggccgaagctccaccgtgctcgtaggaagtacgtcgtactacgttcgacctaacgaacctaaagttacgtcgtacctttacggtacggtaaccaganaacggaccgaccgaacggcctaccgggtcccgtttagtggtttaggttataaataacgtaaagcgttaggagaacggacggtcctaacggaacggcttcggagacgaccgttatcgctcggtacacggagtacgtaacggagaacctaaggtctactcgtacgactagacgtggtacgtacgtccgaaggacgagaacggcgagacgttatacgttatactagacatacaacgtagaacgtacggtacggtaaggttagtaacgttaagggaaacgggttcgggtaacggaaacccggggttagggaacccgttaaccggtcgggtaacccgttaaccggtaaccgtacgggttaaccccgacccgggttaaccccggtaaggttcccgtaaccccggg

SEQ ID NO: 85074 - DNA, 768 bp, Homo sapiens
  misc_feature: GYAE6OF01ALQY1.4.34.D01.1.454.CMB.1.raw
  modified_base (249)..(249): a, c, t, g, unknown or other
  misc_feature (249)..(249): n is a, c, g, or t
tcagagcactgtagcacgaccggtgctcgatttagatcgtctgtgttggggtttgggggtgggtccaggaggcagaactctgggtgtctcaccatggcctggatccctctacttcctccccctcctcactctctgcacaggctctgacggcctctagtgacgctagacacacgccctacccgtcggtgtcaggtccgtaccccgaggaccacggaccggccaaggtactccaccgtggctcgtaggganatcgactattcgacctacgaacctaattactcgtaccgtttacgtacggtaccagacgaacgaccgaccgacggcccgtacggtccccttaggtttggtttgtttagttaacgtaaacgtaaacggacgtaaggtacggtaacggaccggtcccgtacggtacggtacctccggtaggtacgtaccgtacgtttccgtcggttcgcctacgacgcgtaacggaacggtacctaacggtacgtaccgacgttaaccgtactacgtggtacggtacgtcgtacccggaaggtacgtaaagggaacgaacgggtcgtaacgtacgttaacttaagtccttaaggtaacctaacgtacgaacggtaccgaacgggtacggtacgggtaccggttaaggttaacgttaacgggtaaacgggccgggttaacgggaaccgggtaaccgggtaaacgtcgtacgggtaccgtccggttaccggtacgaccggtacccgaacggtcggtccccgttaccggtccccg

SEQ ID NO: 85075 - DNA, 677 bp, Homo sapiens
  misc_feature: GYAE6OF01DY8KG.4.34.D01.1.454.CMB.1.raw
  modified_base (163)..(163): a, c, t, g, unknown or other
  misc_feature (163)..(163): n is a, c, g, or t
  modified_base (500)..(500): a, c, t, g, unknown or other
  misc_feature (500)..(500): n is a, c, g, or t
tcagagcactgtagcacgaccggtgctcgatttagatcgtctgtgttgggtttgggggtgggtccaggaggcagaactctgggtgtctcaccatggcctggatccctctacttcctccccctcctcacttctctgcacgaggctcgtggacggcctctatganctgacactcgccctacccgtggtcgtactacgtcgtaccccgaagggacacgaccgacgagtactcctactcgtctacgtggatatcgctatcgaaccagtacctaatctcgtacttacgtacgtacacggacgaacggacgtaccgacggccggtaccggtccgttggttgtttggtatttaacaaagtaacgagaggtcgagtccgaccgtacggacggtacctcgtggacgtcgttacttcgtcgtcgccctcgtgacctcggaacgtaccaaggtacgtactacggttacactacgtggtaacggtggaccgtaacgcgaagaacggaaccgnggtacgtacgttacgtacttaaccgttatagtacctacgagtaccggcgtaacgggtggaacgggttggggttaacctaaggtttaacgggacgtaaccgggtcgggacgaaccgggctaggaccgttcggacccgttggccttaggaccctacgggctcccgccccgttaacccgg

SEQ ID NO: 85076 - DNA, 756 bp, Homo sapiens
  misc_feature: GYAE6OF01CJ46K.4.34.D01.1.454.CMB.1.raw
tcagagcactgtagcacgaccggtgctcgatttagatcgtctgtgttgggtttggggggtgggtccaggaggcagaactctgggtgtctcaccatggcctggatccctctacttctcccctcctcactctctgcacacggctctggacggcctcctatgacgctcgacacacgcccacccgtcggtgtcaggtccgtcccgaggacacggaccggacctaggactccacctcgtcttcggtagggagtacgtgacgtagttccggaccaacggtaacctaaatagttacgttaccgttaacgttacggtaaccgaagacgaaagaaccggaccggacggaccgtaccggtccccgttgtttacggttttagtttaagttaacttaaacgtaaaacgtagtaaggtacggacggtaccgtaccgtaacggacggtactcccggtagacgtacgtacttcctcgtcgtcctcgacgtcgacggtaacgaacgacgtacgtacgtacgttacgaacgtacgtacggacggtacggacgtaccggaacggtacgaaacgggaacgtacggtacgacgttacgtaacgttacgttactacgtaactaacgtacacggacgaacgtacggtaacgggtacggtacgtaacgttaacggtaacgggtacgggtaacgggacgggaacgggtaaccggtaagtacggtccggttacggtaccggtacgacgtaccgaccggtaacggtccgtcccggtacccgg

SEQ ID NO: 85077 - DNA, 835 bp, Homo sapiens
  misc_feature: GYAE6OF01CWJIX.4.34.D01.1.454.CMB.1.raw
  modified_base (109)..(109): a, c, t, g, unknown or other
  misc_feature (109)..(109): n is a, c, g, or t
  modified_base (760)..(760): a, c, t, g, unknown or other
  misc_feature (760)..(760): n is a, c, g, or t
tcagagcactgtagcacgaccggtgctcgatttagatcgtctgtgttggggtttgggggtgggtccaggaggcagaactctgggtgtctcaccatggcctggatccctntacttcctcccccctcctcactctctgcacaggctctgacggcctctatgagtctgacacacgacccacccgttggtgtcacggttccgtacccccgaagggaccacggaccggaccgtaggacctccacccgtgccgttcgtagggagtacgtcggcttaacgttaccgaacccgtaacgaaaccttaaagttacgttacggtacccttttaacggttaccgggtaaccctaaggaccgaaacggaaccggaccgaaccgggacccgtacccgggtccccgttgggtttcggtttaggtttacgttaataaacgtaaacgaaccggtaggtacggaacggtacccggtacccgtagggtaacggtacccttcccggaggtacggtactacgtttcctacggtcggacctaccgtacgtccggtacggaaccgggtaactaaccggtcgtaccgtaacggtttacgaaccgtacgttacggtaacgggttacggtaacccggaccggtaacgggaacgtaaacgggaacggtacgggtacgttacgtagttaccttaagtacgtacgtactacgacgtagactacgggtaggacggttacggaacgttagttaaagggtaacgtcgggtaaccgggagggtaacccggtanaacggttacgtaccgggtaccgttacggttacggacccgtacggccgtaacccggtccctacccgggttaccccg

SEQ ID NO: 85078 - DNA, 1128 bp, Homo sapiens
  misc_feature: GYAE6OF01A1G6N.4.34.D01.1.454.CMB.1.raw
  modified_base (109)..(109): a, c, t, g, unknown or other
  misc_feature (109)..(109): n is a, c, g, or t
tcagagcactgtagcacgaccggtgctcgatttagatcgtctgtgttgggtttgggggtgggtccaggaggcagaactctgggtgtctcaccatggccctggatccctntacttctcccccctctcactctctgcacaggctcgtgacggcctcctatcgagtctagaccacgacgccctacccgtggtcgtacctaggtccgtacccccgaggaccacggaccggacccgaggtaactcccgaaccctttcggccttcggtaggggaacgtacttcgggacctacgttaccggacccaaaacggtaaccccttaaagttacgttacggtacccttttaaccggttacgggtaacccctacggtaccgtaaacggtaaaccggaccccgaaccgggaccccggtaccgggttcccccgttgggttttacggttttacggttttaacgtttaacgttaaaacggttaaacggtaaccgtaagggttaccggaaacgggtacccgggtaacccccggtttaacgggtaaccgggggtaacccctttacccgggtacggtaaccgggttaccgtttaaccgtttcccgttaaccgggtcccgggttacccttaccccggtaacgggtcccgtaaaccggggtaaaccggggtaaaccctaaaccggtacccggttaacccgttaacccgggttaaccgtaaacccttacggtaaccggtaacgggggtaccggtaacccggttaccggaaacgggtaaccggaaagggtaaacccggtaacgggtaccgggttaacgttaaacggtttacccggtttaaagtttaacccggttaacggtaaccgttaaaacgttcccgggaaacgtaaccgtaacgggttaacccgggttaacggggttaccgggggttaacgggttaaaaacccggtttaacgggtaaaacggggtttaccgggggtaacccccggggtaaacgggtaacccgggtaaaccccggttaacggggttaaccccggttaacccggggttaaccccgggtaacccggtttaaccccgggaaccgggttaaacccccggtaaccccgggtaaccccgggttccccgggtaaccccccggtttaaccccccgggg

SEQ ID NO: 85079 - DNA, 859 bp, Homo sapiens
  misc_feature: GYAE6OF01B51QR.4.34.D01.1.454.CMB.1.raw
  modified_base (87)..(87): a, c, t, g, unknown or other
  misc_feature (87)..(87): n is a, c, g, or t
  modified_base (141)..(141): a, c, t, g, unknown or other
  misc_feature (141)..(141): n is a, c, g, or t
  modified_base (666)..(666): a, c, t, g, unknown or other
  misc_feature (666)..(666): n is a, c, g, or t
tcagagcactgtagcacgaccggtgctcgatttagatcgtctgtggttgggtttgggggtgggtccaggaggcagaactctggggtntctcaccatggcctggactccctctacttcctccccctctcactctctgcacgnggctcgtggacggtcctctatgacgtctagacacacgccctacccgtggtctacaggttccgtaccccgaggaactacggaccggccaaggtacctccaccgtcgtcttacggagggatagttccgacgttacgttccggaaccaaacgaaccttaaagtcgttcgtaccgtttaacggttacggaacccgaaggaccgaaacggaccgcccgtaacggccccggtaccggttccgttaggtttcggttttagtttaaggttaataaacgtaaaggtcgtacggtacgggaacggtacccggtacccgacgggtaaccgttcgttacccggtaggtaccgggttacctttacgtttcccggttacggtaaccggtcccttacgaaccgggttcaaccgggttaaacgggaaccttaaccggtacgttacggtaaccgttccgtaacgtaccgtaccggggttagtaccggtaaccgggtacggtaacgggaaccgaaacgggtaacgggtacggtaaccgggttnttaaaccggttcgtttaaacccgtgttaccggaactacgtacgaactagacgggtaaccggaagggttgtaacggttaataagggaccgggtttaggaccgggtacgggaacgttacccgaacggtcccggttaacgggtccgtaacggtcggaccgaaccgtcccggacggttccccgtccccgtaaccggg

SEQ ID NO: 85080 - DNA, 726 bp, Homo sapiens
  misc_feature: GYAE6OF01DF40I.4.34.D01.1.454.CMB.1.raw
  modified_base (378)..(378): a, c, t, g, unknown or other
  misc_feature (378)..(378): n is a, c, g, or t
  modified_base (523)..(523): a, c, t, g, unknown or other
  misc_feature (523)..(523): n is a, c, g, or t
  modified_base (649)..(649): a, c, t, g, unknown or other
  misc_feature (649)..(649): n is a, c, g, or t
  modified_base (655)..(655): a, c, t, g, unknown or other
  misc_feature (655)..(655): n is a, c, g, or t
  modified_base (660)..(661): a, c, t, g, unknown or other
  misc_feature (660)..(661): n is a, c, g, or t
  modified_base (667)..(667): a, c, t, g, unknown or other
  misc_feature (667)..(667): n is a, c, g, or t
  modified_base (672)..(672): a, c, t, g, unknown or other
  misc_feature (672)..(672): n is a, c, g, or t
  modified_base (674)..(674): a, c, t, g, unknown or other
  misc_feature (674)..(674): n is a, c, g, or t
  modified_base (676)..(677): a, c, t, g, unknown or other
  misc_feature (676)..(677): n is a, c, g, or t
  modified_base (681)..(682): a, c, t, g, unknown or other
  misc_feature (681)..(682): n is a, c, g, or t
  modified_base (684)..(684): a, c, t, g, unknown or other
  misc_feature (684)..(684): n is a, c, g, or t
  modified_base (686)..(686): a, c, t, g, unknown or other
  misc_feature (686)..(686): n is a, c, g, or t
  modified_base (688)..(688): a, c, t, g, unknown or other
  misc_feature (688)..(688): n is a, c, g, or t
  modified_base (691)..(691): a, c, t, g, unknown or other
  misc_feature (691)..(691): n is a, c, g, or t
  modified_base (699)..(699): a, c, t, g, unknown or other
  misc_feature (699)..(699): n is a, c, g, or t
  modified_base (705)..(708): a, c, t, g, unknown or other
  misc_feature (705)..(708): n is a, c, g, or t
  modified_base (711)..(720): a, c, t, g, unknown or other
  misc_feature (711)..(720): n is a, c, g, or t
  modified_base (723)..(723): a, c, t, g, unknown or other
  misc_feature (723)..(723): n is a, c, g, or t
tcagagcactgtagcacgaccggtgctcgatttagatcgtctgtgttggggtttggggacagcagacctgagagcgctcgggcccacacgccctccctcagacgccctgctcgtcctcccgtcggtcacgtcctggacctactcccgtacggtttcccaggtccctgggccgggttaggtagtaacggaagtggtcggttcttaggttgtcctaggttggttacggttaactttaacgagtttttatttttacggaacggttttaacgggttaaactaccttttaaccgtaccgttaccggttaccgggttagaccggggtaaccggttccgggtacgggggaacccgaagggtacccgtacgggtccctacgttccnctaccgccgtacctacccgaacggaccgtccctacgttccggttcccctccccgtacggcccctaccccgttaccgaccgtaaacgtccgaccgtaccggttaccggggtcgggacccaacggtccgggtcccgggttaccccgngggtcccggttccgtacccgggtacggtaacggtaacggttaaccttaccgttaccacggtacgttcgtccgtcggtaacggccgggtaccgggtagtaaccggcggaaccgtcgacgttaggacnggtacntcagnntacggntacgnancnntacnncncncngtntctctctntctgcnnnngcnnnnnnnnnnctngtg

SEQ ID NO: 85081 - DNA, 170 bp, Homo sapiens
  misc_feature: GYAE6OF02GS3WW.4.34.D01.1.454.CMB.1.raw
  modified_base (169)..(170): a, c, t, g, unknown or other
  misc_feature (169)..(170): n is a, c, g, or t
tcagagcactgtagcacgaccggtgctcgatttagatcgtctgtgttgggtttgggattcggcggagggaccaaactgaccgtcctaagtcagcccaaggctgcccctcggtcactctgttcccaccctcctcctacagtgctctgagcgggctggcaaggcgcatagnn

SEQ ID NO: 85082 - DNA, 498 bp, Homo sapiens
  misc_feature: GYAE6OF02HVGZX.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctcagggatccctgagcgattctctggctccagctcagggacaacagtcacgttgaccatcagtggagtccaggcagaagacgaggctgactattactgtcaatcagcagacagcggtgggacttaagtaaagagttcggacggagggaccaaggctgaccgtctaggtcagcccaaggctgcccccg

SEQ ID NO: 85083 - DNA, 410 bp, Homo sapiens
  misc_feature: GYAE6OF02HM6N0.4.34.D01.1.454.CMB.1.raw
  modified_base (407)..(410): a, c, t, g, unknown or other
  misc_feature (407)..(410): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgatattttgactggttaagattactactactccggtatggacgtctggggccaagggaccacggtcaccgtctcctcagcctccaccaagggcccatcggtcttccccctggcaccctcctccaagagcacctctgggggcacagcggccctgggctgcctggtcaaggactacttccctacagtgctctgagcgggctggcaaggcgcatagnnnn

SEQ ID NO: 85084 - DNA, 410 bp, Homo sapiens
  misc_feature: GYAE6OF02HDGLK.4.34.D01.1.454.CMB.1.raw
  modified_base (407)..(410): a, c, t, g, unknown or other
  misc_feature (407)..(410): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaagtttccccaggcctgccggtaggtgtagaatgaggtctgtgtcactgtggtattacgatattttgactggttaagattactactactccggtatggacgtctggggccaagggaccacggtcaccgtctcctcagcctccaccaagggcccatcggtcttccccctggcaccctcctccaagagcacctctgggggcacagcggccctgggctgcctggtcaaggactacttccctacagtgctctgagcgggctggcaaggcgcatagnnnn

SEQ ID NO: 85085 - DNA, 534 bp, Homo sapiens
  misc_feature: GYAE6OF02G4W6W.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctgagggactcccgtgacgcgtattctctcggctccagctcgagggacaacagtcacgttcgaccatcagtggagtccgaggcagaagacgaggctgactattactgtacaatcagcagacaggtcggtaggaacttaagtaagtaggttacgggacgggacgggaaccaaggtctacggacccgtacgtacggtcgacgacccgaaggcctaccggcccccgg

SEQ ID NO: 85086 - DNA, 411 bp, Homo sapiens
  misc_feature: GYAE6OF02GDR5F.4.34.D01.1.454.CMB.1.raw
  modified_base (406)..(411): a, c, t, g, unknown or other
  misc_feature (406)..(411): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgatattttgactggttaagattactactactccggtatggacgtctggggccaagggaccacggtcaccgtctcctcagcctccaccaagggcccatcggtctccccctggcaccctcctccaagagcacctctgggggcacagcggccctgggctgcctggtcaaggactacttccctacagtgctctgagcgggctggcaaggcgcatagnnnnnn

SEQ ID NO: 85087 - DNA, 411 bp, Homo sapiens
  misc_feature: GYAE6OF02H0AN5.4.34.D01.1.454.CMB.1.raw
  modified_base (407)..(411): a, c, t, g, unknown or other
  misc_feature (407)..(411): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgatattttgactggttaagattactactactccggtatggacgtctggggccaagggaccacggtcaccgtctcctcagcctccaccaagggcccatcggtcttccccctggcaccctcctccaagagcacctctgggggcacagcggccctgggctgcctggtcaaggactacttccctacagtgctctgagcgggctggcaaggcgcatagnnnnn

SEQ ID NO: 85088 - DNA, 410 bp, Homo sapiens
  misc_feature: GYAE6OF02IETRK.4.34.D01.1.454.CMB.1.raw
  modified_base (405)..(410): a, c, t, g, unknown or other
  misc_feature (405)..(410): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgatattttgactggttaagattactactactccggtatggacgtctggggccaagggaccacggtcaccgtctcctcagcctccaccaagggcccatcggtcttccccctggcaccctcctccaagagcacctctggggcacagcggccctgggctgcctggtcaaggactactccctacagtgctctgagcgggctggcaaggcgcatagnnnnnn

SEQ ID NO: 85089 - DNA, 523 bp, Homo sapiens
  misc_feature: GYAE6OF02ICI4D.4.34.D01.1.454.CMB.1.raw
  modified_base (430)..(430): a, c, t, g, unknown or other
  misc_feature (430)..(430): n is a, c, g, or t
tcagagcactgtagcacgaccggtgctcgatttagatcgtctgtgttgggtttgggggtgggtccgaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgccagaccaatatgcttactggtaccagcagaagccaggccaggcccctgtgttgttgttatataaagacagtgagacgcctcgagggactcccgtgagacgattctcgtggctccagctcgaggacaacagtcagttgaccatcagtgagtcaggcaagaagacgaggctgacttattactgcaatcagcagacgagnggtacggacttaaagtaagagttcggacgggaggaccgaagcgtcggaaccgtcgtacggtaccgagaccccgaaggccgtccgtacccccgg

SEQ ID NO: 85090 - DNA, 408 bp, Homo sapiens
  misc_feature: GYAE6OF02G3YHA.4.34.D01.1.454.CMB.1.raw
  modified_base (402)..(408): a, c, t, g, unknown or other
  misc_feature (402)..(408): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgatattttgactggttaagattactactactccggtatgggcgtctggggccaagggaccacggtcaccgtctcctcagcctccaccaagggcccatcggtcttccccctggcaccctcctccaagagcacctctggggcacagcgcctggctgcctggtcaaggactacttccctaagtgctctgagcgggctggcaaggcgcatagnnnnnnn

SEQ ID NO: 85091 - DNA, 172 bp, Homo sapiens
  misc_feature: GYAE6OF02FKM9Y.4.34.D01.1.454.CMB.1.raw
  modified_base (170)..(172): a, c, t, g, unknown or other
  misc_feature (170)..(172): n is a, c, g, or t
tcagagcactgtagcacgaccggtgctcgatttagatcgtctgtgttgggtttgggattcggcggagggaccaaactgaccgtcctaagtcagcccaaggctgccccctcggtcactctgttcccgccctcctcctacagtgctctgagcgggctggcaaggcgcatagnnn

SEQ ID NO: 85092 - DNA, 512 bp, Homo sapiens
  misc_feature: GYAE6OF02FKGT7.4.34.D01.1.454.CMB.1.raw
  modified_base (443)..(443): a, c, t, g, unknown or other
  misc_feature (443)..(443): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctcagggatccctgagcgattctctggctccagctcagggacaacagtcacgttgaccatcagtggagtccaggcagaagacgaggctgactattactgtcaatcagcagacagcggtgggacttagtaaagngttacggcggagggaccaagcgtacggaccgttccgtaggtcacgacccgaaggtcctcgtccccccgg

SEQ ID NO: 85093 - DNA, 420 bp, Homo sapiens
  misc_feature: GYAE6OF02H73WP.4.34.D01.1.454.CMB.1.raw
  modified_base (413)..(420): a, c, t, g, unknown or other
  misc_feature (413)..(420): n is a, c, g, or t
tcagagcactgtagcacgaccggtgctcgatttagatcgtctgtgttggggtttggggacagcagacctgagagcgctgggcccacagcctcccctcagagccctgctgtctcctccggtcagccctggacatccccaggtttccccaggcctgccggtaggtgtagaatgaggtctgtgtcactgtggtattacgatattttgactggttaagattactactactccggtatggacgtctggggccaaagggaccacggtcaccgtctcctcagcctccaccaagggcccatcggtcttccccctggcacccctcctcccaagagcacctctggggcacagcggccctgggctgcctggtcaacggactacttccctacagtgctctgagcgggctggctaaggcgcatagnnnnnnnn

SEQ ID NO: 85094 - DNA, 411 bp, Homo sapiens
  misc_feature: GYAE6OF02H1V52.4.34.D01.1.454.CMB.1.raw
  modified_base (408)..(411): a, c, t, g, unknown or other
  misc_feature (408)..(411): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgattattttgactggttaagattactactactccggtatggacgtctggggccaagggaccacggtcaccgtctcctcagcctccaccaagggcccatcggtcttccccctggcaccctcctccaagagcacctctgggggcacagcggccctgggctgcctggtcaaggactacttccctacagtgctctgagcgggctggcaaggcgcatagnnnn

SEQ ID NO: 85095 - DNA, 407 bp, Homo sapiens
  misc_feature: GYAE6OF02GA60W.4.34.D01.1.454.CMB.1.raw
  modified_base (406)..(407): a, c, t, g, unknown or other
  misc_feature (406)..(407): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgatattttgactggttaagattactactactccggtatggacgtctggggccaagggaccacggtcaccgtctcctcagcctccaccaagggcccatcggtcttccccctggcaccctcctccaagagcacctctggggcacagcggccctgggctgcctggtcaaggactacttccctacagtgctctgagcgggctggcaaggcgcatagnn

SEQ ID NO: 85096 - DNA, 412 bp, Homo sapiens
  misc_feature: GYAE6OF02GU7IK.4.34.D01.1.454.CMB.1.raw
  modified_base (408)..(412): a, c, t, g, unknown or other
  misc_feature (408)..(412): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgatattttgactggttaagattactactactccggtatggacgtctggggccaagggaccacggtcaccgtctcctcagcctccaccaagggcccatcggtcttcccccctggcaccctcctccaagagcacctctgggggcacagcggccctgggctgcctggtcaaggactacttccctacagtgctctgagcgggctggcaaggcgcatagnnnnn

SEQ ID NO: 85097 - DNA, 505 bp, Homo sapiens
  misc_feature: GYAE6OF02H2TV8.4.34.D01.1.454.CMB.1.raw
  modified_base (317)..(317): a, c, t, g, unknown or other
  misc_feature (317)..(317): n is a, c, g, or t
  modified_base (420)..(420): a, c, t, g, unknown or other
  misc_feature (420)..(420): n is a, c, g, or t
tcagagcactgtagcacgaccggtgctcgatttagatcgtctgtgttgggtttgggggtgggtccaggaggcagaactctgggtgtctcaccatggcctggatccctctacttctcccccctcctcactctctgcacaggctctgaggcctcctatgagctgacacagcccaccctcggtgtcagtcgtccccaggacagacggccaggatcacctgctctggagatgcattgccagaccaatatgcttactggtaccagcagaagccaggccaggcccctgtgttgttgttataataaagacagtgagaggccctnagggatccctgagcgattctctgctccagctcagggacaacagtcacgttgaccatcagtgagtccgagcaagaagacgaggctgactattactgacaatcancagacagcgtgggaacttaagtaaagagttacggcgggaaggccaaagctagacccgtcgtaggtcacgaccaaggctcgccccg

SEQ ID NO: 85098 - DNA, 550 bp, Homo sapiens
  misc_feature: GYAE6OF02IUFTL.4.34.D01.1.454.CMB.1.raw
  modified_base (359)..(359): a, c, t, g, unknown or other
  misc_feature (359)..(359): n is a, c, g, or t
  modified_base (483)..(483): a, c, t, g, unknown or other
  misc_feature (483)..(483): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttatggtaccagcagaagccaggccaggcccctgtgttgttgtatataaagacagtgagaggccctacgagggactcccgtgagcgattctctggctccagctcgagggacaacngtcacgttgaccatcagtggatccgaggcaaggaagacgaaggctagactattacgtgtacaaatctaagacaaggtaacagggtcgggtacgggaactttaaagtaaaggaggttaccggggngggtaacgggaaccgaagcgtacgaccgtccgtaggtccgaccgacccaggtccgtcgtacccccgg

SEQ ID NO: 85099 - DNA, 523 bp, Homo sapiens
  misc_feature: GYAE6OF02HZU57.4.34.D01.1.454.CMB.1.raw
  modified_base (411)..(411): a, c, t, g, unknown or other
  misc_feature (411)..(411): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgacttactggtaccagcagaagccaggccaggcccctgtgttgttgttatataaagacagtgagaggccctcgagggactccctgagcgattctctggctccagctcgaggacaacagtcacgttgaccatcagtggagtccagcagacgacgaggctgactattactntacaatcagcaagacaggtcgggtaggaacttaagtaaaggtgttacgggcggtaacgggaacaaggctacgaccgtccgtaggacacggccgaacggcctaccgtcccccg

SEQ ID NO: 85100 - DNA, 409 bp, Homo sapiens
  misc_feature: GYAE6OF02HZVF6.4.34.D01.1.454.CMB.1.raw
  modified_base (405)..(409): a, c, t, g, unknown or other
  misc_feature (405)..(409): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgatattttgactggttaagattactactactccggtatggacgtctggggccaaagggaccacggtcaccgtctcctcagcctccaccaagggcccatcggtcttccccctggcaccctcctccaagagcacctctggggcacagcggccctggctgcctggtcaaggactacttccctacagtgctctgagcgggctggcaggcgcatagnnnnn

SEQ ID NO: 85101 - DNA, 507 bp, Homo sapiens
  misc_feature: GYAE6OF02FYWPS.4.34.D01.1.454.CMB.1.raw
  modified_base (427)..(427): a, c, t, g, unknown or other
  misc_feature (427)..(427): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctcagggatccctgagcgtattctctggctcagctcgagggacaacagtcacgttgaccatcagtggagtccgaggcaagaagacgaggctagactattactgtcaatcagcagacngcggtggacttagaagtagttcggcggacggacaagcgtacgaccgtcgtaggtcgagcccgaacggtctccgtaccccg

SEQ ID NO: 85102 - DNA, 412 bp, Homo sapiens
  misc_feature: GYAE6OF02H92VA.4.34.D01.1.454.CMB.1.raw
  modified_base (407)..(412): a, c, t, g, unknown or other
  misc_feature (407)..(412): n is a, c, g, or t
tcagagcactgtagcacgaccggtgctcgatttagatcgtctgtgttgggtttgggacagcagacctgagagcgctgggcccacagcctcccctcagagccctgctgtctcctccggtcagccctggacatcccaggtttccccaggcctgccggtaggtgtagaatgaggtctgtgtcactgtggtattacgatattttgactggttaagattactactactccggtatggacgtctggggccaagggaccacggtcaccgtctcctcagcctccaccaagggcccatcggtcttccccctggcacccctcctcccaagagcacctctggggcacagcggccctgggctgcctggtcaaggactacttccctacagtgctctgagcgggctggcaaggcgcatagnnnnnn

SEQ ID NO: 85103 - DNA, 501 bp, Homo sapiens
  misc_feature: GYAE6OF02GBQIF.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctcagggatccctgagcgattctctggctccagctcagggacaacagtcacgttgaccatcagtgagtccaggcagaagacgaggctgactattactgtacaatcagcagacagcggtggacttaagaagagttcggacggagggacaaggcgtcgaccgtcgtaggtcagacccgaggcctcgtcccccg

SEQ ID NO: 85104 - DNA, 530 bp, Homo sapiens
  misc_feature: GYAE6OF02I9TZ4.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctacgagggactcccgtgaggcgtattctcgtggctccagctacgaggacaacacgtcacgttgaccatcgagtggacgtccaggacaaggaagacggaggctagacttatacgtgtacaatcagcagacaggcggtaggtacttaagtaagtgtacgggcgggaagggaccgaagcgtcgaccgtcgtaggtcacggcccgaaggtcctcggtcccccg

SEQ ID NO: 85105 - DNA, 538 bp, Homo sapiens
  misc_feature: GYAE6OF02GA38A.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctcagggatccctgagcgattctctggctccagctcgagggacaacgagtcacgttgaccatcagtggagtccaggcagaagacgaggctgactattactgtcaatcagcaagacgaggcggtaggacgttaaagtaaagtacggttacgggacgggagggaaccgaaggacgtacggtacccgtaccgtacggtacacggacccgaagggtccgtccgtccccccgg

SEQ ID NO: 85106 - DNA, 586 bp, Homo sapiens
  misc_feature: GYAE6OF02HI3FM.4.34.D01.1.454.CMB.1.raw
  modified_base (460)..(460): a, c, t, g, unknown or other
  misc_feature (460)..(460): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggactcacctgctcgtggagatgcattcgccagaccaatatgcttactggtaccagcagaacgccaggccacggcccctgtgttgttgtataataaagacagtgagacggccctagagggactcccgtaggacgcgtattctcgtcggcctaccgagtctcgaagggaccaaacgagtacctacgttacgacctatcgaggtaggtacgtaccgaggacaaggaacgacgaggctagacttatacgtcgtactaancgagacaacgacgaggcgggttagggaacttaagtaaagtacggttacgggaggaacgggaaccaggccgtacggacccgtacgtacggtaccgaacgacccggaacggtccgtaccgtcccccgg

SEQ ID NO: 85107 - DNA, 499 bp, Homo sapiens
  misc_feature: GYAE6OF02F5P3G.4.34.D01.1.454.CMB.1.raw
  modified_base (491)..(491): a, c, t, g, unknown or other
  misc_feature (491)..(491): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctcagggactccctgagcgattctctggctcagctcagggacaacagtcacgttgaccatcagtgagtccaggcagaagacgaggctgactattactgtcaatcagcagacagcgggtaggacttaagaagagttcggacggaggaccaagcgtgaccgtcgtaggtcacgccgacggtcncgtccccg

SEQ ID NO: 85108 - DNA, 522 bp, Homo sapiens
  misc_feature: GYAE6OF02HIVFE.4.34.D01.1.454.CMB.1.raw
tcagagcactgtagcacgaccggtgctcgatttagatcgtctgtgttgggtttggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagagccctgagggatcctgagcgattctctgctccagctcaagggcaacagtcacgttgaccatcagtggagtccaggcgagaagacggaggctggactattactgtcaatcagccagacagcggtagggacttaataagtaggttacggacggagggaccaaggcgtacggacccgttaccgtacggtaccgaggaccccgaaggcctacgtccccccg

SEQ ID NO: 85109 - DNA, 582 bp, Homo sapiens
  misc_feature: GYAE6OF02IKFEE.4.34.D01.1.454.CMB.1.raw
  modified_base (363)..(363): a, c, t, g, unknown or other
  misc_feature (363)..(363): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgccagaccaatatgcttactggtaccagcagaagccaggccaggcccctgtgttgttgttataataaagacagtgagacggccctagagggactcccgtgagcgtattctctggctcagctacgaggacaacngtcacgttgacatcagttgagtcaggcagaagcgagctagactattactagtacaatcaaggtccaaggaacagggtcgggtagggtaacctttaaagtaaacgcgggtttaccgggacgggtaaacggggaacccaagggcccgttaggaaccccggttacgttaacgggttcaaaccgggtccccggaaacgggtcccgtacccggtacccccccgg

SEQ ID NO: 85110 - DNA, 584 bp, Homo sapiens
  misc_feature: GYAE6OF02H3P9O.4.34.D01.1.454.CMB.1.raw
  modified_base (446)..(446): a, c, t, g, unknown or other
  misc_feature (446)..(446): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagcacggccacggccctagtcgtttgttagttaataataaagacagtgagacggccctagagggactcccgtagacgcgtacttctctggcctacagctcgaaggaacaacgtagtctaacgttacgaaccagtcgaggtaggacgtccgaggacaaggtaagacgtaggctagtaactattacngtacaatcgaagctagacgaggtcggtagggaacttaagtaaagtacggttacgggacgggaacggaaccgaagtccgtacggtacccgtacgtaacggtaccaaccggtacccgaacggtccgtaccgtacccccgg

SEQ ID NO: 85111 - DNA, 417 bp, Homo sapiens
  misc_feature: GYAE6OF02HV079.4.34.D01.1.454.CMB.1.raw
  modified_base (405)..(405): a, c, t, g, unknown or other
  misc_feature (405)..(405): n is a, c, g, or t
  modified_base (410)..(417): a, c, t, g, unknown or other
  misc_feature (410)..(417): n is a, c, g, or t
tcagagcactgtagcacgaccggtgctcgatttagatcgtctgtgttgggtttgggacagcagacctgagagcgctgggcccacagcctcccctcagagccctgctgtctcctccggtcagccctggacatcccaggtttccccaggcctgccggtaggtgtagaatgaggtctgtgtcactgtggtattacgatattttgactggttaagattactactactccggtatggacgtctggggccaagggaccacggtcaccgtctcctcagcctccaccaagggcccatcggtcttcccccctggcacccctcctccaagacgcacctctggggccacacgcggccctgggctgcctggtcaaggactacttccctacagtgctctgagcgggctggcaaggcgnatagnnnnnnnn

SEQ ID NO: 85112 - DNA, 171 bp, Homo sapiens
  misc_feature: GYAE6OF02G5IXL.4.34.D01.1.454.CMB.1.raw
  modified_base (170)..(171): a, c, t, g, unknown or other
  misc_feature (170)..(171): n is a, c, g, or t
tcagagcactgtagcacgaccggtgctcgatttagatcgtctgtgttgggtttgggattcggcggagggaccaaactgaccgtcctaagtcagcccaaggctgccccctcggtcactctgttcccgccctcctcctacagtgctctgagcgggctggcaaggcgcatagnn

SEQ ID NO: 85113 - DNA, 748 bp, Homo sapiens
  misc_feature: GYAE6OF02JRZH4.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgccagaccaatatgcttactgtaccagacagaagcaggccacggcccctgtcgttgttagttactaagtaaacgacgaggtgaggacggccctagagggtactccgtgacgcgtagttctcgtggtcctacgacgtctacgaaggggtaaccaaaccgtacggttccaaccgggtttaccggaaccctacgtaccgtaacggtacgggtaacgtaccggaacggtacgaaagggtaaacggaaccggaaggtaccgttaggaaccgtttaagttaaccgttacggtactaaagtccgaacgtacgaacggtaaccgaagggttaccgggtacggggtaaacctttaaaggttaaacgggtaacggtttaccggggaacggggtaaaccggggtaaacccggtaaacgggtcccgttaacggggtaaccccggtttaaccgggttaacggggttaacccgtaaccgggtaacccccggttaaacggggtaccccgttaccccgggttaaccccccgggg

SEQ ID NO: 85114 - DNA, 562 bp, Homo sapiens
  misc_feature: GYAE6OF02H08OV.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctcccccctcctcactctctgcacaggctctgaggcctcctatgagctgacacagcccaccctcggtgtcagtcgtccccaggacagacggccaggatcacctgctctggagatgcattgccagaccaatatgcttactggtaccagcagaagccaggccaggcccctgtgtttgttgttatataaagacagtgagaggccctagagggactcccgtgagcgattctctggctccagctcgagggacaacagtcacgttgaccatcaggtggacgtccgaggcaaggaagacgaggtctagacttattactgacaatcagcaagacgaggtcggtagggtaattaagtaaaggtacggttacgggacgggacggggaacctaacggcgtacggacccggttaccgtacggtccgaacggacccgaacggtccgtacccgtaccccccgg

SEQ ID NO: 85115 - DNA, 413 bp, Homo sapiens
  misc_feature: GYAE6OF02I30S4.4.34.D01.1.454.CMB.1.raw
  modified_base (408)..(413): a, c, t, g, unknown or other
  misc_feature (408)..(413): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgattattttgactggttaagattactactactccggtatggacgtctggggccaagggaccacggtcaccgtctcctcagcctccaccaagggcccatcggtcttccccctggcaccctcctccaagagcacctctggggcacagcggccctgggctgcctggtcaaggactacttccctacacgtgctctgagcgggctggcaaggcgcatagnnnnnn

SEQ ID NO: 85116 - DNA, 536 bp, Homo sapiens
  misc_feature: GYAE6OF02JDENS.4.34.D01.1.454.CMB.1.raw
  modified_base (415)..(415): a, c, t, g, unknown or other
  misc_feature (415)..(415): n is a, c, g, or t
tcagagcactgtagcacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggccctgtgttgtgttatataaagacagtgagaggcctgacgggatcccgtgagcgtattctcgtggctccgagctcgaaggacaacagtcacgttgaccatcagtggacgtccgaggcaagaagacgaggctgaacttattacngtacaatcagcagacaggtcgtaggtacttaagaagaggttacgggacggaagggtaccgaagtcgtaacggtacccgtacgtagggactacggtacccgaaggccgtacgtaccccccgg

SEQ ID NO: 85117 - DNA, 519 bp, Homo sapiens
  misc_feature: GYAE6OF02HQC2K.4.34.D01.1.454.CMB.1.raw
  modified_base (313)..(313): a, c, t, g, unknown or other
  misc_feature (313)..(313): n is a, c, g, or t
  modified_base (444)..(444): a, c, t, g, unknown or other
  misc_feature (444)..(444): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctnagggatcccgtgagcgattctctggctccagctcagggacaacgagtcacgttgaccatcagtggagtcaggcagaagacgagctgacttatactgtacatcagcagacagcggtagggacttaagaaagngttacgggacggagggaaccaagcgtacgaacccgtcgtacggtaccgagacccgaaggcctacggtaccccccg

SEQ ID NO: 85118 - DNA, 458 bp, Homo sapiens
  misc_feature: GYAE6OF02IM9A9.4.34.D01.1.454.CMB.1.raw
  modified_base (431)..(458): a, c, t, g, unknown or other
  misc_feature (431)..(458): n is a, c, g, or t
tcagagcactgtagcacgaccggtgctcgatttagatcgtctgtgttgggtttggggacagcagacctgagagcgctgggcccacagcctcccctcagacgccctgctgtctccgtccggtcagccctggacatcccaggtttccccaggcctgccggtaggtgtagaatgaggtctgtgtcactgtggtattacgattattttgactggttaagattactactactccggtatggacgtcgtggggccaaaggggccacggtcaccgtctcctcagcctccaccaacggcccatcggtcttccccctggccacccctcctcccaagacgccaacctcgtcgggggccacgacgccggccctgggctcggccgtggtcaacggactaccttccctacagtcgctctgagcgggctggacaggcgcagtagnnnnnnnnnnnnnnnnnnnnnnnnnnnn

SEQ ID NO: 85119 - DNA, 411 bp, Homo sapiens
  misc_feature: GYAE6OF02HR116.4.34.D01.1.454.CMB.1.raw
  modified_base (380)..(380): a, c, t, g, unknown or other
  misc_feature (380)..(380): n is a, c, g, or t
  modified_base (405)..(411): a, c, t, g, unknown or other
  misc_feature (405)..(411): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgatattttgactggttaagattactactactccggtatggacgtctggggccaagggaccacgggtcaccgtctcctcagcctccaccaggcccatcgtcttccccctggcaccctcctccaagagcacctcgtggggcacagcggccctggctgcctggtcaaggactacttccctacagtgctcngagcgggctggcgaaggcgcatagnnnnnnn

SEQ ID NO: 85120 - DNA, 415 bp, Homo sapiens
  misc_feature: GYAE6OF02IDA1J.4.34.D01.1.454.CMB.1.raw
  modified_base (410)..(415): a, c, t, g, unknown or other
  misc_feature (410)..(415): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgatattttgactggttaaagattactactactccggtatggacgtctggggccaagggaccacggtcaccgtctcctcagcctccaccaagggcccatcggtcttccccctggcaccctcctccaagagcacctctgggggcacagcggccctgggctgcctggtcaaggactaccttccctacagtcgctctgagcgggctggcaaggcgcatagnnnnnn

SEQ ID NO: 85121 - DNA, 425 bp, Homo sapiens
  misc_feature: GYAE6OF02HENIA.4.34.D01.1.454.CMB.1.raw
  modified_base (418)..(425): a, c, t, g, unknown or other
  misc_feature (418)..(425): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatccccaggtttccccacggcctgccggtaggtgtagaatgaggtctgtgtcactgtggtattacgtatattttgtactggttaagtattactactactccggtatggacgtcgtgggccgaagggaccacggtcaccgtctcctcagcctccaccaaggcccatcgtcttccccctgccaccctcctccaagacgccacctcgtggggcacagcggcccgtgggctgcctggtcaaggactaccttcctacagtcgctctgagcgggactggcgaaggcgcagtagnnnnnnnn

SEQ ID NO: 85122 - DNA, 516 bp, Homo sapiens
  misc_feature: GYAE6OF02G5HLZ.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctcagggatccctgagcgattctctggctccagctcagggacaacagtcacgttgaccatcagtgagtccaggcagaagacgaggctgactattactgtcaatcaagcagacagcggtgggacttaagtaaagagttcgggacggtagggacccaaggcgtaggacccgttactagggtccaggaccccaagggccgtcgcccccg

SEQ ID NO: 85123 - DNA, 406 bp, Homo sapiens
  misc_feature: GYAE6OF02GIYDR.4.34.D01.1.454.CMB.1.raw
  modified_base (319)..(319): a, c, t, g, unknown or other
  misc_feature (319)..(319): n is a, c, g, or t
  modified_base (403)..(406): a, c, t, g, unknown or other
  misc_feature (403)..(406): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgatattttgactggttaagattactactactccggtatggacgtctggggccaagggaccacggtcaccgtctcctcagcctccaccaaggcccatcggtcttccccctggcaccctcctccaagngcacctctggggcacagcgcctgggctgcctggtcaaggactacttccctacagtgctctgagcgggctggcaaggcgcatagnnnn

SEQ ID NO: 85124 - DNA, 425 bp, Homo sapiens
  misc_feature: GYAE6OF02FYUJC.4.34.D01.1.454.CMB.1.raw
  modified_base (416)..(425): a, c, t, g, unknown or other
  misc_feature (416)..(425): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgatattttgacttggttaagattactactactccggtatggacgtctggggccaagggaccacggtcaccgtctcctcagcctccaccaaggcccatcggtcttccccctggccaccctcctccaagacgcacctctgggggcacgacgccggccctgggcctgcctggtcaaggactacttccctacagtcgctctcgagcgggcgtggcaaggcgcatagnnnnnnnnnn

SEQ ID NO: 85125 - DNA, 503 bp, Homo sapiens
  misc_feature: GYAE6OF02I9HHN.4.34.D01.1.454.CMB.1.raw
  modified_base (446)..(446): a, c, t, g, unknown or other
  misc_feature (446)..(446): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctgagggatccctgacgcgtattctctggctccagctcgagggacaacagtcacgttgaccatcagtggagtccaggcagaagacgaggctagactattactgtacaatcagcagacaggcgtggacttaagaagngttacggacggaggaccagcgtgaccgtcgtaggtcacgccaaggcctcgtcccccg

SEQ ID NO: 85126 - DNA, 558 bp, Homo sapiens
  misc_feature: GYAE6OF02G08AN.4.34.D01.1.454.CMB.1.raw
  modified_base (313)..(313): a, c, t, g, unknown or other
  misc_feature (313)..(313): n is a, c, g, or t
  modified_base (360)..(360): a, c, t, g, unknown or other
  misc_feature (360)..(360): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctnagggactccctgagcgtattctcgtggctccagctcgagggacaacngtcacgttgaaccatcagtggactcgagcagaagacgaggctagactattactgtacaatcagccaagacacggtcggtaacggtacttaaagtaacgtaggttacgggacgggtaacggaaccgaaggtccgtaaccggtaccggttaccgtacggtacgaaccggacccgaacggtcccgtacccggtacccccgg

SEQ ID NO: 85127 - DNA, 563 bp, Homo sapiens
  misc_feature: GYAE6OF02HHK73.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattgccagaccaatatgcttactggtaccagcagaagccaggccacggcccctgtgttgttgttataataaagacagtgagacggccctagagggactcccgtggagcgtattctcgtggctccagctacgaggacaacgagtctacgttcgacctatcgagtggacgtccgaggacaaggaagacgaggctagacttatactgtacaatcgagcagacgaggtcgggtaggtacttaagaagtcggttacgggacggtacgggaaccgaaggcgtacggacccgttacgtacggtccgaccggtacccggaacggtccgtacccggtacccccgg

SEQ ID NO: 85128 - DNA, 502 bp, Homo sapiens
  misc_feature: GYAE6OF02IOWDM.4.34.D01.1.454.CMB.1.raw
  modified_base (219)..(219): a, c, t, g, unknown or other
  misc_feature (219)..(219): n is a, c, g, or t
  modified_base (467)..(467): a, c, t, g, unknown or other
  misc_feature (467)..(467): n is a, c, g, or t
  modified_base (470)..(502): a, c, t, g, unknown or other
  misc_feature (470)..(502): n is a, c, g, or t
tcagagcactgtagcacgaccggtgctcgatttagatcgtctgtgttgggtttggggtagagcagacctgagagcgctgggccacagcctcccctcacgagccctgctgtctcctccggtcagccctggaccatcccacggtttccccaggccctgcccggtaggtcgtagatgaggtctgtgtcactggtggtattagtatattttgactggtttaanagtttaatactacttccggtaatggtacgtctaggggccaagggacccacgggtccacgtcctcctcagcctccaccgaacgggcccatccggtccttccccctggccacccctcctcccaagacgcacctcgtcggggcactagccggccctgggctgacccgtgtcaacggctaccttaccctacagttcgccttctggacggtggaccggttggcgtaacgggccacgtagtaggctgcagctancgnnnnnnnnnnnnnnnnnnnnnnnnnnnnnnnnn

SEQ ID NO: 85129 - DNA, 584 bp, Homo sapiens
  misc_feature: GYAE6OF02F8JVZ.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctcgaggggactacccgtgacggcgtattcctctcggccttccagtcctcgaacgggacaaaccgagtctacgttacgaaccatcagtggagtccgaggcaaggaacgacgaggactgaacttattacgtgtacaattcgagacagacgaggtcgggtaggaacttaagtaaaggtacgggttcgggacggaacgggaaccaaggtccgtaacggtacccgttaccgtaggtccgtaaccggaccccgtaaggtcccgtacggtacccccccgg

SEQ ID NO: 85130 - DNA, 422 bp, Homo sapiens
  misc_feature: GYAE6OF02IFWYC.4.34.D01.1.454.CMB.1.raw
  modified_base (416)..(422): a, c, t, g, unknown or other
  misc_feature (416)..(422): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgatatttttgactggttaagattactactactccggtatggacgtctggggccaagggaccacggtcaccgtctcctcagcctccaccaagggcccatcggtcttccccctggccacccctctcccaagacgcacctctgggggcacgagccggccctgggctcgcctggtacaaggacctacttccctacagtgctctgagcgggctggcaaggcgcatagnnnnnnn

SEQ ID NO: 85131 - DNA, 553 bp, Homo sapiens
  misc_feature: GYAE6OF02HONKQ.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgccagaccaatatgcttactggtaccagcagaagcaggccaggcccctgtgttgttagttataataaagacagtgagagccctgagggactcccgtgagcgtattcctgtcggcctccgagctcgaagggacaacagtcacgttacgaccatcgagttggacgtccgagggcaaggaagacggaggctagacttaattactagactaactcagctacgacaggcggtaggtaacttaagtaagtagttcgggacggacgggaaccaaggtcctacggaccgtacgtacggtacacggacccgtaaggcccgtcgtacccccgg

SEQ ID NO: 85132 - DNA, 586 bp, Homo sapiens
  misc_feature: GYAE6OF02HHR8T.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccacggcccctgtgttgttgttataataaagacagtgagacggccctcgagggactccctggacgcgtattctcgtggctccagctcgagggacaacgagtactacgttacgaccatcgaggtaggacgtccgaggcaaggaagacggaggtactagaacttattactgtacaatcgagacgagaacgaggacgggtaggtaacttaagtaaaggtacggttacgggacgggacgggaaaccgtaaggccgtacgaacccggttaccgttacgggtaccgaaccggtacccggaacgggtcccgtacccggtcccccg

SEQ ID NO: 85133 - DNA, 535 bp, Homo sapiens
  misc_feature: GYAE6OF02HPXBR.4.34.D01.1.454.CMB.1.raw
  modified_base (455)..(455): a, c, t, g, unknown or other
  misc_feature (455)..(455): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagcagtgagaggccctcgagggactcctgagcgattctctggctcagctcgaggacaacagtcacgttgaccatcgagtggacgtccgagacagaacgacgaggctagacttattactgtacaatcaagcagacgaggtcgtgggaacttaagtaaaggnggttcgggacggaacgggaaccaaggtactcggacccgtacgtaggtccgaacgtcccgaacggtcctccgtacccccgg

SEQ ID NO: 85134 - DNA, 467 bp, Homo sapiens
  misc_feature: GYAE6OF02GIO5K.4.34.D01.1.454.CMB.1.raw
  modified_base (214)..(214): a, c, t, g, unknown or other
  misc_feature (214)..(214): n is a, c, g, or t
  modified_base (446)..(467): a, c, t, g, unknown or other
  misc_feature (446)..(467): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgattattttgactggttaaanattactactactccggtatggacgtcgtggggccaagggaccacggtcaccgtctcctcacgcctccaaccaacgggcccagttccggtcccttcccccgtggcccacccctccctaccaacgacgccacccgtcgtcggggcacgcggccggcccgtggctcgcctggacaaggacctaccttccacagtgctcgtcgacgcgggcgtacggacgaacggcgacgaatagnnnnnnnnnnnnnnnnnnnnnn

SEQ ID NO: 85135 - DNA, 709 bp, Homo sapiens
  misc_feature: GYAE6OF02HPUD2.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggcctctgacggcctcctatgagctgacacacgcccacccgtcggtgtcagtcgtccccaggacacggacggccaggactccacctgctcgtggagatgcattcgaccagaaccaatatgtacttactacggtaccagacaagaacgccacggccaccggcccctggttgttgtttagttaataagtaaagacaggtagagacggtccctagacgggtactcccgtgacgacgttattccgtacgtcggcctccgacgtcctacgaacgggtacaaacgacgtacgtacgttacgaactacgtcgaggtcggacgtccgaggacgaaggaaacggacgaggactaggtaactttaagttactacgtaactaagtaccacgacgtaggaacgtacggggtaccggggttaacgggttaaacttaaacggtaaacggttacgggtttaccggggacggggtaaaccgggaaccgtaacgggtaccggttaacgggtaaccccggttaaccggtaaccgggtaccgaaccggtacccccggtaaagggttccccgtaccccggttacccccccgg

SEQ ID NO: 85136 - DNA, 695 bp, Homo sapiens
  misc_feature: GYAE6OF02I3JE1.4.34.D01.1.454.CMB.1.raw
  modified_base (185)..(185): a, c, t, g, unknown or other
  misc_feature (185)..(185): n is a, c, g, or t
  modified_base (223)..(223): a, c, t, g, unknown or other
  misc_feature (223)..(223): n is a, c, g, or t
tcagagcactgtagcacgaccggtgctcgatttagatcgtctgtgttgggtttgggggtgggtccaggaggcagaactctgggtgtctcaccatggcctggatccctctacttatcccccctcctcactctctgcacaggctctgaggcctcctatgagctgacacagccaccctggtgtcagtntccccaggacagacggccaggatccacctgctctgganatgcattcgccagaccaatatgcttactcggtaccagacagaacgccacggccgacggcccctggtcgttgttgttatagtaaagacagtgagcggccctacgagggactcccgtagacgtcgtattccttcgtcggcctcgacgcgttacgaacgggaaccaacgtaagttccaacggtttacgaacccgtacgtacgacggttggaacggttacccgagggtaccaagggaaacggacggtacggtctacggtaacttacgttaacttacggtacctaaacgtcgaactaccggaacgtaacggacggtaccggggtttaagggaacctttaaaaggtaaacggttaggtttacccggggggaacggtaacgggtaacccggtaaacgtcggtaccggtaaccccgttacgttaacgggtacccgacccgggtaacccgaaccggttccccggtcccgttaaccccccgg

SEQ ID NO: 85137 - DNA, 422 bp, Homo sapiens
  misc_feature: GYAE6OF02IGGN9.4.34.D01.1.454.CMB.1.raw
  modified_base (412)..(412): a, c, t, g, unknown or other
  misc_feature (412)..(412): n is a, c, g, or t
  modified_base (418)..(422): a, c, t, g, unknown or other
  misc_feature (418)..(422): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgatattttgactggttaagattactactactccggtatggacgtctggggccaagggaccacggtcaccgtctcctcagcctccaccaacgggcccatcggtcttccccctggccacccctcctcccaagagcacctcgtgggggcacagccggccctgggctgccgtggtcaaggactacttccctacagtgctctgacgcgggcgtggcaaggccgnactagnnnnn

SEQ ID NO: 85138 - DNA, 670 bp, Homo sapiens
  misc_feature: GYAE6OF02F4GQ8.4.34.D01.1.454.CMB.1.raw
  modified_base (318)..(318): a, c, t, g, unknown or other
  misc_feature (318)..(318): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgtcttactcggtaccagcaagaagccaggccacggcccctgtgttgttgttataataaagacagtgagacggcctnagggactcccgtgagcgtattctctggctcgagctcgaagggacaacagtacgacgttacgacctaattacgaaggtacggtacgtcccgaaggtacgaaacgaaggacgaacgggctacgtaacgttaacttaacgtacgttaacaaacttcgaacggtcccgaagaacccgaagggtccggggttaaagggtaaccttttaaaaaaacgggtaaggtacgggtttaccggggaacggggtaaacggggtaacccgaaacggtcggtaaccggttaacccggttaccggtaacggggtacctaacccgggaaccccgtaacggggtacccttccccggtaacccccccggg

SEQ ID NO: 85139 - DNA, 413 bp, Homo sapiens
  misc_feature: GYAE6OF02FZ5IN.4.34.D01.1.454.CMB.1.raw
  modified_base (411)..(413): a, c, t, g, unknown or other
  misc_feature (411)..(413): n is a, c, g, or t
tcagagcactgtagcacgaccggtgctcgatttagatcgtctgtgttgggtttggggacagcagacctgagagcgctgggccccacagcctccccctcagagcccctgctgtctcctccggtcagccctggacatcccaggtttccccaggcctgccggtaggtgtagaatgaggtctgtgtcactgtggtattacgatattttgactggttaagattactactactccggtatggacgtctggggccaagggaccacggtcaccgtctcctcagcctccaccaaggcccatcggtcttccccctggcaccctcctcccaagagcacctctgggggcacagccggccctgggctgcctggtcaaggactacttccctacagtgctctgagcgggctggcaaggcgcatagnnn

SEQ ID NO: 85140 - DNA, 643 bp, Homo sapiens
  misc_feature: GYAE6OF02IZSHQ.4.34.D01.1.454.CMB.1.raw
  modified_base (524)..(524): a, c, t, g, unknown or other
  misc_feature (524)..(524): n is a, c, g, or t
tcagagcactgtagcacgaccggtgctcgatttagatcgtctgtgttgggtttgggggtgggtccaggaggcagaactctgggtgtctcaccatggcctggatccctctacttcctccccctcctcactctctgcacaggctctgacggcctcctatgagctgacacagccaccctggtgtcagtcgtcccaggacagacggcaggatcacctgctcgtggagatgcattcgcagacaatatgacttagcggtaccagcaagaagccgaacggccacgccccttgtcggtttgttagtataacgaaaagacagtgaaggacggtccctaggacggacttcccgaggacgtcgtaacgtttcctcgttccgggcttacccgtacggaccgtaccggaacgggtaaaccaaaccgtacggtaccgtaacgttacgaacccgtatacggtaacggtagggaccgttaccgaaggacgaaagggaacgaacgggtacggactacggaacttagttcgactaccggtanaaactacgacgacagaacgaggtcggtaggaacttaaagaacggtgtacgggacggtaacggaccgtagcgttaccggaccgttacgacggtcgaaccgacccgtacggctaccccggg

SEQ ID NO: 85141 - DNA, 510 bp, Homo sapiens
  misc_feature: GYAE6OF02FGFUC.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgccagaccaatatgcttactggtaccagcagaagccaggccaggcccctgtgttgttgtatataaagacagtgagaggccctcagggatccctgagcgattctctggctccagctcgagggacaacgagtcacgttgaaccatcagtggagtccaggcaagaagacgagcgtagacttattactgtacaatcagcagacagcggtaggacttagtaagtagttcggacggagggaaccagctagtaccgtcgtaggtccacgcccaggcctcgtcccccg

SEQ ID NO: 85142 - DNA, 724 bp, Homo sapiens
  misc_feature: GYAE6OF02JOG38.4.34.D01.1.454.CMB.1.raw
tcagagcactgtagcacgaccggtgctcgatttagatcgtctgtgttgggtttgggggtgggtccaggaggcagaactctgggtgtctcaccatggcctggacccctctcctgctcccctcctcactttctgcacagtctctgaggcctcctatgagctgacacagccaccctcggtgtcagtcgtcccaggacaaacggccaggactcacctactctggagatgcattcgccataccagcaagtaacgtcacgaccacggcccctgttctggtcatcgtgtacggagacaccgaaacgacccgtcggactccctagacgaacgactttctcgtcggtctccgagtcctacgacggggaactaagtccgggaccctaaccgtttacgaacttaacgtcgtaacggggttccggggacccgaagggttcgggaacgggtaacgtacggtaaacccgttgaaaccttaacgtttagtttacggttaacctacgaaacgtaacgtaacgaacgtaccgtaaggtaccgtacttaaacgtctaaagggttcgggggttacgttaccgggacgggtaacgggtaacttacgggaacgtcgttaccggaacccgttacggtaacggtaccacggtacccgtaacgggcctttcccggaccccgttccgggtacctaccgtttccggtaccgttccggttccccgtaccccttcccgttacccgtaaccgg

SEQ ID NO: 85143 - DNA, 665 bp, Homo sapiens
  misc_feature: GYAE6OF02JAO7U.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcaagaagccgagccacggcccctgtgttgttgttatataaagacagtgagacgccctgaggactccgtgagcgattctctggctcagctacgaggacaacgagtccgtaacgttgaacctagtacgaacggtggaacgtccgaggtcgaagaacggaacggaggactagaaccttagttacgtacgtacaaacgtcgtaaggaccaaggtaaccacgggtaccggggttaagggtaaacccgtttaaagttaaaagggttaacgggttaccggggaagggtaaccgggggttaaaacccaacggttaccggttacccgggtaaaccccgttacccgggttaagggttacccaacccggggtacccccgtaaacggggttacccccgtccccggggttaacccccccgg

SEQ ID NO: 85144 - DNA, 864 bp, Homo sapiens
  misc_feature: GYAE6OF02IROH4.4.34.D01.1.454.CMB.1.raw
tcagagcactgtagcacgaccggtgctcgatttagatcgtctgtgttgggtttggggtgggtccaggaggcagaactctgggtgtctcaccatggcctggatccctctacttctccccctcctcactctctgacacgagctctaggacggtccctctatgacgcgtagaccacacgacccctacccgttcggtctccgtaggttccgtacccccgaagggaccgaacgggacccggacccgaaggtaccttacctaccgttcgcccttcggtagggaagtagtcggtacttagttccgaccgaacgaacctaattacgttcgttacctttaccgttaccggtaaccgagaccgaaaggtaaccgacccgaccggcccgaacccgggtcccctttgggtttcggttttacggtttttagtttaacgttaaaggtaaaacgtacgtaacgggttaggaacggtaccggtcccccgttaagggaacgggttacccttaccccggttaggaccggtacggtttactttaccgttcggtccggtccctttaccgacgtcccgttacggaaacgggaacctaaacgtacgttaccgttacgtttacgaaccgtacttacggtagggttacggtaccggtaccgtaagggacgaaaggaaaccggtaacgggacgttcgtaaacgttaacgtttaactttaaccgttcgtaacgttaactaccgagtaccgaacgtacggacgggttaccgggttaaggttaactttaaaagtaaggttacggttacggggacgggtaaccgggtaccaaacgtcggtacgtaccgttacgtaacggtcgaccgaccggaacgtcccgtcccgtaccccgg

SEQ ID NO: 85145 - DNA, 608 bp, Homo sapiens
  misc_feature: GYAE6OF02GHRZD.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgccagaccaatatgcttactggtaccagcagaacgccaggccacggcccctgtgttgttgttatataaagacagtgagacggccctcgagggactcccgtgagcgtattctctggcctccgagctcgagggacaacagtctacggttcgacctactctaggtgggaacgtccgaagggcaaggaacggacggaaggtctagtaacttaattacgtcgtacaaacttacgacgacgaagacgagggtcgggtacgggtaactttaaagtaaaggtacggtttaccgggacgggtaacgggaacgaaacggtccggtaacgtacccggtacggtacggtaccgaaccggacccgtaacgggtccctccggtaccccccgg

SEQ ID NO: 85146 - DNA, 456 bp, Homo sapiens
  misc_feature: GYAE6OF02HXP0R.4.34.D01.1.454.CMB.1.raw
  modified_base (307)..(307): a, c, t, g, unknown or other
  misc_feature (307)..(307): n is a, c, g, or t
  modified_base (440)..(456): a, c, t, g, unknown or other
  misc_feature (440)..(456): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgcagaatgaggtctgtgtcactgtggtattacgattattttgactggttaagattactactactccggtatggacgtcgtggggccaagggaccacggtcaccgtctcctcagcctccaccaacgggcccatcggtccttcccccnggccaccctccctaccaagacgccacctcgtcgggggcacgagccggcccgtgggctgccgtggtacaacgggacctaaccttcctactagtcgcttcgtagacgcgggcgtgggacgaagggcgccagtagnnnnnnnnnnnnnnnnn

SEQ ID NO: 85147 - DNA, 414 bp, Homo sapiens
  misc_feature: GYAE6OF02GARPE.4.34.D01.1.454.CMB.1.raw
  modified_base (407)..(414): a, c, t, g, unknown or other
  misc_feature (407)..(414): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgatattttgactggttaagattactactactccggtatggacgtctggggccaagggaccacggtcaccgtctcctcagcctccaccaagggcccatcggtcttccccctggcaccctcctccaagagcacctctgggggcacagcggccctgggctgcctggtcaaggactacttccctacagtgctctgagcgggctggcaaggcgcatagnnnnnnnn

SEQ ID NO: 85148 - DNA, 441 bp, Homo sapiens
  misc_feature: GYAE6OF02I7HZU.4.34.D01.1.454.CMB.1.raw
  modified_base (428)..(441): a, c, t, g, unknown or other
  misc_feature (428)..(441): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgattattttgactggttaagattactactactccggtatggacgtcgtggggccaagggaccacggtcaccgtctcctcagcctccaccaacgggcccatcggtcctccccctggccaccctcctccaagacgccaccgtcgtggggcacgacgccggccctgggctgcctggaccaaggtcctaccttccctacagtcgctcgtggacgcgggtctggacgacggcgcaatcgnnnnnnnnnnnnnn

SEQ ID NO: 85149 - DNA, 411 bp, Homo sapiens
  misc_feature: GYAE6OF02FNSM6.4.34.D01.1.454.CMB.1.raw
  modified_base (407)..(411): a, c, t, g, unknown or other
  misc_feature (407)..(411): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgatattttgactggttaagattactactactccggtatggacgtctggggccaagggaccacggtcaccgtctcctcagcctccaccaagggcccatcggtcttccccctggccaccctcctccaagagcacctctgggggcacagcggccctgggctgcctggtcaaggactacttccctacagtgctctgagcggctggcaaggcgcatagnnnnn

SEQ ID NO: 85150 - DNA, 690 bp, Homo sapiens
  misc_feature: GYAE6OF02H8Y5A.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgtcttactggtaaccagcagaagccgaggccacggcccctgtcgtttgttagtttataataaagacagtaggagacggccctgaacgggactcccgtaggacgcgtactttcctcgtcggccttaccaaggtccgtcgaagggaaccaaccgacgtaccgtacggtttacgaacctagttaccgaagggtcggaacgtacccgaggggacgaaacggaaaggaacggaagggccgttaaggtaacttaacgttttaacgtgtaaccgaaattccgtaacgccgaaggaaccgacggtacggggttaagggtaacctttaaaaggtaaacgggtacggttaccggggacggggtaacggggaaccgaaacggtccgtaacggtaaccccggttcggtaacggtaccgaaccggaccccgtaaagggttcccgtcccggtacccccccgg

SEQ ID NO: 85151 - DNA, 544 bp, Homo sapiens
  misc_feature: GYAE6OF02HURP9.4.34.D01.1.454.CMB.1.raw
  modified_base (413)..(413): a, c, t, g, unknown or other
  misc_feature (413)..(413): n is a, c, g, or t
  modified_base (429)..(429): a, c, t, g, unknown or other
  misc_feature (429)..(429): n is a, c, g, or t
  modified_base (446)..(446): a, c, t, g, unknown or other
  misc_feature (446)..(446): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaaccaataatgtcttactggtaccagcagaagccaggccacggcccctgttcgttgttgttataataaagacagtgagacggccctagagggactcccgtagacgcgtacttctcgtcggctccaggctcgaggacaacagtctacgtcgacatcagtaggacgtcgagacagagacgnggctagacttattacngtacaatcagacagacnggcggtaggtacttaaagaaggtagttacgggacggacgggaacgtaagcgtacgaccgtcgtaggccaccgtacccggaacggtccaccgtccccgg

SEQ ID NO: 85152 - DNA, 486 bp, Homo sapiens
  misc_feature: GYAE6OF02H2HYY.4.34.D01.1.454.CMB.1.raw
  modified_base (461)..(462): a, c, t, g, unknown or other
  misc_feature (461)..(462): n is a, c, g, or t
  modified_base (464)..(486): a, c, t, g, unknown or other
  misc_feature (464)..(486): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgattattttgactggttaagattactactactccggtatggacgtcgtggggccaaagggccacggtcaccgtctcctcacgcctaccaccgaacgggccccagtccggtccttccccccgtggcctacccctcctcccaaacgacgccaccgtcgtcggggcacgacgccggcccgtgggctcggcctggtaccaaacggtaccttaccttcccctaacgagtcgtctcgtggacggccgggtcgtcggcgaacgggcgacagtagnngnnnnnnnnnnnnnnnnnnnnnnn

SEQ ID NO: 85153 - DNA, 623 bp, Homo sapiens
  misc_feature: GYAE6OF02J2D4R.4.34.D01.1.454.CMB.1.raw
  modified_base (226)..(226): a, c, t, g, unknown or other
  misc_feature (226)..(226): n is a, c, g, or t
  modified_base (247)..(247): a, c, t, g, unknown or other
  misc_feature (247)..(247): n is a, c, g, or t
  modified_base (387)..(387): a, c, t, g, unknown or other
  misc_feature (387)..(387): n is a, c, g, or t
  modified_base (447)..(447): a, c, t, g, unknown or other
  misc_feature (447)..(447): n is a, c, g, or t
tcagagcactgtagcacgaccggtgctcgatttagatcgtctgtgttgggtttggggttgggtcgaggaggcgagaactctgggtgtctcaccatggctggatccctctacttctcccctcctcactctctgcacaggctctgacggcctcctatgagctgacacagccaccctcggtgtcagtgtccccaggacagacggccaggtatcacctgctctggaacgntcgcattcgccagaccaaatntgtcttactggtaccagcagaacgccacggcctacggcccctggtcgttgttgttaataagtaaacgactagtgagacggcccgtacgaggtactccgtgacgtcgacttctcgtcgcctcgacgctacgaggacaacgngtacacgtttacgacctacgtcgtagtaggacgtccgtacggacgaaacggaagaccggngacgttgaactacgttactgactaaagtccagacgacgacgacggtacgggtacggtaaacgtaagtaacggtaggttcccgggaaggtacgggaacccgaaggtcgtacccggtaaccgtacccggttaggtcccggtaacgaccccggaacggtccggtaccccgtccccccgg

SEQ ID NO: 85154 - DNA, 736 bp, Homo sapiens
  misc_feature: GYAE6OF02H7JCC.4.34.D01.1.454.CMB.1.raw
tcagagcactgtagcacgaccggtgctcgatttagatcgtctgtgttgggtttggggtgggtccaggaggcagaactctgggtgtctcaccatggcctggatccctctacttctccccctcctcactctctgcacaggctctgaggcctcctatgagctgacacagcccacccgtcggtgtcagtcgtccccaggacagacggccaggactcacctgctctggagatgcattgccagaccaatacgtctacttagtacgacacgacgaagacgcgacgaccgaccgtccgttgttcgtttaggttattaataaacgtaaacgacgtaggtaggacggtccgtaccgacggaacgtaccttcggagacggtactaccgttcgtcggtcgtacctacgcgtaccgtacgggaaacggtaacctaacggtaccgtacggttacggtaacctaaccgacgtacggtaaggggtcggtacccgtaccgtagggaacgaaaggaacgggacggtaccggtacgttaacgtaacttaactttacgtacaacgttaacacgtaacggactaaaccggtaggaccggggttacggggtaacgtttaaagtaaaggttaaacgggttacggggtaccgggaagggggtaacccgaaacggtacggttaccgacccgggtttaaccgtacggttaacgggaccgacccggtaaccggaaccgttcccgggacccccgttaccccggg

SEQ ID NO: 85155 - DNA, 702 bp, Homo sapiens
  misc_feature: GYAE6OF02GNNRC.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggcacggccctgtgttgttgttatataaagacagtgagacggccctcgagggactcccgtggacgcgtattcgtcgtggcctccgagcctacgaacgggaaccaacgtacgtcgtaacgttcgaaccgtacttacgaggttcggaacgttacccgaagggtaccaaaggaaacggaaccggtacgggtaccgttacggtaaacgtttaacgtttaaccgtggtttaaccgaaacttaccgaacggaccgtaagtaaccggacgggtaccgggttaacgggtaaactttaaaggtaaacggtacgggtttaccggggacggggaaaccgggtaacccggtaaacgggtccggtaaccggtaacccggttacccgttaacgggtaccggtaaccggtacccccggaaagggttccccgtacccggttacccccccggg

SEQ ID NO: 85156 - DNA, 647 bp, Homo sapiens
  misc_feature: GYAE6OF02JFND5.4.34.D01.1.454.CMB.1.raw
  modified_base (382)..(382): a, c, t, g, unknown or other
  misc_feature (382)..(382): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatgctattcgccagaccaatatgacttacgtcggtaccagcaagaacgccgaggccacggcccctgtcgtttgttgttataataagacagtagagacggccctgagggtactccgtgacgcgtattctcgtcggctccgagctacgaacggacaacgngtactacgttacgacctatcgaggtggaacgtccgaggacgaaggaacggacggacggtacgtacgtaacttacgttacgtgtaacctaagttcgaacggacgaacggtacgagggtaccgggttagggtaaacgtttaaagtaacgggttacgggttaccgggacggggaacgggtaaccgaaggtccggttaaccggacccgttaccggtacggtaccgaaccggtaccccggaacgggttccctaccccggttaccccccgg

SEQ ID NO: 85157 - DNA, 507 bp, Homo sapiens
  misc_feature: GYAE6OF02GNH5H.4.34.D01.1.454.CMB.1.raw
  modified_base (315)..(315): a, c, t, g, unknown or other
  misc_feature (315)..(315): n is a, c, g, or t
  modified_base (439)..(439): a, c, t, g, unknown or other
  misc_feature (439)..(439): n is a, c, g, or t
  modified_base (444)..(444): a, c, t, g, unknown or other
  misc_feature (444)..(444): n is a, c, g, or t
tcagagcactgtagcacgaccggtgctcgatttagatcgtctgtgttgggtttgggggtgggtccaggaggcagaactctgggtgtctcaccatggcctggatccctctacttctcccccctcctcactctctgcacaggctctgaggcctcctatgagctgacacagccaccctcggtgtcagtgtccccaggacagacggccaggatcacctgctctggagatgcattgccagaccaaatatgcttactggtaccagcagaagccaggccaggcccctgtgttgttgttatataaagacagtgagaggccctnagggatccctgagcgattctctggctcagctcagggacaacagtcacgttgaccatcagtggagtcaggcaagaagacgagctgactattactgtacaatcagcagacagcggtaggacttaanaaagngttcggacggagggaccaagctacggaccgtccgtaggtcacgcccaaggtctcgtccccccg

SEQ ID NO: 85158 - DNA, 595 bp, Homo sapiens
  misc_feature: GYAE6OF02J1JLZ.4.34.D01.1.454.CMB.1.raw
  modified_base (339)..(339): a, c, t, g, unknown or other
  misc_feature (339)..(339): n is a, c, g, or t
  modified_base (438)..(438): a, c, t, g, unknown or other
  misc_feature (438)..(438): n is a, c, g, or t
  modified_base (458)..(458): a, c, t, g, unknown or other
  misc_feature (458)..(458): n is a, c, g, or t
tcagagcactgtagcacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacacgcccaccctcggtgtcgagtcgtccccaggacacggacggccaggactccacctcgctcgtggagatgacattcgccacgaaccaatatgtcttactgtacagacagacgccgaggccacggccctgtgttgttgttatataagagtagtgagcgaccgtcgaggtactccgngacgcgtacttcgtctcgctccgagtctacggacggacaacgacgtctacgttacgacttagcgtaggtcgtaacgtccgaggacgaagaacggtacgngacgtagtacttaatcgtancgaactgtacgacacgtacgcggtacgggtagttaacgtaacgtaaggtacggtacgggacgggacggtaacgcgtacgtaacggtacccgtacggtacggtacccaacgggaccctacggtccgccccgttcccgg

SEQ ID NO: 85159 - DNA, 535 bp, Homo sapiens
  misc_feature: GYAE6OF02F2MDC.4.34.D01.1.454.CMB.1.raw
  modified_base (223)..(223): a, c, t, g, unknown or other
  misc_feature (223)..(223): n is a, c, g, or t
  modified_base (242)..(242): a, c, t, g, unknown or other
  misc_feature (242)..(242): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattgccagaccaatntgcttactggtaccagcaagaagccaggccaggcccctgtgttgttgtatataaagcagtgagaggccctgagggtactccctgagcgattctctggctcagctcgaggacaacagtcacgttcgaccatcagtggagtccaggcaagaagacgacggctagactatactgtacaatcagcagacagtgggagtacttaagaaagtggttacgggacgggtaacgggaccgaagccgtacgacccggttaccgtaggtccgaacggccccaagggtcctccggtaccccccgg

SEQ ID NO: 85160 - DNA, 526 bp, Homo sapiens
  misc_feature: GYAE6OF02FQ218.4.34.D01.1.454.CMB.1.raw
  modified_base (416)..(416): a, c, t, g, unknown or other
  misc_feature (416)..(416): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgccagaccaatatgcttactggtaccagcagaagccaggccaggcccctgtgttgttgttatataaagacagtgagaggccctcagggatccctgagcgattctctggctccagctcgagggacaacgagtctacgttgaccatcagtggtagtccaggcaggaagacgaggctagactattactntacaactcagcgagacagcggtggacttaagtaagtagttacgggcggaacgggaccaaggcgtacgaccgttccgtaggtccacggacccaagggcctcgtacccccgg

SEQ ID NO: 85161 - DNA, 444 bp, Homo sapiens
  misc_feature: GYAE6OF02G2GBR.4.34.D01.1.454.CMB.1.raw
  modified_base (433)..(444): a, c, t, g, unknown or other
  misc_feature (433)..(444): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgatattttgactggttaagattactactactccggtatggacgtcgtggggccaagggaccacggtcaccgtctcctcagcctccaccgaacggcccatccggtccttccccctggccaccctctcccacgacgcacctaccgtcgggcggacacgcggcccgtcggtcggtcgccgtcgtcgaacgaacgtaccttaccctaccagtgtctctcgagcggcgtgcgacgcgcgactagnnnnnnnnnnnn

SEQ ID NO: 85162 - DNA, 702 bp, Homo sapiens
  misc_feature: GYAE6OF02I8Y7O.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttcctcccccctcctcactctctgcacgaggctctgaggcctcctatgagctgaccacacgcccaccctcggtgtccagtcgtcccccgaggacagaccggccaggactccacctgcctcgtggagatgccagttcgaccagaccaatatcgtacttacgtacggtaccagcaagaacgccgacggcacggcccctgttgttgttcgttaataataaagacagtagagacgccctgacggtactccgtgagctagttcctcgtcggcctacgacgtccgtacggaacggaaccgaaacgtacgtacccgtaacgttacgacctagttacgagtacggtaacgtacccggtaggacgaaacggaaacggacggtacggtacgttacgtaacttagtttacgttacgtaactaacgtacgaacgtacgaaggaaccgtaggggtaccgggtaagggtaaaccgttttaaaaggaacgggtttaacggtccggggtaccggggaaacgggtaacccgtaacggacgttaccggtacccgtaccggttacggtccgaaaccggacccggtaacgtccgtccccggtaccccccgg

SEQ ID NO: 85163 - DNA, 648 bp, Homo sapiens
  misc_feature: GYAE6OF02GYUV2.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattgccagaccaatatgcttactggtaccagcagaagccaggccacggccctgtgttgttgttataagtaagacagtgagacgccctgacgggactcccgtagacgcgtacttctcgtcggccttaccgagccttacgaacggggaaccaaacgtacgtcctaacggttacgaaccgtataccgaaggtacgggacgtccgaagggaccgaaggaaacggacgggaggtaccgtagtaacgttaacgtttaacgttagtacgtaaactcgaacggtacgaacggaaccgacggtacgggttagggtaactttaaaggtaaacggtacgggtttacgggacgggtaacgggtaaccggaacgtacggtacggtaccgtacgtacggtcgaccggaccgtaacggccgtaccggtacccccgg

SEQ ID NO: 85164 - DNA, 476 bp, Homo sapiens
  misc_feature: GYAE6OF02HG0PC.4.34.D01.1.454.CMB.1.raw
  modified_base (456)..(476): a, c, t, g, unknown or other
  misc_feature (456)..(476): n is a, c, g, or t
tcagagcactgtagcacgaccggtgctcgatttagatcgtctgtgttgggtttggggacagcagacctgagagcgctgggcccacagccctcccctcagagccctgctgtctcctccggtcagccctggacatcccaggtttccccaggcctgccggtaggtgtagaatgaggtctgtgtcactgtggtattacgattattttgactggttaagattactactactccggtatggacgtcgtggggccaagggccacggtcaccgtctcctcacgcctccaccgaacgggccagtccggtccttccccctggcctacccctcctaccaagcgcctaccgtcggtcggggccacgacgccggcccgtgggcctcgccgtcggtacgaacggtaccttaccttccctaacgagtcgctcgtggacggtcgggcgtcgggacgacgggcgacagtacgnnnnnnnnnnnnnnnnnnnnn

SEQ ID NO: 85165 - DNA, 732 bp, Homo sapiens
  misc_feature: GYAE6OF02J1ZPJ.4.34.D01.1.454.CMB.1.raw
  modified_base (245)..(245): a, c, t, g, unknown or other
  misc_feature (245)..(245): n is a, c, g, or t
  modified_base (293)..(293): a, c, t, g, unknown or other
  misc_feature (293)..(293): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctcgtggagatgcattgccagaccaaatntgcttacgtggtaccagcaagaagccaggccaggcccctgtgttgttnttaataataaagacagtgagacggccctagagggactcccgtgacgcgtacttcgtcgtcggtcctccgaacgctacggaacgggaaacctaacgtacgtaccgtaacggtttaccggaacctacgtaccgtaacgggttacggggtaaccgttacccggaagggaccggaaagggaaacggaccgggaacgggtacttacgggtaaactttaaacgtttaccgttagtaaccgtaaagttaccgtaacggaccgtaaagggaccggtaacggggtaccggggttaacgggttaaactttaaaccggtaaagggtaccgggttacgggaaccggggttaacgggaacccggtaacggtacggttacccggaaacccgtttccggtaacgggttaccgaaccggaacccggtacggtcccgttacccggtaccccccggg

SEQ ID NO: 85166 - DNA, 565 bp, Homo sapiens
  misc_feature: GYAE6OF02HHX4N.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccacccctcggtgtcagtgtccccaggacagacggccaggatcacctgctctggagatgcattgccagaccaatatgcttactggtaccagcagaagccaggccaggcccctgtgttgttgttatataaagacagtgagaacggccctcgagggactccgtgagcgattctcgtggctcccagctcagggacaagtagtctacgttacgacctatactagtggagtcccgaagggacaggaaagacgacggactagactattacgtagtacaagtcagcagacaggcggtaggtaacgttaataaggtacggttcggagggacgggtaacgaacggtcgtacgtaccgtaccgttacggtacccgacggtacccgaacggtccgtccgtaccccccgg

SEQ ID NO: 85167 - DNA, 417 bp, Homo sapiens
  misc_feature: GYAE6OF02IXMP1.4.34.D01.1.454.CMB.1.raw
  modified_base (376)..(376): a, c, t, g, unknown or other
  misc_feature (376)..(376): n is a, c, g, or t
  modified_base (410)..(417): a, c, t, g, unknown or other
  misc_feature (410)..(417): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgattattttgactggttaagattactactactccggtatggacgtctggggccaagggccaggtcaccgtctcctcagcctccaccaagggcccatcggtcttccccctggcaccctcctccaagacgcacctcgtggggcacagcggccctgggctgcctggtcaaggactacttcccctanagtcgctctgagcgggctggcaaggcgcatacgnnnnnnnn

SEQ ID NO: 85168 - DNA, 444 bp, Homo sapiens
  misc_feature: GYAE6OF02INENQ.4.34.D01.1.454.CMB.1.raw
  modified_base (271)..(271): a, c, t, g, unknown or other
  misc_feature (271)..(271): n is a, c, g, or t
  modified_base (313)..(313): a, c, t, g, unknown or other
  misc_feature (313)..(313): n is a, c, g, or t
  modified_base (339)..(339): a, c, t, g, unknown or other
  misc_feature (339)..(339): n is a, c, g, or t
  modified_base (405)..(405): a, c, t, g, unknown or other
  misc_feature (405)..(405): n is a, c, g, or t
  modified_base (419)..(419): a, c, t, g, unknown or other
  misc_feature (419)..(419): n is a, c, g, or t
  modified_base (424)..(444): a, c, t, g, unknown or other
  misc_feature (424)..(444): n is a, c, g, or t
tcagagcactgtagcacgaccggtgctcgatttagatcgtctgtgttggggtttggggacgagcagacctgagagcgctgggcccacagcctcccctcagagccctgctctctcctccggtcagccctggacatcccaggtttccccaggcctgccggtaggtgtagaatgaggtctgtgtcactgtggtatacgattattttgactggttaagattactactactccggtatggacgtctggggccaagggaccacggtcaccgtctccnctagcctccaccagggcccatcggtctccccctggccacccnccttccagacgcacctcgtcggggcncaacgccggcccgtgggctcgcctggtccaaggactacttccctacagtcgctcgtgaggcgggcnggtcaaggcgccanacggnnnnnnnnnnnnnnnnnnnnn

SEQ ID NO: 85169 - DNA, 425 bp, Homo sapiens
  misc_feature: GYAE6OF02HK0F6.4.34.D01.1.454.CMB.1.raw
  modified_base (418)..(425): a, c, t, g, unknown or other
  misc_feature (418)..(425): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgatattttgactggttaagattactactactccggtatggacgtctggggccaagggaccacggtcaccgtctcctcagcctccaccaagggcccatcggtcttccccctggccaccctcctccaagacgccacctcgtgggggcacgacgccggcccgtgggctgcctggtcaaggtactaccttccctacagtgctctgaggcgggctggcaaggcgcatagnnnnnnnn

SEQ ID NO: 85170 - DNA, 688 bp, Homo sapiens
  misc_feature: GYAE6OF02JF14Z.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactcggtaccagcaagagccgacggccaggcccctgtgttgttgttataataaagactagtgagacggacctcgaggactcccgtgacgcgtacttctacgtcggtcctccgacgctacgaacggaaccaaacgacgttactacggttacgaacctacttacgaaggtagggaccgttacccgaagggacaaagggtaaacgaacgggtacggtacgtaggtaacctttaacgttaacttacggtaactaacgttacaagtaccaaggaaccaaggggttccgggtacgggtaaacgtttaaacgaaagggttacgggttacgggacgggaaacggggtaacccaaagggtaccgttaccggtaaccccggttaacggttaaccgggttaccgaaccgggtaaccccgtaacggggtacccgttacccggtacccccccggg

SEQ ID NO: 85171 - DNA, 585 bp, Homo sapiens
  misc_feature: GYAE6OF02F7ZGB.4.34.D01.1.454.CMB.1.raw
  modified_base (414)..(414): a, c, t, g, unknown or other
  misc_feature (414)..(414): n is a, c, g, or t
  modified_base (466)..(466): a, c, t, g, unknown or other
  misc_feature (466)..(466): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgccagaccaatatgtcttacgtggtaccagacaagaacgccgacggccgacggccccttgttagtttgttagttataagtaaagacaggtgaagacggccctacggagggtactcccgtgagtcgtattctcgtcggcctccagctacgagggaacaacgacgtctacgtcgacctagtacgngtaggacgtacgaggtacaaggaacgacggaggctagtacttaagttacgtntacaatcgacgacgagacgagggtcggtagtaacgttaagaaggtaggtcgggacgggtacggaacaacggtcgtacggtaccgtcgtacggtcacgaccgacgtccgtcccggtcccg

SEQ ID NO: 85172 - DNA, 719 bp, Homo sapiens
  misc_feature: GYAE6OF02GC74T.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctcgtggagatgcattgccagaccaatatgcttactggtaccagcagaagccaggccacggcccctgtgttgttgttatataaagacagtgagaggccctgagggactccctgagcgtattctcgtcggcctccgagtcctacgaacggggaaccaaacgtacgttaccgtaccggtttacgaacccgtataccgtaaggttagggtaaccggttacccgaagggacccgtaaagggaaaccggaaccgggacgggtaccgttacggtaacctttaacgtttaaccgttacggttaacctaaacgttccgaacggaccgtaaacggaaccgtaacgggtaccggggttaacgggtaaacctttaaaaggttaaacgggtaacgggtttaccgggaaccggggtaacgggaaacccgtaacgggtaccgtaacgggtaacccgttaccggttaccgggtaccaacccggtaccccggaacgggtcccgtcccggtacccccccggg

SEQ ID NO: 85173 - DNA, 562 bp, Homo sapiens
  misc_feature: GYAE6OF02IPWRQ.4.34.D01.1.454.CMB.1.raw
  modified_base (430)..(430): a, c, t, g, unknown or other
  misc_feature (430)..(430): n is a, c, g, or t
  modified_base (468)..(468): a, c, t, g, unknown or other
  misc_feature (468)..(468): n is a, c, g, or t
  modified_base (533)..(533): a, c, t, g, unknown or other
  misc_feature (533)..(533): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtcccccaggacaggacggccaggatccacctactctggagatgacattcgaccataccagccaagaacgtcagccacggccccttgtcgtggtacattcgtgtggacacaaccgaaaccgccccgtcgggactccctagacgatacttctcgtggcctcagctcgagggacaagtcggacctactagactgtcagggtcgggcccagggtggagatacgaactgtactatattcgtactacaanagacagcagtcgtatactcgtaggtcgggtggtacggnggtagatcgacgtcgacgtaccgtcgacggtacaccggccgtaacggcctacccgcccgtcgtcnccttcgtccttcccctcccttccgtaccc

SEQ ID NO: 85174 - DNA, 452 bp, Homo sapiens
  misc_feature: GYAE6OF02IH0YU.4.34.D01.1.454.CMB.1.raw
  modified_base (322)..(322): a, c, t, g, unknown or other
  misc_feature (322)..(322): n is a, c, g, or t
  modified_base (328)..(328): a, c, t, g, unknown or other
  misc_feature (328)..(328): n is a, c, g, or t
  modified_base (377)..(377): a, c, t, g, unknown or other
  misc_feature (377)..(377): n is a, c, g, or t
  modified_base (407)..(407): a, c, t, g, unknown or other
  misc_feature (407)..(407): n is a, c, g, or t
  modified_base (413)..(413): a, c, t, g, unknown or other
  misc_feature (413)..(413): n is a, c, g, or t
  modified_base (416)..(452): a, c, t, g, unknown or other
  misc_feature (416)..(452): n is a, c, g, or t
tcagagcactgtagcacgaccggtgctcgatttagatcgtctgtgttgggtttgggacagcagacctgagagcgctcgggcccacagcctcccctcagagccctgctgtctcctccggtcagccctggacatcccaggtttccccaggcctgccggtaggtgtagaatgaggtctgtgtcactgtggtattacgattattttgactggttaaagatttactactactccggtatggacgttctgggggccaagggaccacggtcacccgtctcctcagcctccaccaaggccatcggcttccccctgcaccctcctccaagngcaccnctggggcacagcgccctgggctagcctggtcaaggacctactcccgtanacgtgctcttgacgcgggctggcaagggcncatagnagnnnnnnnnnnnnnnnnnnnnnnnnnnnnnnnnnnnnn

SEQ ID NO: 85175 - DNA, 580 bp, Homo sapiens
  misc_feature: GYAE6OF02FTCKZ.4.34.D01.1.454.CMB.1.raw
  modified_base (223)..(223): a, c, t, g, unknown or other
  misc_feature (223)..(223): n is a, c, g, or t
tcagagcactgtagcacgaccggtgctcgatttagatcgtctgtgttgggtttgggggtgggtccaggaggcagaactctgggtgtctcaccatggcctggatccctctacttctcccccctcctcactctctgcacaggctctgaggcctcctatgagctgacacagccaccctcggtgtcagtgtccccaggacagacggccaggatcacctgctctgganatgcattgccagaccaatatgcttactggtaccagcagaagccaggccacggcccctgtgttgttgttatataaagacagtgagacggccctcgagggactccctgacgcgtattctctggctccgagctacgagggaccaacgacgtcgaacgttcgacctagtacgaggtcggacgtcccgaaggcaaggaacgacggaggactgaacttagttacgtgtacaatacgacgacagacgaggtacggtaggtacttaagaaagtcggttacgggacggacgggtaaccaaggtccgtacgtaacccgtaccgttaaggtccgacggtaccccgaaggtccctaccggtccccccgg

SEQ ID NO: 85176 - DNA, 632 bp, Homo sapiens
  misc_feature: GYAE6OF02FXX0M.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgtacaggctctgaggcctcctatgagctgacacagcccaccctcggtgtcagtgtccccaggacagacggccaggatcacctgctctggagatgcattgccagaccaatatgcttactggtaccagcagaagccaggccacggcccctgtgttgttgttatataaagacagtgagacggccctagagggactcccgtgacggcgacttctcgtggcctccagctcgagggaacacgagtctacgttgaccatcgaggtcggacgtaccgaggtacgaaggaacggacggaggtacgtagtaaccttaagtttacgtcgtactaaacttccgaagaccgtaacgaacgtacgggtacgggttacgggtaaacctttaaaggtaaaagggtaccgggttacgggacgggtaacgggaaccgtaaacggcgttaccggtacccgttaccgtaacgggtaccgacggaccccggtaaggcccgttaccggcccccgttacccgg

SEQ ID NO: 85177 - DNA, 579 bp, Homo sapiens
  misc_feature: GYAE6OF02HQ1DG.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatagtaaagacagtgagacggccctgagggactccctgagcgtattctctggcctccagctacgagggaacaacgacgtactaacgttagaaccctataccgaaggtggaacgttccgaaggacaaggaagacggaggctagacttaattactgacaagtcaagtcaagacgagcggttagggaacttaagtaaaggtaggttcgggaacgggaacgggtaaccaagggtctacgggacccgttaccgtagggtaccacggaccccggaagtccgtaccggtccccccgg

SEQ ID NO: 85178 - DNA, 662 bp, Homo sapiens
  misc_feature: GYAE6OF02IYYFY.4.34.D01.1.454.CMB.1.raw
  modified_base (222)..(222): a, c, t, g, unknown or other
  misc_feature (222)..(222): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgagcctcctatgagctgacacagccaccctcggtgtcagtcgtccccaggacagacggccaggatcacctgctctgganatgacattgccagaccaatatgcttacgtcggtaccagacaagaacgccgaggccacggccccgttgttgtttgttagttaataacgtaaagacagtgaggacggtccctagagggactcccgtggacgcgtacttctccgtggtcctaccgagttaccgacggtaaacgggaccaaaccgtacgttccgtaacggtttacgaacccgtaacgtaccgtaagggttcggacggttaccgaaggaccgtaaggaaacggtacggaggtaccgtacgtaacttaaacgtttacgtacgtactaatacgaacgacgaacgaacgtaggccgggttaggtaacgttaaagtaaggtacggttacgggaacggacggggaacctaaggaccgtacgaccgttacggtacggccgtaccggaccgaacggtccgtcccgtaccccg

SEQ ID NO: 85179 - DNA, 423 bp, Homo sapiens
  misc_feature: GYAE6OF02HSSYL.4.34.D01.1.454.CMB.1.raw
  modified_base (322)..(322): a, c, t, g, unknown or other
  misc_feature (322)..(322): n is a, c, g, or t
  modified_base (411)..(423): a, c, t, g, unknown or other
  misc_feature (411)..(423): n is a, c, g, or t
tcagagcactgtagcacgaccggtgctcgatttagatcgtctgtgttgggtttggggacagcagacctgagagcgctgggcccacagccctcccctcagagccctgctgtctcctccggtcagccctggacatcccaggtttccccaggcctgccggtaggtgtagaatgaggtctgtgtcactgtggtattacgattattttgactggtaaagattactactactccggtatggacgtcgtggggaccaaagggaccacggtcaccgtctcctcagcctccaccaaggcccatcggtctcccctggcaccctcctccaagngcacctcgtggggcacagccggccctgggctgcctggtacaacggactacttccctacagtgctctgagcggctggcaaggcgcatagnnnnnnnnnnnnn

SEQ ID NO: 85180 - DNA, 596 bp, Homo sapiens
  misc_feature: GYAE6OF02JA8HM.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctcccccctcctcactctctgcacaggctctgaggcctcctatgagctgacacagcccaccctcggtgtcagtcgtccccaggacagacggccaggactcacctgctctggagatgcattgccagaccaatatgtcttactggtaccagcaagaacgccgacggccacggcccctggtgtttgttagttataagtaaagacagtagagacggccctgagggactcccgtgacgcgtattctcgtcggcctccgagtcctacgaacgggacaacgagtaccacgttacgacctatcgtaaggtcggacgtccgagggacgaacggaagaccggaggtctagtaaccgttaattaccgtgtaacaatccgagtacgaacgacgacggtacgggtggtaactttaagaacggtagttccggacggacggaacaacgtcgtacgtaccgtcgtacggccaccgaccgaacggccgtacccgtccccg

SEQ ID NO: 85181 - DNA, 459 bp, Homo sapiens
  misc_feature: GYAE6OF02JHXCO.4.34.D01.1.454.CMB.1.raw
  modified_base (426)..(459): a, c, t, g, unknown or other
  misc_feature (426)..(459): n is a, c, g, or t
tcagagcactgtagcacgaccggtgctcgatttagatcgtctgtgttggggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgatattttgactggttaagattactactactccggtatggacgtctggggccaagggaccacggtcaccgtctcctcagcctccaccaacgggcccatcggtcttccccctggccaccctcctccaagagccacctcgcgggggcacacgcgggccctgggctcgcctggtccaaggactacttcccctacagtgctcgtgagcggggctggactaagggcgcgtaatacgnnnnnnnnnnnnnnnnnnnnnnnnnnnnnnnnnn

SEQ ID NO: 85182 - DNA, 732 bp, Homo sapiens
  misc_feature: GYAE6OF02GTGEI.4.34.D01.1.454.CMB.1.raw
  modified_base (224)..(224): a, c, t, g, unknown or other
  misc_feature (224)..(224): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgganatgcattgccagaaccaatatgtacttacgtcggtaaccagacgagaacgcccgacggtcccgaacggtcccccgttggtttggttttaggtttagtttaactaaagtaaaacggacgtaaggtacgacggaaccggtccccgtagaacggggtacctcccgtagacgtccgtacttcttcgtcggcctaccgacggtcctaccgggaacgggaaccaaaccgtacggttacccgtaacgggtttaccgaaccctaagttaccggaagggttacggggtaaccgtaccggaggaacgtaaggaacggacggtacggtactacggtaacttacgttacgtagtacaacgtacgacgacgaacgacgtacgggtacggtacggtaaacgttaaagtaacggtaccgggttacggggacgggtaacggaacggaacgtccggtacggttacccgttaccggtacggtaccggaaccggtaccccggtaacggcccgttacccgtcccccgg

SEQ ID NO: 85183 - DNA, 758 bp, Homo sapiens
  misc_feature: GYAE6OF02HI1TS.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctcccccctcctcactctctgcacaggctctgaggcctcctatgagctgacacagcccaccctggtgtcagtgtccccaggcagacggccaggatcacctgcctctggagatgcattgccagaccaatatgcttactcggtaccagacagaacgccgaggcccgacggcccccttaggttcgtttgtttagttaataagtaaagactaggtgaagacggcccgtacgacgggactcccgtagacgcgtattctcgtcggtcctccgacgtccgtacgaacggggtaaccaaacgtacgttaccgtaaccggtttacgaacccgtacttaccgtaagggttacgggtacgtacccggtaacggacggaaacggtaaacggaacggtacggggtaccttacggtaaccgtttaacgttttaacgtacgtttaaccgaaacgtttaccgaacggtaccgaaacggtaaccggaacgggttacggggttaaccgggttaaacgtttaaacggttaaagggttaccgggttaccggggaacgggttaccggggaaaccgtacgggtaccgtaaccggtacccggtttaccgtaccgggttaccgacccggtaaccccggaacgggttccccgtacccggttaccccccgg

SEQ ID NO: 85184 - DNA, 734 bp, Homo sapiens
  misc_feature: GYAE6OF02FF23W.4.34.D01.1.454.CMB.1.raw
  modified_base (226)..(226): a, c, t, g, unknown or other
  misc_feature (226)..(226): n is a, c, g, or t
tcagagcactgtagcacgaccggtgctcgatttagatcgtctgtgttgggtttgggggtgggtccaggaggcagaactctgggtgtctcaccatggcctggacccctctcctgctcccctctcactttctgcacagtctctgaggcctcctatgagctgacacacgccaccctcggtgtcagtcgtaccccaggaccaaacggccaggactcacctactctggganatgctattcgccataccagcaagaacgtcacgaccacggccctagttctcggtcatctgtggagactaccaaaccgcccgtaccgggactcccgtgacgacgtattaccgtcgtggtccctccgacgtccgtacgtacgggacaacggtcggaccctaccgttcgaactacgttacgacgggttacggggccccgaaggggttcggggaagggtacgtacggtaacccgttagaaccttaacgttaacgttttacgtttaaccgttacaaaccgtacgaaccgacgtacgaagtacggttacctaaactacgtagggttgggggtttacggttaccgggacgggaggggtaaccgttacggaaacgttcggtaccgtacccggttaccgttacggtccgtacggaccccgtaacgggtccctcccgggtacccccgttaccggtccgttaaccgttcccgttaccggttacccccctacccgttaccccctaccgtaccgttacccgg

SEQ ID NO: 85185 - DNA, 496 bp, Homo sapiens
  misc_feature: GYAE6OF02GBXI4.4.34.D01.1.454.CMB.1.raw
  modified_base (452)..(452): a, c, t, g, unknown or other
  misc_feature (452)..(452): n is a, c, g, or t
  modified_base (456)..(456): a, c, t, g, unknown or other
  misc_feature (456)..(456): n is a, c, g, or t
  modified_base (458)..(496): a, c, t, g, unknown or other
  misc_feature (458)..(496): n is a, c, g, or t
tcagagcactgtagcacgaccggtgctcgatttagatcgtctgtgttggggtttgggggacagcagacctgagagcgctgggcccacagcctcccctcagagccctgctgtctcctccggtcagccctggacatcccaggtttccccaggcctgccggtaggtgtagaatgaggtctgtgtcactgtggtattacgattattttgactggttaagattactactactccggtatggactcgtggggccaagggccacggtccaccgtctcctcagcctccaccaagggcccatccggtcttccccctggccacccctcctcccaagacgcacctcgtcgggggcacgacgccggcccgtgggcctgccgtggcgaaacggacctacctttccctacgtaagtcgctctaggaggccgggaccgtggaccgaaaggcgacgtaagtaacggcnagcncnnnnnnnnnnnnnnnnnnnnnnnnnnnnnnnnnnnnnnn

SEQ ID NO: 85186 - DNA, 691 bp, Homo sapiens
  misc_feature: GYAE6OF02GZ2XU.4.34.D01.1.454.CMB.1.raw
  modified_base (373)..(373): a, c, t, g, unknown or other
  misc_feature (373)..(373): n is a, c, g, or t
tcagagcactgtagcacgaccggtgctcgatttagatcgtctgtgttgggtttgggggtgggtccaggaggcagaactctgggtgtctcaccatggcctggatccctctacttcctccccctcctcactctctgcacaggctctgaggcctcctatgagctgacacagcccacccgtcggtgtcagtcgtccccgaggacaggaccggccaggatccactgctcgtggagatgactattcgaccagaacctaatattcgtccttacgtacggtaaccagacgaagacgccgacggccgaccggtcccttggtgttgttagttaataataaacgacgtaggtgacggacggtccctacggacgggtactcccgnggaacgtcgtacttccgtcgtcggtacctccgacgtaccgtacggaacggaccaacgtacgtaccgtacgtacgaccgtacgtacgtacggtacggtacgtaccgacggtacgaacggaacggacggtacggtacgtacgtacgttaacgttacgtacgtacgtaactacgaacgacgacgacgacggtacgggtacggtaacgttaaaggtaaggtacggttacgggtacgggaacgggtaacggaacggtaccgtacggtaccgtaccggtacggtaccgaccgacggaccccccccggtagtcccggtaccccgg

SEQ ID NO: 85187 - DNA, 678 bp, Homo sapiens
  misc_feature: GYAE6OF02JLT0P.4.34.D01.1.454.CMB.1.raw
  modified_base (203)..(203): a, c, t, g, unknown or other
  misc_feature (203)..(203): n is a, c, g, or t
  modified_base (215)..(215): a, c, t, g, unknown or other
  misc_feature (215)..(215): n is a, c, g, or t
  modified_base (220)..(220): a, c, t, g, unknown or other
  misc_feature (220)..(220): n is a, c, g, or t
tcagagcactgtagcacgaccggtgctcgatttagatcgtctgtgttgggtttgggggtgggtccaggaggcagaactctgggtgtctcaccatggcctggatccctctacttctcccctctcactctctgcacaggctctgcgcctctatgagctgacacagccctaccgtcggtgtcagtcgtcccaggacagacgcaggntccacctgctcnggatntcgctagtcgaccacgaacctaatctcgtaccgttacgtacggtaacccagaccgaaggtaaccgccgaacggtcccgacggtccccgttggttcgttaggttttataataacgttaaagaccgtaggtaggacggaccggttccctaggacgggtccgtccctaggtaccgacgttagttcctcgtacggccttcgacgtcgtacgaggaaccctaagtccggtactacggttacacgttactacggtacgtacgtaacgtcgagtaacgaacgtacgacgacgtacgtacgtacgtacttacgcgttaaactcgtacgtacggactacgaacgtacgggtacgtaacggtaacgtaaaggttacggaccgttacgggaccgtacggtaacgtacggtacggtaaccttacggaacgttacggacggtacctacggtactcccggtacccgtaccgg

SEQ ID NO: 85188 - DNA, 580 bp, Homo sapiens
  misc_feature: GYAE6OF02GGVMJ.4.34.D01.1.454.CMB.1.raw
  modified_base (424)..(424): a, c, t, g, unknown or other
  misc_feature (424)..(424): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgcagaccaatatgcttactggtacagcagaagccaggccaggccctgtcgttgttgttatataaagacagtgagaggccctcgaggactccctgagcgtattctctggctccgagcgtacgaggacaacgagtcacgttcgactagtcagtcggacgtccgagacagaacgacgaggctacgactagttacgtntacaatcagcagacaggtcggtagggtaacttaagtaaaggtacggttacgggacgggaaccgggtaaccgaacggtccgttacggtaacccggttacccgttaacgggtaccgaccggaccccggtaacgggttcccgtcccggtacccccccgg

SEQ ID NO: 85189 - DNA, 700 bp, Homo sapiens
  misc_feature: GYAE6OF02JU4GR.4.34.D01.1.454.CMB.1.raw
tcagagcactgtagcacgaccggtgctcgatttagatcgtctgtggttgggtttgggggtgggtccaggaggcagaactctgggtgtctcaccatggccgtggactccctctacttcctcccctcctcactctctgcacaggctcgtgacggtcctcctatgagcgtaccacagccaccctcggtgtccagtcgtcccaggacagacggccaggactcacctgactcgtggagatgcacttggaccaagaccatactcgcttactggtacagcacggtagcccaggcctaggtccctgttcgttagtaccgtaagactttaagttacgcgggtccacgggtaggtccctcgaagggactcccgtgacccggttaccgttctacggtcgtcccaaggtcgtacctacggtacgaacctagtacgtactcgtacgtacgaagtaccgtaggaacggttaaccggaacggacgaacgacgtaacgtacgtacgttacgaaccgtaattacgtacgtacgaacgtacgaacggtacgtaacgtaacggaacggtacggtacgggtacggtttaacgaaacggtaacggtacggtacggacgggtacccgaacgggttacccgggtaaccgtggggtaaccgttaaggtcccgtacgggaccccgtcggtacccctacccggtttccgtaccgttcccgtacccg

SEQ ID NO: 85190 - DNA, 593 bp, Homo sapiens
  misc_feature: GYAE6OF02IWE6R.4.34.D01.1.454.CMB.1.raw
  modified_base (223)..(223): a, c, t, g, unknown or other
  misc_feature (223)..(223): n is a, c, g, or t
  modified_base (299)..(299): a, c, t, g, unknown or other
  misc_feature (299)..(299): n is a, c, g, or t
  modified_base (341)..(341): a, c, t, g, unknown or other
  misc_feature (341)..(341): n is a, c, g, or t
tcagagcactgtagcacgaccggtgctcgatttagatcgtctgtgttgggtttgggggtgggtccaggaggcagaactctgggtgtctcaccatggcctggatccctctacttctcccccctcctcactctctgcacaggctctgaggcctcctatgagctgacacagccaccctcggtgtcagtgtccccaggacagacggccaggatcacctgctctgganatgcattgccagacaatatgcttactggtaccagtacaagaacgccaggccacggcccctgtgttgttgttaatanaaagacagtgagaggccctacgaggactccgaggtcgacgtnttactcgtcggtcctacacgcctacgaggaaccaacacgtccgtacggttagaacccagttacgagtagggaccgttacgagggacaaacggaagacgggaggacgtgtaacttacgtaaccgttgtaccaatcaacgtcagacgtaaggcggtaaggtacttaaaggtaacgttaggttacgggaccgggtacggaacgtaacgcgtacgaccgtctacggtcgaccgacccgacgaccgtccgtaccccg

SEQ ID NO: 85191 - DNA, 734 bp, Homo sapiens
  misc_feature: GYAE6OF02IHK1T.4.34.D01.1.454.CMB.1.raw
  modified_base (169)..(169): a, c, t, g, unknown or other
  misc_feature (169)..(169): n is a, c, g, or t
tcagagcactgtagcacgaccggtgctcgatttagatcgtctgtgttgggtttgggggtgggtccaggaggcagaactctgggtgtctcaccatggcctggatccctctacttctcccccctcctcactctctgcacaggctctgacggccctcctatgagctgacacngcccaccctcggtgtcagtcgtcccaggacagacgcaggatcacctgctcgtggagatgactattcgccagaaccaatagtgtacttaacgtcgtaaccagacaagaacgcacggaccgacggccccttgttgtttagttagttaattaagtaaacgacgtaggtgaacggacgtaccgacgtaacgggtactcccgtaggacgacgtacttcgtacgcgtacctccgtacgaccgttacggaacggtaaaccgtaacgtacgtaaccgtacggttacgaaccgtactacgtacggtacggtacgacgtaacggacgtaaagggaaccggaaaggaccggtacgtaacgttaacgttaatttaccgtacggtaaactaactacgaacgaccgtaaagaccggtacggttacggggttaaacgggtaattaaaaacgggttaagttaccgggttaccggggaacgggtaacgggaaccgtaacgtaccggtacggttacccggtaccgttacgggtaccgaacccgggtaacccgtaacgggttccccgtacccggtaccccccgg

SEQ ID NO: 85192 - DNA, 703 bp, Homo sapiens
  misc_feature: GYAE6OF02FVCOJ.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgctattcgccagaccaatatgtcttacgtggtaccagacaagaacgccgaggacccgacggtcccctggttggttgttagttactaataaagacaggtagacggacggccctacgagggactcccgtggacgtcgtattccgtcgtggtcctccgagcctacgagggaaccaacgtagtaccgtacgttacgacctagtccggtaggtcgggtacgtccgaacgggacaaggaaacggaacggaggtccgtagtaacttacttacgtacgtaacaattccgaagacgagtaaccgagggtaccggggttaacggtaacgtttaaacgtaacgggttacgggttaccggggaacggggtaaccgggtaaaccggtaaccggtaccggttaacccgggtaacccggtttaacccggttaacgggtacccgaaacccggtaccccgggtaacggtcccggttaccccggttaccccccgg

SEQ ID NO: 85193 - DNA, 729 bp, Homo sapiens
  misc_feature: GYAE6OF02GWTXT.4.34.D01.1.454.CMB.1.raw
  modified_base (467)..(467): a, c, t, g, unknown or other
  misc_feature (467)..(467): n is a, c, g, or t
tcagagcactgtagcacgaccggtgctcgatttagatcgtctgtgttggggtttgggggtgggtccaggaggcagaactctgggtgtctcaccatggcctggatccctctacttcctccccctcctcactctctgcacaggctctgaggcctcctatgagctagacacagccacccgtcggtgtcagtcgtccccaggacaggacggccaggactccacctgactcgtggacgtatgctattcgaccacgaacctaatatcgtaccttacgtacggtaaccagacgaagaacgccgacggcccgaccgtcccgtggttcgtttaggtttagttaattaagtaaacgacgtaggtacggtaacggaccggtacccgtacgaacgggtactacccgtaggaccggtcgtttactcgtacgtcggtacctcgactctacggaacggaacacgacgtctacgtacaccgancgtaggtagacgtacgagacaaggacgggagaggtactaggtaactttacgttaacgtcgtaacctaagtacgaacgtaccgtacggaacgtcgggttaccgggttaacggttaaagttaaaaaggtacggtacgggttaccgggaacccggggtaagggaaacccggtagtaacccgggttaccgtacccggtttaaccggtaacggccggttaaacccggtccgggtaacccggttccccgacccggttacccccccggg

SEQ ID NO: 85194 - DNA, 432 bp, Homo sapiens
  misc_feature: GYAE6OF02F7BDW.4.34.D01.1.454.CMB.1.raw
  modified_base (239)..(239): a, c, t, g, unknown or other
  misc_feature (239)..(239): n is a, c, g, or t
  modified_base (418)..(432): a, c, t, g, unknown or other
  misc_feature (418)..(432): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgatattttgactggttaagattactactactccggtatggacgtcnggggccaagggaccacggtcaccgtctcctcagcctccaccaagggcccatcggtccttccccctggccacccctcctccaagacgcacctcgtgggggccacagccggccctgggctgcctggtacaaggactacttcccacagtgctctagagccgggctggacaaggcgcagtagnnnnnnnnnnnnnnn

SEQ ID NO: 85195 - DNA, 453 bp, Homo sapiens
  misc_feature: GYAE6OF02FSKJ9.4.34.D01.1.454.CMB.1.raw
  modified_base (438)..(453): a, c, t, g, unknown or other
  misc_feature (438)..(453): n is a, c, g, or t
tcagagcactgtagcacgaccggtgctcgatttagatcgtctgtgttgggtttgggggacagcagacctgagagcgctgggcccacagcctcccctcagagccctgctgtctcctccggtcagccctggacatcccaggtttccccaggcctgccggtaggtgtagaatgaggtctgtgtcactgtggtattacgattattttgactggttaagattactactactccggtatggacgtcgtggggaccaagggaccacggtccaccgtctcctcagcctccaccaagggcccatcggtccttccccctggccacccctcctcccaagagccaccgtcgtcgggggcaccgacgccggccctgggctcgcctggtcaaggacctaccttcccctacagtcgctctggacggcgggcgtggcgaacggccgacagtagnnnnnnnnnnnnnnnn

SEQ ID NO: 85196 - DNA, 675 bp, Homo sapiens
  misc_feature: GYAE6OF02HWJAH.4.34.D01.1.454.CMB.1.raw
  modified_base (238)..(238): a, c, t, g, unknown or other
  misc_feature (238)..(238): n is a, c, g, or t
  modified_base (545)..(545): a, c, t, g, unknown or other
  misc_feature (545)..(545): n is a, c, g, or t
  modified_base (554)..(554): a, c, t, g, unknown or other
  misc_feature (554)..(554): n is a, c, g, or t
tcagagcactgtagcacgaccggtgctcgatttagatcgtctgtgttgggtttgggggtgggtccaggaggcagaactctgggtgtctcaccatggcctggatcccctctacttctccccctcctcactctctgcacaggctctgaggcctcctatgagctgacacagcccaccctggtgtcacgtcgtccccaaggacacggacggccgaaggactccaccgttgcttccgtggganagttcgctagttccgccaagaacctaatacttcgtacttaccgtggtaccagacgagaacgccgacgccgacggtccccttggttgtttagttacgttaagtaataaagacaggtggagaccggtcctaggacggacgtccgacgacgtcgtacttctacgtcggtctaccgcgtacgtcgacgggaacaacggtacttcgtacgtacgtacacgtcggtaggtcggaccggtaacgacgggaaacgtacggaacgtaacggaggtaccgttacgtacgttaactttacgacgttaactactccganacggaacgnggtacgggcgggtaacggttaaagtaagttaacggagggttacggacggtaacggaaccgaggtcgaccggtacccgtgtacggcgtaccgtaacccggtacgtcccgtcccgtaccccgg

SEQ ID NO: 85197 - DNA, 567 bp, Homo sapiens
  misc_feature: GYAE6OF02GK30H.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccacggcccctgtgttgttgttatataaagacagtgagaggccctagagggactcccgtgacgcgtattctctggcctcacgctacgagggacaacgagtcacgttcgacatcagtggacgtccaggcaagaacgacgaggactgaacttattacgtgtacaatcgagcaagacaggtacgggtaggaacttaagtaaagtacggttacggacgggaacgggtaacccaaggccgtacggaacccggttaccgtagggtccgaaccggacccgtaacggcccgtacccggtccccccgg

SEQ ID NO: 85198 - DNA, 619 bp, Homo sapiens
  misc_feature: GYAE6OF02H4OR6.4.34.D01.1.454.CMB.1.raw
  modified_base (259)..(259): a, c, t, g, unknown or other
  misc_feature (259)..(259): n is a, c, g, or t
tcagagcactgtagcacgaccggtgctcgatttagatcgtctgtgttgggtttgggggtgggtccaggaggcagaactctgggtgtctcaccatggcctggatcccctctacttctcccccctcctcactctctgcacaggctctggaggccttcctatgagctgacacagcccacccgtggtgtcaggtcgtaccccaggacagacggccaggactcgaccttgctcgtgggaatgcagttgccgagacctaatatcncttacgtacggtacagcagacgcacggccacggtccctgtcgtttgttgttaataagtaaagacagtgacggtacgccgtagagggtactcccgtagacgtcgtacgttcgtcgtacgctaccgacgtctacgaggaacaacgagtcgtacgttagaacctatcgagtggacgtcgagacgaagacggagacgcgtagacttacgttagactatatacgagacgaacggacacgggcggttaagggtaaccttaaggtaacgggtacgttacggggacgggaacggtaccgacggtccgtacggtacccggttacgtaacggcgtaaccggacccgtaaggtcccgtacccgtaccccgg

SEQ ID NO: 85199 - DNA, 536 bp, Homo sapiens
  misc_feature: GYAE6OF02FJC40.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgctactggtaccagcagaagccaggccacggcccctgtgttgttgttatataaagacagtgagagccctcgagggactccctgagcgattctctcggctccagtctcgagggacaacacgtcacgttagaccatcaggtggacgttccaggcaaggaagacggaaggctagacttattactgtacaatcgagcaagacgagcggtacggacttaataagtacgttacggacgggacggaccgtaagcctacggaccgtactacgggtcacggtacccacggtctccgtcccccg

SEQ ID NO: 85200 - DNA, 622 bp, Homo sapiens
  misc_feature: GYAE6OF02HGR67.4.34.D01.1.454.CMB.1.raw
  modified_base (140)..(140): a, c, t, g, unknown or other
  misc_feature (140)..(140): n is a, c, g, or t
  modified_base (146)..(146): a, c, t, g, unknown or other
  misc_feature (146)..(146): n is a, c, g, or t
  modified_base (223)..(223): a, c, t, g, unknown or other
  misc_feature (223)..(223): n is a, c, g, or t
  modified_base (227)..(227): a, c, t, g, unknown or other
  misc_feature (227)..(227): n is a, c, g, or t
  modified_base (242)..(242): a, c, t, g, unknown or other
  misc_feature (242)..(242): n is a, c, g, or t
  modified_base (259)..(259): a, c, t, g, unknown or other
  misc_feature (259)..(259): n is a, c, g, or t
  modified_base (280)..(280): a, c, t, g, unknown or other
  misc_feature (280)..(280): n is a, c, g, or t
  modified_base (303)..(303): a, c, t, g, unknown or other
  misc_feature (303)..(303): n is a, c, g, or t
  modified_base (311)..(311): a, c, t, g, unknown or other
  misc_feature (311)..(311): n is a, c, g, or t
  modified_base (365)..(365): a, c, t, g, unknown or other
  misc_feature (365)..(365): n is a, c, g, or t
  modified_base (418)..(418): a, c, t, g, unknown or other
  misc_feature (418)..(418): n is a, c, g, or t
  modified_base (426)..(426): a, c, t, g, unknown or other
  misc_feature (426)..(426): n is a, c, g, or t
tcagagcactgtagcacgaccggtgctcgatttagatcgtctgtgttggggtttgggggtgggtccaggaggcagaactctgggtgtctcaccatggcctggatccctctacttcctcccccctctcactctctgcacgnggcctngacggcctcctagtgagctgacacagcccacccgtggctccgagtccgtaccccaggacaggaccggccaaggctcncgtncctgtggatatcganattcgcagtaccaagtntgtacttctcggacagcgaanacgcgtagcctcggcctgttgtnttagttanacaaagtagaggtaggacgacgtccgtaggtaccgtcgtccgtaaggcgtcctnttcctgttaccgcctacgcgtacgccgaagaccgaacgtacgtctcggtaacncgttaacncggacgtcgtacgcgacggacgagtacggatggactagtacgttacgactcgactaagtacgacgcaggtaccgtcggtacggttaagtaaccgttaaggacgttacggggtacgaaccgggacggtcgtaaaccggcgtaccggtacgtaggacccgttcggaacccggtccggtaacggtcccgtaccgccggg

SEQ ID NO: 85201 - DNA, 480 bp, Homo sapiens
  misc_feature: GYAE6OF02GDD4Z.4.34.D01.1.454.CMB.1.raw
  modified_base (454)..(454): a, c, t, g, unknown or other
  misc_feature (454)..(454): n is a, c, g, or t
  modified_base (456)..(480): a, c, t, g, unknown or other
  misc_feature (456)..(480): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtgtattacgattattttgactggttaagtattactactactccggtatggacgtcgtggggccaagggaccacggtccaccgtctcctcacgcctccaaccgacggcccagtccggtcccttccccgcggcctacccctcctccaagacgccaccgtcgtggggcacgacggccgccgcgggctcgccgtaggtaccgaacggtaccttaccttcctacgtacgtcgctcgtaggacggcgggcgtcgggacgtaacgggcgacagtagnannnnnnnnnnnnnnnnnnnnnnnnn

SEQ ID NO: 85202 - DNA, 662 bp, Homo sapiens
  misc_feature: GYAE6OF02HAWEK.4.34.D01.1.454.CMB.1.raw
  modified_base (165)..(165): a, c, t, g, unknown or other
  misc_feature (165)..(165): n is a, c, g, or t
  modified_base (196)..(196): a, c, t, g, unknown or other
  misc_feature (196)..(196): n is a, c, g, or t
  modified_base (408)..(408): a, c, t, g, unknown or other
  misc_feature (408)..(408): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacanagccaccctcggtgtcagtcgtcccaggacngacggccaggatcacctgctctggagatgcattgccagaccaatatgctttacgtggtaccagcaagaacgcgacgcacggccctgtgttcgttgttataataaagacagtgagacgcctgaggatccctgacgcgtatctcgtggctcgacgctcgaaggtaacaatagtactacgttacacctaagtcaaggtcgacgtccgtaacgganaacgtaaggaacggtacggtaccgtaagtaacttaattaaccgttactaactaacgtactacgacaacgtaccgaagggaccgggttaagggtaactttaaaagtaaacggttaccggggttaccggaacgggggaaaccggtaaccggtaaacggttacggttaacccgggaacccgtttaccggttaaccgggtcctaacccgggtaaccccggtaaaccgggttacccgttacccccggttaacccccggg

SEQ ID NO: 85203 - DNA, 630 bp, Homo sapiens
  misc_feature: GYAE6OF02GOAC6.4.34.D01.1.454.CMB.1.raw
  modified_base (358)..(358): a, c, t, g, unknown or other
  misc_feature (358)..(358): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctctggagatgcattgccagaccaattatgcttactggtaccagcagacgcgaggccacggcccctggttgttcgtttagttataataaagacaggtgagacggccctgagggatcccgtagagcgtattctcgtggctaccgngctcgaacgggacaacgtacgtacgtaacgttcgaccctacgtcgtacggtcggtacgtacccgagggacgaaggaaaccgaacgggaggcctaggtaaccttattacgttcgtacgaacttcgagacgagaccgagggtacgggtgggtaacttaaagtaacgtacgggttacggggagggtaaccgggaacgaacggttccgtacggtaacccgttaccggtaacggtcccgaacggtccccgtaacggtccgttaccccggtcccccgg

SEQ ID NO: 85204 - DNA, 508 bp, Homo sapiens
  misc_feature: GYAE6OF02GRYWK.4.34.D01.1.454.CMB.1.raw
  modified_base (470)..(471): a, c, t, g, unknown or other
  misc_feature (470)..(471): n is a, c, g, or t
  modified_base (474)..(508): a, c, t, g, unknown or other
  misc_feature (474)..(508): n is a, c, g, or t
tcagagcactgtagcacgaccggtgctcgatttagatcgtctgtgttgggtttggggacagcagacctgagagcgctgggcccacagcctccccctcagagccctgctgtctcctccggtcagccctggacatcccaggtttcccccaggcctgccggtaggtgtagaatgaggtctgtgtcactgtggtattacgattattttgactggttaagattactactactccggtatcggacgtcgtggggccaagggccacggtcaccgtctcctcacgcctccaccaagggccccatccggtccttccccctggccacccctcctaccaacgacgcaccgtcgtcgggggcacgacgccggccccgtgggcctcgccgtggtaccaaacggtaccttaacctttcccctaacgacggtcgccttcgtcggacggtccggggcgtcgggacgaaacgggccgactaagtagnngannnnnnnnnnnnnnnnnnnnnnnnnnnnnnnnnnn

SEQ ID NO: 85205 - DNA, 711 bp, Homo sapiens
  misc_feature: GYAE6OF02GL2X5.4.34.D01.1.454.CMB.1.raw
  modified_base (341)..(341): a, c, t, g, unknown or other
  misc_feature (341)..(341): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccagaaccaatatgtcttactggtaccagcaagaacgccgacggccacggccctgttgttgttgttataataaagacgtagtgacgacggccctgacgggactcccgngacgcgtattcgtcgtcgctccgagtctacgacggaacaacgtacgtccgtacgttacgacctagtacgtagggtcggtacgtaccggacggtacgaaaggaacggtaaccgggaacgggtccgtaacgtaacgtttaaacgttaccttacggttaaaccaacgttaccgacggtaccgtaaacgtaaccggtaagggtacccggggttaagggtaaactttaaaaaccgggttaaagggtaccggggttacgggaccggggtaacgggaaaccccggtaggtaaccggtacccggttacccgtaacccggtacgggttacccggaccccggtaacccggtacgggtaccccttcccggtaccccccggg

SEQ ID NO: 85206 - DNA, 802 bp, Homo sapiens
  misc_feature: GYAE6OF02I994C.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggactccacctgctctggagatgcattcgaccagaccaatatgtacttacgtcggtaccagacagaacgccgaggccacggcccctgttggttgttagttatagtaaagacagtggacgacggccctacgacgggtctcccgtgacgtcgtacttcgtcgtacggtcctaccgtacgtccgtacggaacgggaaaccaaaccgtacggtacccgtaaccggtttccggaaaccctacggtaccgtaagggttaccgggaaccggttaccccgaaaggggacctaaacggggaaaccgggtaacggaaccggggtaccttaacggttaaacccgtttaaacgtttaaccggttacggtaaccttaacgtacggtaaccgacgaacggtaacgtaacggggttaccgggggttaagggttaaaccgtttaaacggttaaacggggttacggggttaccggggacgggggttaaaccggggaaacccggttaaaccgggtaccggttaacccgggttaaccccggtttaccgggttaaccgggtaccggaacccgggttaaccccggaaacgggttcccgtaccccggttaccccccggg

SEQ ID NO: 85207 - DNA, 768 bp, Homo sapiens
  misc_feature: GYAE6OF02I7547.4.34.D01.1.454.CMB.1.raw
  modified_base (172)..(172): a, c, t, g, unknown or other
  misc_feature (172)..(172): n is a, c, g, or t
  modified_base (183)..(183): a, c, t, g, unknown or other
  misc_feature (183)..(183): n is a, c, g, or t
tcagagcactgtagcacgaccggtgctcgatttagatcgtctgtgttgggtttgggggtgggtccaggaggcagaactctgggtgtctcaccatggcctggactcccgtctacttctccccctcctcacctctctcgcacaggctctgacggcctcgtatgagctcgacacngcccacctggntcagtcgtcccgaggacaggaccggccaaggctccgactcggacctgtgggaatctaggccttagttcgacctacggaaaccttaagtcgttcggtactttaaccgtacggtaccaacggaccgaaaggtaaccgaccgtacgggaccgaccggtccccgttagttcggtttcgtttaacggttataaagtaaacgtacgtaagtggaacgtacggtaccccgtcgggaaggtcccttcgacggtacacgtacgttcctacgtcgtcctacgacgcgtacgacggtacaacggtcgtacgtacgtcgaacctgtcgtcggaggttcgaaccggtagacaacggtaaacgacggtacggttactacggttaatttaacgttacgtactaaccgtactgaaccctagggtaacgacgtaccgggttagggtaaacggtcgtttaaacggtaaccggttacggggtacccgggttaagggacccgggttaaaccgaacgggttccggttaacccggttaacccggttacccgtaggggtaacccgtccgggtaacccgtcggggtccccgttaccggttaacccccgg

SEQ ID NO: 85208 - DNA, 563 bp, Homo sapiens
  misc_feature: GYAE6OF02HCK3G.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggaaagacggccaggatcacctgctctggagatgcattgccagaccaatatgcttactggtaccagcagaagccaggccacggcccctgtgttgttgttatataagacagtgagacggccctagagggactccctgagcgtatttctcgtggcctccgagctcgaagggaccaacgatcgacgtttcgaaccatcaggtggactccgaaggcaaggaacgacgaggctcggacttagtactgtacaagtcagcagacgaggtcggtagtacttaagaaaggtagttcgggacggtaacggaacccgaaggtcctacggacccgttaccgtaggtacccacggacccgaacggtctcccgcccccgttaccgg

SEQ ID NO: 85209 - DNA, 590 bp, Homo sapiens
  misc_feature: GYAE6OF02IG8W5.4.34.D01.1.454.CMB.1.raw
  modified_base (178)..(178): a, c, t, g, unknown or other
  misc_feature (178)..(178): n is a, c, g, or t
  modified_base (219)..(219): a, c, t, g, unknown or other
  misc_feature (219)..(219): n is a, c, g, or t
  modified_base (456)..(456): a, c, t, g, unknown or other
  misc_feature (456)..(456): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctctatgagctgacacagcccaccctggtntccagtcgtcccaggacagcggcaggatcactgctctgganatgctattcgccagaccaatatcgactactgtaaccagacagaacgcaggaccaggccccttgtcgttagtttagttaataagaaagtacgagtgacgacgtaccctgaaggtactccgagacgcgtattctcgtcggcctacgagcctacgacggaactacgacgtacgtagtacacactcgagtgacgtcgagcgaacgaagacgaagtcgacgtatacttacgtctaactaacngaactacaagacgtaggtacggaggtaaccttaaagtaacggtagtcgggaacggaacggaacgaacgtcgtaacggtaccttaccggtaacgtacgtaaccgtacccggaagttcccgaaccggtacccccgg

SEQ ID NO: 85210 - DNA, 493 bp, Homo sapiens
  misc_feature: GYAE6OF02FYTME.4.34.D01.1.454.CMB.1.raw
  modified_base (214)..(214): a, c, t, g, unknown or other
  misc_feature (214)..(214): n is a, c, g, or t
  modified_base (459)..(461): a, c, t, g, unknown or other
  misc_feature (459)..(461): n is a, c, g, or t
  modified_base (463)..(493): a, c, t, g, unknown or other
  misc_feature (463)..(493): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttcccccaggcctgccggtaggtgtagaatgaggtctgtgtcactggtgtattacgattatttgacttggttaanattactactacgtccggtatgggacgtcgtcggggccaagggaccacggtcaccgtctcctcacgcctccaaccgacgggccccagtccggtccttcccccgtggccctacccctcctaccaagtacgccaccgtcggcggggcacgcggccggcctgggctcgccgtggtacgaacggcttaccgttcccaacgtgttcgcttcgtggaccgggcgggcgtacggacgaacggcgatacgtagnnngnnnnnnnnnnnnnnnnnnnnnnnnnnnnnnn

SEQ ID NO: 85211 - DNA, 842 bp, Homo sapiens
  misc_feature: GYAE6OF02JW3GV.4.34.D01.1.454.CMB.1.raw
  modified_base (110)..(110): a, c, t, g, unknown or other
  misc_feature (110)..(110): n is a, c, g, or t
tcagagcactgtagcacgaccggtgctcgatttagatcgtctgtgttgggtttggggggtgggtccaggaggcagaactctgggtgtctcaccatggcctgggatccctntacttctccccctctcactctctgcacaggctctggacggtcctctatgacgctgacacacgccctacccgttggtctacgacggttccgtaccccgaggacacggaccggacgaacgtcttccgaacctggccttcgagggtactagtacgcctaagttccgaccgtaacgacctaaattacggtacgtaccgttacggtaccggtaacccgtagccgaaacggtaacgacccggaccggtaccctaccggttccccgtttaggttggtttaacgtttaacgttaagtaaacgtaacgacgtagggtaactaacgggtaccggtcctaaggtaccggtacttccggaacgttacgagttacctttcgtacggtaccggtcttaacccgtacggccgtaacggaacgaacgttaaccggtcgttactacccggttacgaacctacgtaccggtaacggtaacggtaccggaccgtaagggtaccgtaaacgggaaccggtcggaagggttaccttaccgttaagtaccgttacaacgttaaccggagtaccggtaacgtacggaacgttaccgggtacgggttaaccggtaaacggttaataaaccggacgggttaaccgggaccggtaacgggtaaccgcgggttaaccttacccgggtagttccggttaacccgggaactaccggggttaaccacccggtttaacggtccccttaacccccgggtaccgg

SEQ ID NO: 85212 - DNA, 546 bp, Homo sapiens
  misc_feature: GYAE6OF02HKXG5.4.34.D01.1.454.CMB.1.raw
  modified_base (214)..(214): a, c, t, g, unknown or other
  misc_feature (214)..(214): n is a, c, g, or t
  modified_base (497)..(498): a, c, t, g, unknown or other
  misc_feature (497)..(498): n is a, c, g, or t
  modified_base (500)..(502): a, c, t, g, unknown or other
  misc_feature (500)..(502): n is a, c, g, or t
  modified_base (504)..(507): a, c, t, g, unknown or other
  misc_feature (504)..(507): n is a, c, g, or t
  modified_base (509)..(509): a, c, t, g, unknown or other
  misc_feature (509)..(509): n is a, c, g, or t
  modified_base (511)..(512): a, c, t, g, unknown or other
  misc_feature (511)..(512): n is a, c, g, or t
  modified_base (514)..(546): a, c, t, g, unknown or other
  misc_feature (514)..(546): n is a, c, g, or t
tcagagcactgtagcacgaccggtgctcgatttagatcgtctgtgttgggtttggggacagcagacctgagagcgctgggcccacagcctcccctcagagccctgctgtctcctccggtcagccctggacatcccaggtttccccaggcctgccggtaggtgtagaatgaggtctgtgtcactgtggtattacgattattttgactggttaaanattactactactcggtatggacgtcgtggggccaagggaccacggtcaccgtctcctcacgcctaccaccgaacgggcccacttccggtcccttccccccgtcggcccacccccttccctacccaaaggacgccgacccgtccggtcggggggcaccgtaacggcccgggcccgtcggggcgtcgcccgtggtcgaaacggtaccttaccttcccctaacgtaggtcgtcgtcgttcgaggccggggtacgtcgggaccgaacgggtcgacgtaacgtacggnngnnngnnnncncnncnnnnnnnnnnnnnnnnnnnnnnnnnnnnnnnnn

SEQ ID NO: 85213 - DNA, 985 bp, Homo sapiens
  misc_feature: GYAE6OF02HS987.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgacggtccctacctatgagcctagaaccacagccctacccgtcggtcgtctagttccggacccccgaggaaccgacggaaccgggaccgtaaggacttacccgaaccgttcggtacgttccggtagggtaagtacgtcggtaccctagtttaccgaccgtaaaccgaacctaaagttacgttcgttaacgtttaaccgttaaccggtacccgacgaacgaaggtaaaccggccgtaccggacccggccggttaccccgttgggtttcgttttacggtttaagtttaacgtaaaacgttaaaacgtaccgttaaggttaggaaacgggtaccgggttaccccgtagggaacccggtaacccgtaacccgtcgggtaaaccgtacggttaacttttccgtttaccgggtaacggttccctaacccgtacggttccgaacgggtaaaacccgggtaaaaccgaaaccggttaccggttaccgtaaaccgggtttaacctaacccgttaacggttaaccgggtaaacgggttaacggggtaacccttaccgggaaacgtaaccggggaaacggtaacggaacgggtaaccggtaccttacggttaaacgttaaccgttaacgtaacgttaccgaaacctttaccgaaaacgggttccaacgggttaaaggtccggggtacggggttaaaccgttaaacggtaaagggttaaccgggacggtaccgggggtaaaccgggaacggtaaccggtaacccgttaccgggaccggttaaccggttacccggtaaccgggtacgtaaacccgggcccggtaacccgggtccgttaccccggtaacccccggg

SEQ ID NO: 85214 - DNA, 761 bp, Homo sapiens
  misc_feature: GYAE6OF02GI4J0.4.34.D01.1.454.CMB.1.raw
tcagagcactgtagcacgaccggtgctcgatttagatcgtctgtgttggggtttgggggtgggtccaggaggcagaactctgggtgtctcaccatggcctggatccctctacttcctccccctcctcactctctgcacaggctctgacggcctcctatgagctgacacacgcccacccgtcggtgtcagtccgtaccccgaggacacggaccggcgaggactccacctgctcgtaggagatcgctagttcgacccgaacggaacctaaacgtaagttcgtaccgttacgttacggtaaccgagaacgaacggaaacggaccggacggacccggaccggtccccgttggttggtttacggtttagttaataagtaaaagaacgtagtaggtacggaccggtccctaggacgggtactcccgtagacgtacgtacttcgtccgtcggtcctaccgtcgtacgtacgaacgggtaaccaacgtacgttcgtaaccgtttaccgaaccttagtccggtaaggtacgggtacgttaccggaacgggtaacgaagggaaaccggtaggacgggtactacgtaacgttaacttaacgtcgtaaccgaactacggaacgtaccgaacgaccggtacggttacgggtacggttaaagttaaacgtaaacgggtagggtacgggaacgggtaaccgggaacgtaacggtcgttaccggaccgtcggtaacggtacgaccgtacccggaacgtcccggttcccgtaccccgg

SEQ ID NO: 85215 - DNA, 705 bp, Homo sapiens
  misc_feature: GYAE6OF02JSB3M.4.34.D01.1.454.CMB.1.raw
  modified_base (147)..(147): a, c, t, g, unknown or other
  misc_feature (147)..(147): n is a, c, g, or t
  modified_base (431)..(431): a, c, t, g, unknown or other
  misc_feature (431)..(431): n is a, c, g, or t
  modified_base (448)..(448): a, c, t, g, unknown or other
  misc_feature (448)..(448): n is a, c, g, or t
  modified_base (585)..(585): a, c, t, g, unknown or other
  misc_feature (585)..(585): n is a, c, g, or t
  modified_base (664)..(664): a, c, t, g, unknown or other
  misc_feature (664)..(664): n is a, c, g, or t
tcagagcactgtagcacgaccggtgctcgatttagatcgtctgtggttgggtttgggggtgggtccaggaggcagaactctgggtgtctcaccatggcctggatccctctacttcctccccctcctcactctctgcacaggctctgngcctcgtatgagctgacacacgcccacccgtcggtgtcagtcgtccccgaggacaggacggccaggacttcgacctgccttcgtagggactatcgacctaagttccgaccgaaagaacctaaacttactcgtaccgtttaactcgggtaaccaggacgaaggaacacccggaacggtcccgaaccggtccccgtttaggttacggttttggttacgtttaactaacgtaaaaacggccgtaaggtacggacgtacggcccgttacggagggtacccttaccggnggactacgtacttcgtntcggcctacgacgctacggaaggacacgtcgtactacgttcgacctagttcgaggttcgaaccgcgaggacgaaggtagacggacgtactaacgtcgttaattactacgtaacgtaatccgaggaccgaagtacggngtaacgggttagtaaccgtaaagttaacggcgggtacgggaacggaacgggacccgtaaggtccgtacggtacccggtntacgggtccaccggaccgacgggtcccgtcccggtacccgg

SEQ ID NO: 85216 - DNA, 692 bp, Homo sapiens
  misc_feature: GYAE6OF02G13B8.4.34.D01.1.454.CMB.1.raw
  modified_base (181)..(181): a, c, t, g, unknown or other
  misc_feature (181)..(181): n is a, c, g, or t
tcagagcactgtagcacgaccggtgctcgatttagatcgtctgtgttgggtttgggggtgggtccaggaggcagaactctgggtgtctcaccatggcctggatccctctacttctcccctcctcactctctgcacaggctctgacggcctcctatgagctagacacacgcccacctcggtntcagtccgtacccaggacaaaccggccaggactccacctactcgaggagtatcgcattcgaccataccagacaagaaacgtcacgaccacggtccctgttctggtcatctgtggagaccaccaaacgcccgtacggactccgtacgaagtacgacttctcgtggacctccgacgtctcgaacggactaacgcgacctaccgtagacgtacgtcgtagtcggggaccgtaggtcgggtaagacgtacggtaaccgtacgtaaccgttacttaagtttccgttaacgttaaccgaacaacgaaccgtaggacgaacgttcgaaccttaacgtactaacgggttgggttacggttacgggtacgggacggtaacggtacgtacggaccgttacggtacccgttacggtacggtaccaggtaccccgaacgggttccctccggtacccccgtcggttaccgaccgtttcccgttaacccgttcccccgttacccgttcccctaccgttaacccgg

SEQ ID NO: 85217 - DNA, 705 bp, Homo sapiens
  misc_feature: GYAE6OF02IWNRL.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgacggcctcctatgagctgacacagcccaccctcggtgtcaggtcgtccccaggacaggaccgccaggatcacctgctcgtggagatcgctagttcgaccaagaccaattatacgtacttacgtacggtaacgacgacaaggaacgccgacggccgaccggtccccgttgttcggtttgtttacgttaataacgtaaaagtactaaggtggaaggtaccggtcccgtacggtacgggtaccttaccccggtaggacggtaccgttacgtttccgtcgttacggccttacccgagtccgtacgtaacgggacctaacgacggtacctacggttacgacctacgtcgtaaggtcggaacgtccgaaggacgtaaacggacggacggacggtactacgtaactattacgtcgaactacgtcgaacgacgtacggacgtacgggtacggtaacgggtaaattaaacggtaaggtaccgggttacggacgggacggtaaccgagtaccggtccggtaaccgttcgacggtacgaccggaccggtaacggccgtacccgtacccccgg

SEQ ID NO: 85218 - DNA, 695 bp, Homo sapiens
  misc_feature: GYAE6OF02GG7YL.4.34.D01.1.454.CMB.1.raw
  modified_base (164)..(164): a, c, t, g, unknown or other
  misc_feature (164)..(164): n is a, c, g, or t
tcagagcactgtagcacgaccggtgctcgatttagatcgtctgtgttgggtttggggtgggtccaggaggcagaactctgggtgtctcaccatggcctggatccctctacttcgtccccctcctcactctctgcacaggctctgagcctctatgagctgacacngccaccgtgtgtcagtgtcccaggacagacgccaggatcactgctctggacatgacattcgaccagaaccaatatgtacttacgtaggtaacctaggacaacgaacgacccgacgggacccaacggggtcccccttggttacggtttacggtttagtttaaacgttaacgttaaaaacgacgtaacggttaggaacgggtaccggtaccctacggaacgggtacctacccgtagacgtacgtacgttcgtacgtcgtacctcgagtcgtaacgacggtaacacgtacgtactacgtcaacctagtacaggtacgcgtacgacgacgaagaacgacgagtctacgtaactacgttacgtacgtacaacgtacgagtaccgaagtaaccggagaacgggtacgtaaacgtttaaacggtaaacgtacgggtttacgggaacgtaaccggggtaactaacggtacctaaccgggtacccgtaacggttaacggaccgaaccggttacccgaacggtccgaccccggttaccccg

SEQ ID NO: 85219 - DNA, 780 bp, Homo sapiens
  misc_feature: GYAE6OF02HRJHM.4.34.D01.1.454.CMB.1.raw
  modified_base (608)..(608): a, c, t, g, unknown or other
  misc_feature (608)..(608): n is a, c, g, or t
tcagagcactgtagcacgaccggtgctcgatttagatcgtctgtgttgggtttggggtgggtccaggagcagaactctgggtgtctcaccatggcctggatccctctacttcctcccctcctccactctctgcacaggctcgtgacggtccctccgtatgagctgacctacacgcccaccctggttgcgagtcgtaccccgaggacctacggaccggcaggtactccaccttgctcgtaggacatgactacgttcgaccagacctaatctagtaccttacgtacggtaaccgagacacggaacgaccgacggccgaaccggtccccgttggtttcggtttcgttttaacgttaagttaacgtaaaacgacgtaaggttacggaacggtacggtacccctagggaaccgggtacttaccgaggacggttccgtagttacctcggtccgtccttacgacggacgtacggacgaactaagtacgtaacgtccgtacgacgtacgtacggtgtacggtaccgacggacggagtaacggaacgaccgggagtaccgttaagtcgtttaaacgtacgttaccagttaacgtacgacgaccgaagtaacccgggnggttaacgggttaaccgggttaaattaacggtaaaccggggttagggttacccgggacggggtaaacccggtaacgtaaccggttaccgtaacccgggttccgttaaccgggtaccgggtaacccaaccgggttacccggtaaccggtcccggttaccccgttaaccccggg

SEQ ID NO: 85220 - DNA, 681 bp, Homo sapiens
  misc_feature: GYAE6OF02IVSS8.4.34.D01.1.454.CMB.1.raw
  modified_base (260)..(260): a, c, t, g, unknown or other
  misc_feature (260)..(260): n is a, c, g, or t
tcagagcactgtagcacgaccggtgctcgatttagatcgtctgtgttggggtttgggggtgggtccaggaggcagaactctgggtgtctcaccatggcctggatccctctacttctccccctcctcactctctgcacaggctctgacggcctcctatgagctgacacagcccacccgtcggtgtccagtcgtccccgaggaccaggaccggccaggactccacctgctcgtggagtatgcctattcgccaacgaccaatntgccttacgtcggtaccagcaagacgccgaggccacggccccttgttcggttgttacgttataagtaaacgtactaggtagacggacggtccccgtaggacgggtactcccgtggacggtacgtacttacgttcgtacggtccttcgacgtccgtaccgaagggtaaaccaacgacgtacctacgttacgaaccctagtacgacggtcggacgtaccggagacgtaaggaaccggacggacggtctacgtaacgttattacgtcgtaactaactccgtaagacgtacgaacggacggtcgggttaacggtaaacttaaggaacgttcgggtacgggagggtaacgggaacctaaggtaccgtcgtaccggttacgaacggttccgaacggtacccgaacggcccgttacccgtacccccgg

SEQ ID NO: 85221 - DNA, 674 bp, Homo sapiens
  misc_feature: GYAE6OF02HLID1.4.34.D01.1.454.CMB.1.raw
  modified_base (315)..(315): a, c, t, g, unknown or other
  misc_feature (315)..(315): n is a, c, g, or t
  modified_base (329)..(329): a, c, t, g, unknown or other
  misc_feature (329)..(329): n is a, c, g, or t
tcagagcactgtagcacgaccggtgctcgatttagatcgtctgtgttggtttggggtggtccaggaggcagaactctgggtgtctcaccaatggcatggatccctctacttctccccctcctcactctctgcacaggctctgaggcctcctatgagctgacacagcccaaccctcggtgtccagttcgtcccccaggaccagaccggccaggatccaacctgcctcgtggacgatgctagttcgaccaggaaccaatatcgtactttacgtcggtaccagcaagaacgtccgaacggccacggtcccctaggttntttacgttagttanaagttaaagacgtagttcggaagtacggtcctacggacggtactcccgtgaacgtcgtattcctacgtcggcctcgagtccgtagaacggacaacgtctacgtaacgttcgaacctagtccgtaggtacggactaccggaacggacgaacggaacgacggacggtcgtaacgtactattaccgtacgtaactacgtacgtacgtcgaacgaacgtacgtacgggtagtaaaccgttagtaaaggtccgttaggaccgggtacggtaaccggaacgtaccgtaccggtaacccggttccgaacggttcccgaaaccggtcccggtaacggtcccgttaacccccgg

SEQ ID NO: 85222 - DNA, 781 bp, Homo sapiens
  misc_feature: GYAE6OF02I6COR.4.34.D01.1.454.CMB.1.raw
tcagagcactgtagcacgaccggtgctcgatttagatcgtctgtgttgggtttgggggtggtccaggaggcagaactctgggtgtctcaaccatggcctggatccctctacttcctccccctctcactctctgcacgaggctcgtggacgcctactatgacgtctcgaacacgacgccctacccgtggtagtctagtccgtacccgaaggacgaggtaccggccgaaggacctaccgaccgttgccttcggtagggactagtcgtactagtcggaccgtaacgaactaatacgtcgtactttaagacgtaccgagacaagaccgccgacgccgtacggcccttgttaggttgttattagtaagtaacgagtggacgtacgaccgtaccgtgtaaccggtcgtaccgtaggcgtacgtacgttccgtcgtaccggtcctacggaccgtacgtaacggaaccggtaaccgtaacgttacggtaccttaaccggtactaaccgtagtcggtaaggcggttaaccggacgagtaacgaaggaaacggccgtaagtacggtacgttacttaacgtcgttaaaccgtagaacgtacgaacgacggtagaacggttacgggtaaaccggttaacgttaaacgtaaaggtacgggtttaaccggggtcgggtaacgggtaccggtaaaccggtacggttaacccggttacggttaaccccgggtttacggaccgttaaacccggaacccgggtacccggtaacgggtttccccgacccggttcccccgg

SEQ ID NO: 85223 - DNA, 847 bp, Homo sapiens
  misc_feature: GYAE6OF02IO3UW.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacacgcccacccgtcggtgtctagtccgtaccccgaggaccaggaccggaccaggactccaccgtgccttcgtagggagtaatcggtacctagttcgtaccgaacgtaacctaaagttacgtacgttacgtttaacggtacggtaaccgacgacgaacgaacggaccggaccggaccgtaccggccccgttggttcggtttacgttttaggttaactaagtaaacgtacgtaaggtagggaacggaccggtacccgtacggtaacggtaccctaccggtaggtacggtccgtaacgtttcctacggtcggtacctaccgtacgtaccgtaaccgggaacggaaccgtaacgttacggtacctaaccgttacgaacctacgttacggtaacgggttacggtaaacccggtaccgaaacgggtacgaaaacggtaacggtaaccgggtacggtaacctttaacggtaacctttaaacgttaaccgtagtaaccgtaaacgttacgaacgacggtaacgaacggtaccggggttaacggggttaacgggtttaaactaaaggggttaaccggtaacgggttcggggaacggtaaccgggtaacggtaacgtaccggttaccgggtaccgtaccggttaggaacccgcggaacccccggttagggtacccgtcccggttaacccccgg

SEQ ID NO: 85224 - DNA, 686 bp, Homo sapiens
  misc_feature: GYAE6OF02G016O.4.34.D01.1.454.CMB.1.raw
  modified_base (217)..(217): a, c, t, g, unknown or other
  misc_feature (217)..(217): n is a, c, g, or t
  modified_base (343)..(343): a, c, t, g, unknown or other
  misc_feature (343)..(343): n is a, c, g, or t
  modified_base (526)..(526): a, c, t, g, unknown or other
  misc_feature (526)..(526): n is a, c, g, or t
tcagagcactgtagcacgaccggtgctcgatttagatcgtctgtgttgggtttggggacagcagacctgagagcgctcgggcccacagcctcccctcagacgccctgctgtctcctccggtcagccctggacatcccaggtttccccaggcctggccggtaggtgtagaatggaggtctgtgtcactgtggtattacgattattttgacttggtaanattactactactcgtatcggacgtcgtgggaccaaggaccacgtcaccgtctcctcgacgtcctaccaccgaacggcctagtccggtaccttcccccgtcgaccgacccctcctacccaacggacnccgtacctcggcgggtacacgacggtccggcccgtggtaccgtcgaccgtggtacgaaaccggtaccttaaccttacccgtaacgtacggttacgtcccttacggttacggaaccggcgggggtacgttaacggggtacccggtaaaacggggcccgggtaaacgtaaacggtttaacccggngtacgtcgagacgtacgtacgtacgcgacgacgtacgagcgtcgacactgtacgacgacgtacgtacgacacgtgtacgtcgacgtacagtacgtacgtacctacgtacggtaacggtacgacgtacgtacggtaaccgactaccggtacgtacggtacg

SEQ ID NO: 85225 - DNA, 693 bp, Homo sapiens
  misc_feature: GYAE6OF02IL337.4.34.D01.1.454.CMB.1.raw
  modified_base (257)..(257): a, c, t, g, unknown or other
  misc_feature (257)..(257): n is a, c, g, or t
  modified_base (639)..(639): a, c, t, g, unknown or other
  misc_feature (639)..(639): n is a, c, g, or t
tcagagcactgtagcacgaccggtgctcgatttagatcgtctgtgttgggtttgggggtgggtccaggaggcagaactctgggtgtctcaccatggcctggatccctctacttcctccccctcctcactctctgcacaggctctggacggtcctcctagtgagcctgaccacgacgcccaccccgtcgggtgtacacggttccgtaccccgaggaccacggaccggccgaggactccaccgtgcctcgtagggactntcggactagttccgaccaagaaccctaattacgtcgtacttaacgtcggtaaccgagacaaggaacgaccgaccggccgaccggtccccgtttaggttcgtttagtttagtttaacgtaagtaaacgtagaggtaggacggtacggtccgtacggaacggtacctccgtaggacgtacgtacttcgtcgtcggtcctccggacgtccgtacgaacggtacaacgtactacgtacgtacaccgtagtacggtaggtcggacgtacgagggtaacaagggacgacggtaggtaccgtagtaacgttaattcagtacctacgtagacacgtagacggtacgtagtacggtaattaacggtacggacggtacggaacggcggaacncgtcggtaacgttacccgaggtacgacgccgaccggcgtaccgcccgtacccgg

SEQ ID NO: 85226 - DNA, 636 bp, Homo sapiens
  misc_feature: GYAE6OF02FUWWD.4.34.D01.1.454.CMB.1.raw
  modified_base (223)..(223): a, c, t, g, unknown or other
  misc_feature (223)..(223): n is a, c, g, or t
  modified_base (251)..(251): a, c, t, g, unknown or other
  misc_feature (251)..(251): n is a, c, g, or t
  modified_base (258)..(258): a, c, t, g, unknown or other
  misc_feature (258)..(258): n is a, c, g, or t
  modified_base (479)..(479): a, c, t, g, unknown or other
  misc_feature (479)..(479): n is a, c, g, or t
tcagagcactgtagcacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagccaccctcggtgtcagtcgtccccgaggacagacggccaggatcacctgtctctggnatgctattcgcagaccaatatgcttacnggtaccngcagaagccaagccacggccctgtgttgttgttatagtaaacgacgagtagacggagcccctagagggtacttcccgaggacgtacgtattccgtcgtaggcctacgacggtctacggaaggggaccaacgtagtccgttaacgtgaccgtaactcgtaggtagggcgttaccgacggacaacggagaacgggtaaggtcgtacgtactaagttaaccgtntaccaagttaccgaggacgaacgacgtagggcggttacggtaaagttaacgtaaaggtggttacgggaacgggtaacgggaccaacggttaccggacggttaccggtacgttacgggtacaccggtaaccgtaacggtaccgtcccggtacccccgg

SEQ ID NO: 85227 - DNA, 824 bp, Homo sapiens
  misc_feature: GYAE6OF02JU3G7.4.34.D01.1.454.CMB.1.raw
  modified_base (151)..(151): a, c, t, g, unknown or other
  misc_feature (151)..(151): n is a, c, g, or t
  modified_base (636)..(636): a, c, t, g, unknown or other
  misc_feature (636)..(636): n is a, c, g, or t
tcagagcactgtagcacgaccggtgctcgatttagatcgtctgtgttgggtttggggtggtccgaggaggcagactctgggtgtctcgacatggcctggatcccctataccttctccccctactcgtactcctctgacacaggccttacgnggcgcctctatggacgtcacgacgatcgaccctaccgtggtcgtcacggtccgtacccccgagggaccaggaccgggccagggacttacccgaccgttagtccgtcggtaaggacgtctcggacctaagttcggacccagaacctaagttctacgtcgttacctggtaaccagtacaacggtacgacctacgggctaccggtccctttaggtgtttcgtacgttataaccgaataccggattcgggaaacgtccgttccagtacggtctaccgtgtacgcgttatccgtatcggtactacgacgttacgaaccgggactaacttaacggcccggtaccgttttaacggacgtaccgtaaggtttaccggtacgggttaaccgggtaccgtaacccgggtaagggaaaccgtaacggtaacccggtaacggggaccttaaccggttaacgttaaccgttactacggtttaccgtaaccgtaaccgngtaaccggttacgaacggtaaccggtaggtaacccggttaggtaaagtttaaccgaacgggttacccggtacgggtaacccggggtgaaaccggtttaaccggtggtaaaccccggtttacggaaccggtttaccggaccggtaccggtaaacccgggtcccggtacccgaccggttttacccccggg

SEQ ID NO: 85228 - DNA, 714 bp, Homo sapiens
  misc_feature: GYAE6OF02F1VBC.4.34.D01.1.454.CMB.1.raw
tcagagcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctggtgtcagtcgtccccaggacagacggccaggatcacctgctcgtggagatgctattcgccaagaccaatatgacttacgtggtaccagcagaacgccgacggccacggccccttggttgtttggttagtttaagtaataaaagcgtaggtaggagtacggccctaggagggtacctcccgaggacgcgtacttcgtcgtcggcttaccagtccgtacgagggaaccaacgacgtaccgtaacgttcgacctagtcgaacggttggaacggtaccgagggtaacgaaacggtaacgaccggtaggtaccgtacggtaacctttaacgttaacgttacgtaactaaaccgtacgaacggtccgaaaggtaccggaagggtaccggggtttaacgggtaaactttaaaccgggtaaagggtccgggttaccgggaacggggaacgggtaaccgtaacggtcggtaacccggttacccggttaccggtaacgggtccaacccgggtacccggtaacgggtccccgtacccggtaccccccgg

SEQ ID NO: 85229 - DNA, 802 bp, Homo sapiens
  misc_feature: GYAE6OF02FVSQ4.4.34.D01.1.454.CMB.1.raw
  modified_base (240)..(240): a, c, t, g, unknown or other
  misc_feature (240)..(240): n is a, c, g, or t
  modified_base (244)..(244): a, c, t, g, unknown or other
  misc_feature (244)..(244): n is a, c, g, or t
  modified_base (610)..(610): a, c, t, g, unknown or other
  misc_feature (610)..(610): n is a, c, g, or t
tcagagcactgtagcacgaccggtgctcgatttagatcgtctgtgttgggtttgggggtgggtccaggaggcagaactctgggtgtctcaccatggcctggatccctctacttctccccctcctcactctctgcacgaggctctgaggcctcctatgagctgacacacgccctacccgtcggtgtccagtcgtccccgaggacagaccggcctaagggctccacctcgcctcgtaggganacgngactattcgaccacgaccaatacgtcgtcttaacgtcggtaccacgactaacggaacgtccgacggccgacggtccccttggttggttgttagttataagtaacgacgtacgtagcggtacgtcccgttacggacgggtacctacccgtgacggtccgtacgtttcgtccgttcgacctacggtacgtacgtaccggacggtaaaccgtaactaccggttacctaaccggttaccggaacccttaacggtccggtaagggttccgggaaacggttcccggaaggtaaccgaaaggaaccgggtaacggacgggtacctttacggtaacctttaaccggttacgtaacgttaccgtaagtaccgganaaccggtaacgtaccggacgggtaccgggttaacggtaacgtttaaacggaaggtttccggggttaaccgggacgggggttaaccgtaaccgggaacggttacccgggtaaccggtaacccgggttaacggttaccggacccggttaacccgggaccgttaaccggtccccgggttccccgtaacccccggg

SEQ ID NO: 85230 - DNA, 802 bp, Homo sapiens
  misc_feature: GYAE6OF02ICZH3.4.34.D01.1.454.CMB.1.raw
  modified_base (175)..(175): a, c, t, g, unknown or other
  misc_feature (175)..(175): n is a, c, g, or t
tcagagcactgtagcacgaccggtgctcgatttagatcgtctgtgttgggtttggggtggtccaggaggcagaactctgggtgtctcaccatggcctggatccctctacttctcccctctcactctctgcacaggctcgtgacggcctctatgagctgacacagcccacctggtntcagtctcccgaggacacgaccggcaggactccgtactgccgttatagggatacgttgcctaagttcggaaccctaggtaaccaagttcgtacgtacctttacgtaccggtaaccaaggacgaacggaacgaccggtaacggcccgtacggaccccttggttccgtttagtttaagtttaacgttaaagtaaaccggtagtaggaagtaaccgggtacggtacccttagggaacggtacctccgtaggtaccggtactaacgtttccgtcggtcggtaccctaccgtacgccgttacggaacggacctaaccgtacgtaaccggttacgttacggtaacctaggtacgtacgggtacgtacgtaaccgggacgaacggtaacggaagggtaccggttaacggacgttccgttaaacggttacttacgtaacgtaccgttaacggaacgaacgttaccggaagggtacccgtaggggttaaaccggtaaggttaaacgtaacgttagggttacgaccgggggttaacggaaccgggtaaccgttaacggcgttaacccgggtacccgtaggtttaaccggaccggaacggtaccccggtaacgtccccggttccccggtaaccccggg

SEQ ID NO: 85231 - DNA, 666 bp, Homo sapiens
  misc_feature: GYAE6OF02G5TMD.4.34.D01.1.454.CMB.1.raw
  modified_base (259)..(259): a, c, t, g, unknown or other
  misc_feature (259)..(259): n is a, c, g, or t
tcagagcactgtagcacgaccggtgctcgatttagatcgtctgtgttgggtttgggggtgggtccaggaggcagaactctgggtgtctcaccatggcctggatccctctacttctcccccctctcactctctgcacaggctctgaggcctcctatgagctgaccacagcccaccctcggtgtcagtcgtccccaggaccaggaccggaccaggatcacctggcctcgtgggagactggctagttcgcccagacctaatntcgtactttacgtggtaacccaggccgaaggaacgcccgagggcccgaccggccccgttggttggtttgtttagttataataaacggactaggtgaggtacggccctaggtaggactcccgtagcgacgtacttctcttcggctcgagtcgtagacggacaacgagtctacgtcgaacagtacgaggtgcgtaccaggcgaaaggacgagacgtcgtactacgtaacttctacggtactaacgtcgacgtacgaacggagtcgggaacggttagggttaaccgtttaaagtaaacgggttcgggtaccggggacggtaacggggaaccctacgggtcctaccgggtacggtttacccggaggttaccgaccggtaacccggacggttcccgacccggttacccccgg

SEQ ID NO: 85232 - DNA, 870 bp, Homo sapiens
  misc_feature: GYAE6OF02FVXHF.4.34.D01.1.454.CMB.1.raw
  modified_base (85)..(85): a, c, t, g, unknown or other
  misc_feature (85)..(85): n is a, c, g, or t
  modified_base (226)..(226): a, c, t, g, unknown or other
  misc_feature (226)..(226): n is a, c, g, or t
  modified_base (242)..(242): a, c, t, g, unknown or other
  misc_feature (242)..(242): n is a, c, g, or t
tcagagcactgtagcacgaccggtgctcgatttagatcgtctgtgttgggtttgggggtgggtccaggaggcagaactctgggtntctcaccatggcctggatccctctacttctccccctcctcactctctgcacaggctctgaggcctcctatgagctgacacacgccaccctggtgtcagtcgtcccgaggacaggacggccaggactcacctgctcgtgganatgctattcgaccganaacctaatagtctaccttacgtacggtaaccacgacaaggaacgaccgacgggacccgaccggtccccttggtttggttacggttttagtttaagtaaagttaaaacgacgtaaggttagaacggaccggtcccttagggaacggtaaccgtttccctagggacggtacgtttaacgttccgttccggttaccgggtccctaaccgacgtccggttaacggaacgggtaaaaccaaccgtacgtaccgttaaccggttacacccgttaagttacgtacggggttacgtacgtaccggaaggtaaccgaaaggaaaccgggaacgggtacggttactaaccgggttaactttacctttaaacgtcggttaaaacctaacgttacaccggttaaaccgacgggttaaaccggacggggtttaaccgggggtaaacgttttaaaccggtaaaagggttaaaccgggttaccgggggttttacggggggaaacccggggttaaacgggtaaaccccggtaagggtttaccccggttaacgggttaaacccgggtttaccgttaaccggggttaccgggtaacccggaacccccgggttacggtaccccggttaccccgggttaaccccccgg

SEQ ID NO: 85233 - DNA, 604 bp, Homo sapiens
  misc_feature: GYAE6OF01BHRKP.11.16.B05.1.454.CMB.1.raw
  modified_base (183)..(183): a, c, t, g, unknown or other
  misc_feature (183)..(183): n is a, c, g, or t
  modified_base (248)..(248): a, c, t, g, unknown or other
  misc_feature (248)..(248): n is a, c, g, or t
  modified_base (257)..(257): a, c, t, g, unknown or other
  misc_feature (257)..(257): n is a, c, g, or t
  modified_base (312)..(312): a, c, t, g, unknown or other
  misc_feature (312)..(312): n is a, c, g, or t
tcagcgagagataccacgaccggtgctcgatttagagctcacgtattgagctctgggagaagagccccagccccagaattccgaggagtttccattcggtgatcagcactgaacacagaggactcaccatggagtttgggctgagcggtgtttcgtcgtaggcgtatatagagtgtcagtgtnaggtgcaatggtggaatcgtggggagcttggtcaagcctggggatccctgagactctcctgtgcncgctctgtntctctctagtgtactcttatgtagtgtacgtccgcgacgcgtcgacggcggaggngtagtagtgtattactatactagtagtagtaagtagacgacgtacctactactacgacgacgacgtacgtcgtagtaggtacgggtaccggtacgtactacgtacgtaccgacggaacgtaacctaacctaaactaactaactaactactacgtaacgtaagtacgtaacgtacgtacgtacgtacgtacgtacgtaacggtacgtaccggttacgttacgttacgttacgtacggtaccggtaccgacccggtaccgacgtacgacgtacgactactactacgtcgtacgg

SEQ ID NO: 85234 - DNA, 513 bp, Homo sapiens
  misc_feature: GYAE6OF01DUFRV.11.16.B05.1.454.CMB.1.raw
  modified_base (505)..(505): a, c, t, g, unknown or other
  misc_feature (505)..(505): n is a, c, g, or t
tcagcgagagataccacgaccggtgctcgatttagagctcacgtattgagctctgggagaagagccccagccccagaattccgaggagtttccattcggtgatcagcactgaacacagaggactcaccatggagtttgggctgagcttgggttttccttgttgctattatagaaggtgtccagtgtcaggtgcaactggtggaatcgtgggggagcttggtcaagcctgggggatccctgagactctcctgtgcagcctctggattctccttcagtgactctttatgagttggatccgcaggctccgagggcaggggctgggaatggatttcatacagttggtagaaagtggcagtcccatactaccacgcagactctgtgaacgggccggttcacatctcgaggaacactaccaaaactcaactatatctagaatgaactagcctgagactcgaggacgacggtccgtttatactgtcgccgacgcccgcgactgcacgcatcntcgtacgg

SEQ ID NO: 85235 - DNA, 563 bp, Homo sapiens
  misc_feature: GYAE6OF01DCMTN.11.16.B05.1.454.CMB.1.raw
tcagcgagagataccacgaccggtgctcgatttagagctcacgtattgagctctgggagaagagccccagccccagaattccgaggagtttccattcggtgatcagcactgaacacagaggactcaccatggagtttgggctgagctgggttttccttgttgctattatagaaggtgtccagtgtcaggtgcaactggtggaatcgtgggggaggcttggtcaagcctgggggatccctgagactctcctgtgcagcctctggattcctcctttcagttgacttcctttatgtagttggactccggccaggctccgaggggcaggggctgggaatggaatttcatactattggtagaaaggtggcagtcccaatactaccagcagctctgtgaggccggttcacatctcaggacaactaccaaactcactatatctagaatgactacgccgtagacgtacgtacgacggaccgtaccgggtaccgtttattacgttggtcggtaccggacccggccccggaccggacgtacggaccgtacgaccaatccagttccgtaccggg

SEQ ID NO: 85236 - DNA, 566 bp, Homo sapiens
  misc_feature: GYAE6OF01EUSEA.11.16.B05.1.454.CMB.1.raw
  modified_base (283)..(283): a, c, t, g, unknown or other
  misc_feature (283)..(283): n is a, c, g, or t
  modified_base (378)..(378): a, c, t, g, unknown or other
  misc_feature (378)..(378): n is a, c, g, or t
tcagcgagagataccacgaccggtgctcgatttagagctcacgtattgagctctgggagaagagccccagccccagaattccgaggagtttccattcggtgatcagcactgaacacagaggactcaccatggagtttgggctgagcttgggttttccttgttgctattatagaaggtgtccagtgtcaggtgcaactggtggaatcgtggggggagcttggtcaagccgtggggacgtccctggagactctccgtgtgcagcctctggacttctccttcagtnaccttcctttatgtagttggatcccgcaggcctccgagggcaggggctaggatggtattcatacagttggagaagtgcagtcccatactacacgnagactgtgtggaacgggtccgtcacctagtctccgaggactaaccaccaaaactcaactatactctaggaatgtaactacgctagacgtacgtcgaacggacctacgggtaccgtttagttacgtgtacggaccgaccgggaccccgccgaagtacggacctacggactactcacgttcgtaccgggg

SEQ ID NO: 85237 - DNA, 601 bp, Homo sapiens
  misc_feature: GYAE6OF01AO1PT.11.16.B05.1.454.CMB.1.raw
tcagcgagagataccacgaccggtgctcgatttagagctcacgtattgagctctgggagaagagccccagccccagaattccgaggagtttccattcggtgatcagcactgaacacagaggactcaccatggagtttgggctgagctgggttttccttgttgctattatagaaggtgtccagtgtcaggtgcaactggtggaatcgtgggggagcttgggtcaaggccgtggggatcccgtgagactctcctgtgcagcctcgtggacttcctccttcagtcgtacttcctttatcgagtttggactcccgccgaggctccggagggcaggggtctaggaatggtactttcagttacgtagtttgggagtaaaggtggactacgtccctaagtactaccacgtacaagtacctcgtggtacggaacgggtccgttcaaccgtacttcgtaccgaagggtaaccaaactaacccgtaaaactacaactaatactacgtaaggtaaatcgaactagacctagacgtactcggagacgtacggtacttagttacgtggtcgcggtaccgcccggacgagtacgcgacgctagtcagtcgtacgg

SEQ ID NO: 85238 - DNA, 645 bp, Homo sapiens
  misc_feature: GYAE6OF01AGTVZ.11.16.B05.1.454.CMB.1.raw
tcagcgagagataccacgaccggtgctcgatttagagctcacgtattgagctctgggagaagagccccagccccagaattccgaggagtttccattcggtgatcagcactgaacacagaggactcaccatggagtttgggctgagcttgggttttccttgttgctattatagaaggtgtccagtgtcaggtgcaactggtggaatcgtggggggagcgttggtcaaggccgtgggggacgtcccctggacgtacctctcctggtcgacacgtccctcgtggtactttcctccttcaggtcgtacctttcctttaagtggtagttgggacttcccggaccgagggtcctccgaggggccgagggggctagggaagtggtatttcaattacgtagtttgggaagtaagtggactacgtcctatactaccacgcagtctcgtgtaggacggtccgtcaccactccgaccgacggaaccaactaaccaaacctcaactatacgtacgtagaagtacgacgtacggtcctagtacgtaccgtacggaaccggaccgtaccggttaccgtttacttaccggttcggccggtaccgacccggccccggccgtacgtaccgccgtacgacagtctaccgttccggtaccgggg

SEQ ID NO: 85239 - DNA, 608 bp, Homo sapiens
  misc_feature: GYAE6OF01C827J.11.16.B05.1.454.CMB.1.raw
  modified_base (298)..(298): a, c, t, g, unknown or other
  misc_feature (298)..(298): n is a, c, g, or t
tcagcgagagataccacgaccggtgctcgatttagagctcacgtattgagctctgggagaagagccccagccccagaattccgaggagtttccattcggtgatcagcactgaacacagaggactcaccatggagtttgggctgagctgggttttccttgttgctattatagaaggtgtccagtgtcaggtgcaactggtggaatcgtgggggagcttggtcaagccgtgggggactccccgagacctctcctgtgcagcctctggtacttccttccttcagtcgtacttccttttagngtagttggactccgcgaggtctccgagggcgaggggctaggaatggtatttacatacgagttggtagaaagtggcacgtacccatactaccgacgacagtactcgtggtacggaacgggtccggttacaccgtactccgtaccgaacggaactaaccgtaaccaaaactacctaacttatattacgtagaatacgacgtacgactagacgtacgtacggacgaccgtcggtacgtttaatacgtcggtacgccggaccgtccccggacgtacgtacgcagtacctatacctactccgtacggtaccgggg

SEQ ID NO: 85240 - DNA, 815 bp, Homo sapiens
  misc_feature: GYAE6OF01AYUWG.11.16.B05.1.454.CMB.1.raw
  modified_base (279)..(279): a, c, t, g, unknown or other
  misc_feature (279)..(279): n is a, c, g, or t
  modified_base (297)..(297): a, c, t, g, unknown or other
  misc_feature (297)..(297): n is a, c, g, or t
tcagcgagagataccacgaccggtgctcgatttagagctcacgtattgagctctgggagaagagccccagccccagaattcccgaggagtttccattcggtgatcagcactgaacacagaggactcaccatggagtttgggctgagctgggttttccttgttgctattatagaaggtgtccagtgtcaggtgcaactggtggaatcgtgggggaggcttgggtcaaggcctgggggagtccctgagactctcctgtgcagcctctggattcctaccttnagtgtaccttcctttagngtagttggactcccgcgagctccgagggcgaggggtcgtaggaagtcggtatttcgaacttaccgtagttttaggaaggtaaaggtgggacctacggttacccctaagttaacctaacccggaaccgtaccgtaaggaccctttacggttacgggttaacgggtaaccgggggtaccccgggtttacccaaccccgtacgttccccgtaaccccgggtaaacggggtaacccctaaaacccgttaaacccctaaaaaacccttacccgtaaaaccgtttaacttaaccttaacggttaacggttaaaagtttaccggtaaacgtaaccggtacccttaacggggtaaccgtacggttaaccggaaccgggtaacccggtaaccgggtttaacccgttttaacgtttacggttacggttaaccgggacccgggttaccccggacccccgggtacccggtacggtacggtacccgaaacgggtcccaacgtaccgtacgttaacccggttaaccgggggg

SEQ ID NO: 85241 - DNA, 656 bp, Homo sapiens
  misc_feature: GYAE6OF01A3RE7.11.16.B05.1.454.CMB.1.raw
tcagcgagagataccacgaccggtgctcgatttagagctcacgtattgagctctgggagaagagccccagccccagaattccgaggagtttccattcggtgatcagcactgaacacagaggactcaccatggagtttgggctgagctgggtttcctgttgctattatagaaggtgtccagtgtcaggtgcaactggtggaatcgtggggggagcttgggtcaaggccgtgggggactccctggagactctcctgtgcaggccctcgtggtacttctccttacagtcgtactcctttagtgtaggttggactcccggccgaggcctccggaaggggcgaaggggctgggaatggtatttcaagtacagtttgggagtaaagtggacacgtcccaagtactaccgacgcaagtcctgtagtacggaacgggtcccggttacaccgtactccgtacccgaaggaacctaacctaacccgtaaaaacctcaaaccttaactaacgttacgtaaggaaactaggtaacctaacggtccgtaaggtacgtaaccgttacggaacggtaccgaaccggtccgtttagttaaccgtggtcggtacccggaccggccccggtaccgtacgtacgaccgtaggacctagactacgtccgtaccggg

SEQ ID NO: 85242 - DNA, 647 bp, Homo sapiens
  misc_feature: GYAE6OF01EODB9.11.16.B05.1.454.CMB.1.raw
tcagcgagagataccacgaccggtgctcgatttagagctcacgtattgagctctgggagaagagccccagccccagaattccgaggagtttccattcggtgatcagcactgaacacagaggactcaccatggagtttgggctgagcttgggttttccttgttgcttattataggaaggtgtccagtgtcaggtgcaactgggtggaatcggtgggggagtcttggtcaacggccgtgggggactccctgacgtactctcctgtgcagtcctgtggtacttccttccttcagttcgtacctttccgttttagtcggtaggttggacttcccggaccgtacgggccctacccggaggggccggagggggtcctagggaactggtactttcgagtacgtagttgggtagaaaggtcggactacgtcctaatactaccagccagctgtagtacggacgggtccgtacactactcgaccgacggacaacctaaccaaactcactatatacgtagaatcgaactacgctagacgtacgtagaacggtaccgtacggttaccgtttagttaccgtcggtaccggtacccgacccggtacccgaaccggtacgtacgacccgtacaccgtaatccgtaacttccggtaaccgggg

SEQ ID NO: 85243 - DNA, 728 bp, Homo sapiens
  misc_feature: GYAE6OF01B7YSV.11.16.B05.1.454.CMB.1.raw
  modified_base (241)..(241): a, c, t, g, unknown or other
  misc_feature (241)..(241): n is a, c, g, or t
tcagcgagagataccacgaccggtgctcgatttagagctcacgtattgagctctgggagaagagccccagccccagaattccgaggagtttccattcggtgatcagcactgaacacagaggactcaccatggagtttgggctgagctgggttttccttgttgctattatagaaggtgtccagtgtcaggtgcaactggtggaatcgtgggggagcttggtacaaggccgtggggactcccngacgactctcctgtgcacgcctcgtggtactttcctcctttcagttcgtaccttccttttagtgtaggtttggacctcccggaccgtaggccctaccggaggggccgagggggtctaggggaattgggtaacttttacgaattaaccgttagtttagggtaacggtaaaagggtggactacggtacccaagttaacctacccgacggctaacgtaccttcggttaggtacgggaacggggtcccggttacacccgtacttacccgtaccggaacgggaaccctaaacctaaccctaaaacctacctaaacgttacttaacgtacgtaaggtaaacttacgtaacgtaacgaccgttaggaacgtaaccgtacggaccggacctaccgggttaccgtttacgttacgtacggtcggtaccggtaccccggacccggtccggtaacgtacgtaccgtacgactaccttaccgtacgttcccgtaccggg

SEQ ID NO: 85244 - DNA, 776 bp, Homo sapiens
  misc_feature: GYAE6OF01C4S09.11.16.B05.1.454.CMB.1.raw
tcagcgagagataccacgaccggtgctcgatttagagctcacgtattgagctctgggagaagagccccagccccagaattccgaggagtttccattcggtgatcagcactgaacacagaggactcaccatggagtttgggctgagcttgggttttccttgttgctattatagaaggtgtccagtgtcaggtgcaacgtggtggaagtcggtgggggagtcgttggtacgaagccgtggggacgtccctaggacgtacctctcctggtgcgacgtccctcgtggtactttccgtccttactagggtctacctttaccgttagtggttaaggttcggactcccggccgacgggtcctccggaggggcggaggggtacgtagggtaagtggtaactttcctaagtaacgttagttagggtagtaaacgtcggtactacgttacccgtaataaccgtaccctaacggaccacgtaaccttcggttagggtaacggtaccggggtcccggttaaccaacccgtacgtacccctaccggaaccgggtaacaaaccccgttaaccgaaaacctacggtaacctaagtaccgtacggtaacgtaaacgtcgtaacgtacgaccgtaggtaacgtaccgtaccgggaaaggtcccgtaaaccgggttttacccgtttaatacccggttagggtacccggtaaccccgggcggtacccccggtacgtaaccggtacacccggtaactcggtaaaccttacgtccgggtttaccgtaacccgggggg

SEQ ID NO: 85245 - DNA, 789 bp, Homo sapiens
  misc_feature: GYAE6OF01BCDWF.11.16.B05.1.454.CMB.1.raw
  modified_base (335)..(335): a, c, t, g, unknown or other
  misc_feature (335)..(335): n is a, c, g, or t
  modified_base (353)..(353): a, c, t, g, unknown or other
  misc_feature (353)..(353): n is a, c, g, or t
  modified_base (396)..(396): a, c, t, g, unknown or other
  misc_feature (396)..(396): n is a, c, g, or t
tcagcgagagataccacgaccggtgctcgatttagagctcacgtattgagctctgggagaagagccccagccccagaattccgaggagtttccattcggtgatcagcactgaacacaggaggactcaccagtgggtagtttgggcttggagtcgtttgggtttttaccttgttgacttattagtaagaaggtgtcagtgtcgaggtgctaacgtgggtaggaatcggtagggggagtcgttggtacaacggtccggtgggggactccctaggacgtccttctccgtgtgccacgtcctcgtggtaccttcgtccttacagttctacttctttagngtacgttggactccgcgnggtccgtaccggagggccgagggtctaggaagttggtacttancgttactggtttagggaggtaagccgtactaccgtacccgtaataacccgtacccgagtacacggttaccgtttacggacgggtaacgggtaccgggtccgttaccgtaacccgtacgtacccccgtaaccggtaaccgggtaaaccctaaacccgtaaacctaaacccttaacctactttaacgtacctaaggtaaacggtaactaacgttaacgtacggtacccgttaggtaacccgttacggtaaccgggtaaccggtaccgggtttaacccggttaccgtttaacgtttaacgggtaccgtaccgggttaccccggacccgggtccccgggtaacaccgtaacgacgtaaccgtaccgtaacctcgtacccgtaccgggtacccggggg

SEQ ID NO: 85246 - DNA, 712 bp, Homo sapiens
  misc_feature: GYAE6OF01D41O7.11.16.B05.1.454.CMB.1.raw
  modified_base (685)..(685): a, c, t, g, unknown or other
  misc_feature (685)..(685): n is a, c, g, or t
  modified_base (700)..(700): a, c, t, g, unknown or other
  misc_feature (700)..(700): n is a, c, g, or t
tcagcgagagataccacgaccggtgctcgatttagagctcacgtattggagctctgggagaagagcccagccccagaattccgaggagtttccattcggtgatcagcactgaacacagaggactcaccatggagtttggctgagcttgggttttccttgttgctattatagaggttgtccagtgtcaggtggcaactggtaggaatcgtgggggagcttggtcaaggccgtgggacgtcctgacgacttactccttagtgctagccttcgtggtacttcctccgtttacagttcgtaccttaccgtttagttagtaggtttaggacgttacccgaccgaggtccgttaccggacgggtcgagggggtctagggtaagtgggttaacttttcaattaacgtagttcgggtaagtaacgggtcgtcgaacgtacccagttaaccacccgtagactaaccgtacgtttacgtacgggttcggtaaccggggttcccgggtttacacccgttacttaccccggtaccgaaacgggtaaccctaacctaacccgtaaaaacgtcctaaaccgttaattactaccggttaaggtaaactacgggaacttacgcctaagggacgtacgtacggaacgtacgtacccgttacggtttactacgtgttacggcctacccggccggacgtaacgngactaagccagtccngtacctaccggg

SEQ ID NO: 85247 - DNA, 666 bp, Homo sapiens
  misc_feature: GYAE6OF01A6120.11.16.B05.1.454.CMB.1.raw
  modified_base (561)..(561): a, c, t, g, unknown or other
  misc_feature (561)..(561): n is a, c, g, or t
  modified_base (571)..(571): a, c, t, g, unknown or other
  misc_feature (571)..(571): n is a, c, g, or t
tcagcgagagataccacgaccggtgctcgatttagagctcacgtattgagctctgggagaagacgccccagccccagaattccgaggagtttccattcggtgatcagcactgaacacagaggactcaccatggagtttgggctgagcttgggttttccttgttgcttattagtaagtaggtgtccagttgtcaggtcgacacgtgggtaggaatcggtggggggaggctttcggtacaacggccggttgggggaccgtccctggacgtacttccctccgttgtcgcacgtcccttagtcggttactttcctccgttctagttcgtaccttctttagtggtaggttcggaccttcccgcgtacggcctcggagggcggacggggtctaggaagttgttattacgaattacgtagtttagggaacgtaagggttgaacgtccgtaccctataccgtacgacgacacgtaccttcggtaggtacggtaccgggtaccgttaccgactaccttcgaccggacggtaaccaaacctaccaaaacctctactaacttactacgtaanaagttacganacgtcctagtacgactcgggaactacgtaccgtcgttacgtcgtacgcggcgacccgacccgcgtacgtcgcgtcacatcgacgtcggtaccggg

SEQ ID NO: 85248 - DNA, 717 bp, Homo sapiens
  misc_feature: GYAE6OF01C3O3W.11.16.B05.1.454.CMB.1.raw
tcagcgagagataccacgaccggtgctcgatttagagctcacgtattgagctctgggagaagacgccccacgccccagaattccgaggtacgtttccattcggtgatcagcactgaacacagaggactcaccagtggagtttgggctgagtcgttgggttttccttggttgtcttattataggaaggtgtcctagtcgtcgaggtgacaacgtgggtaggaagtcggtgggggaggtcgttgggtaccaacggtccggtggggacttcccgtaggacgtacctccgtccgtgtacgcacgtcctcgtggtactttcctccttcgagtcgtaaccttccgtttatcggtacgttcggacctcccggaccgtacggccgtaccggaggggtcggacggggtcgtaggtaagtcggttaccttataacgttacggtagttagggtaagtaacggtcggtactaccgtacctaagtactaccgacgaacgtcggtaactcggtacggtacgggtaccggtccgtaccaacgtccgtacccgtacgaaccggtactaacccgaacctaaactcctaagtactaagttacgtaagtaagtacgtaactacgccgttagaaccggtacgacgtaacggaccgttaccggttacttagtccggtcgacgtacccgtcccgaccgtacgagtacgacctacgactagtccgacgtacggtaccggg

SEQ ID NO: 85249 - DNA, 947 bp, Homo sapiens
  misc_feature: GYAE6OF01B7CAB.11.16.B05.1.454.CMB.1.raw
tcagcgagagataccacgaccggtgctcgatttagagctcacgtattgagctctgggagaagagccccagccccagaattccgaggagtttccattcggtgatcagcactgaacacagaggactcaccatggagtttgggctgagcttgggttttcctgttgctattatagaaggtcgtccagtgtcaggtgctaacgtgggtaggaagttcggtggggggacggtcgttacggtacgaaacggtcccggtaggggggaccgttccccgtaggaccggtaccttccgttcccgttggcgaccgtacggtcccttcgttacgggtaccttttcccgttacccttacgtacgttccgtaacccttttccgttttaagtaggtacggtttggtaaccgtccccggacccggtaccgggtcccgtacccggacggggtcggacgggggtcgttaggggaagttcggtactttacgaacttacgtaggtttaggggtaagtaaacgggtcggtaccgtacccgtacccgtaactaacgtacccgtaccggtaccgtaacgtaaccgtttcggtacgggtaaccgggtaccggggttaccccgttaaccgtaccctaaccggttacccgtaaaccccggtaaaccgggaaacccgttaaaaccccgtaaaacccctaaaaacccttaacccgttaaacccttaaacgttaacccttaacgggttaacgtaaaaccggttagtaaacccgttaaccggtacccggtaaacgggtaccgtaaccggtaaccggaaccggggttaaccgtaaacccgggttttacccggtttttaccgttaaacgtaccgggttcccgggtaacccggtaacccccgggtccccggtaaaccgtacggttaacccgacggttacgtacctaccggttaaccgttaccgtacccggttacccggggg

SEQ ID NO: 85250 - DNA, 535 bp, Homo sapiens
  misc_feature: GYAE6OF02JCUFB.11.16.B05.1.454.CMB.1.raw
tcagcgagagataccacgaccggtgctcgatttagagctcacgtattgagctctgggagaagagccccagccccagaattccgaggagtttccattcggtgatcagcactgaacacagaggactcaccatggagtttgggctgagctgggttttcctgttgctattatagaaggtgtccagtgtcaggtgcaactggtggaatcgtgggggagcttggtcaagcctggggatccctgagactctcctgtgcagcctctggattctccttcagtgacttcctttatgagttggactccgccaggctccgagggcaggggctgggaatggatttcgatacagtttggagaaagtggcagtcccatataccacgcagctctggtgaacgggtccgttcacctatcctccgacgggacaacctaccaaaactcaactatatctagaatgactacgctgagactacgaggaccgacggtaccgtttacttacgtgtcggcgaccgcccggacgacgtacgcacggcatcactcgtaccgg

SEQ ID NO: 85251 - DNA, 170 bp, Homo sapiens
  misc_feature: GYAE6OF02GT8K0.11.16.B05.1.454.CMB.1.raw
  modified_base (166)..(170): a, c, t, g, unknown or other
  misc_feature (166)..(170): n is a, c, g, or t
tcagcgagagataccacgaccggtgctcgatttagagctcacgtattgagctctgggagaagagccccagccccagaattccgaggagtttccattcggtgatcagcactgaacacagaggactcaccatggagtttgggctgagcgggctggcaaggcgcatagnnnnn

SEQ ID NO: 85252 - DNA, 620 bp, Homo sapiens
  misc_feature: GYAE6OF02IMNNK.11.16.B05.1.454.CMB.1.raw
tcagcgagagataccacgaccggtgctcgatttagagctcacgtattgagctctgggagaagagccccagccccagaattccgaggagtttccattcggtgatcagcactgaacacagaggactcaccatggagtttgggctgagctgggttttcctgttgctattatagaaggtgtccagtgtcaggtgcaactggtggaatcgtggggggagcttggtcaagccgtgggggatccctgagactctcctgtcgcagcctcgtggtactttcctccttcagtgtaccttcctttatgtagttggactccggccgaggcctccgagggcgaggggctaggaattggactttcaatactgttggagtaaaggtggctacggtccagtaacctaccgacgcaacggtacttcgtaggtacggaacggggtcccggttacgaaccgtacgtccgtaccgaacgggaaccaaaccgtaaaccctaaaaacgtacctaaacctaattaactacgtagtaaagtagtaactacgtccgtagaacgacgtacgaacggacacggtacctttatacgtgtcgcggacccgccgaccgtacgacgcgacgccgactctacgtctaccggg

SEQ ID NO: 85253 - DNA, 617 bp, Homo sapiens
  misc_feature: GYAE6OF02JXB0S.11.16.B05.1.454.CMB.1.raw
tcagcgagagataccacgaccggtgctcgatttagagctcacgtattgagctctgggagaagagccccagccccagaattccgaggagtttccattcggtgatcagcactgaacacagaggactcaccatggagtttgggctgagctgggttttccttgttgctattatagaggtgtccagtgtcaggtgcaactggtggaatcgtgggggagcttggtcaagcctgggatccctgagactctcctgtgcagcctctggattctcttcagtgactcttatgtagttggactccgccaggcctccgagggcgaggggctgggaatggtatttcatacagttggtagaaagtggactacgtccatacacctacgcagacttcgtgtacggtaacgggtccgttacgacctacgtcctaccgacgggaacctaaccgtaaccaaaaaccttacaacttaattactactaacggaacttagaactaacggtccgtagacgtaacgtacggaacggtaaccgtacgggttaccgtttaacgttacgtggttacggacggtaccggcccggtaccgaacgttacggaccgtacggacctacgtacctacgttcctaacccggg

SEQ ID NO: 85254 - DNA, 652 bp, Homo sapiens
  misc_feature: GYAE6OF02JASOA.11.16.B05.1.454.CMB.1.raw
  modified_base (262)..(262): a, c, t, g, unknown or other
  misc_feature (262)..(262): n is a, c, g, or t
tcagcgagagataccacgaccggtgctcgatttagagctcacgtattgagctctgggagaagagccccagccccagaattccgaggagtttccattcggtgatcagcactgaacacagaggactcaccatggagtttgggctgagctgggttttccttgttgctattatagaaggtgtccagtgtcaggtgcaactggtggaatcgtgggggaggtcttgggtacaagccgtgggggacgtccctgagacctctcctgtgcngtcctctggtacttcctccttcagtcgtaccttcctttaatgtaggttggactccgccgaggcctccgaggggccgagggggctagggaagttggtactttcatacgtagttagggtagaaggttggactacgtcccaattactaccacgcgagtaccttcgtggtacggtacgggtccggttccgaacctagtcctaccgaacggaaccaacctaacctaaaacctcctaactactactacgtaacgtaaatacgtaactacgacctagacgtaccgtacggaacggaccgtaccggttaccgtttacgttacgtacggtccggaccggtacccggcccgaccgtacgtacgaccgtacgacctacgtaccgtacgttaccgtaccggg

SEQ ID NO: 85255 - DNA, 586 bp, Homo sapiens
  misc_feature: GYAE6OF02H3KMF.11.16.B05.1.454.CMB.1.raw
  modified_base (178)..(178): a, c, t, g, unknown or other
  misc_feature (178)..(178): n is a, c, g, or t
  modified_base (268)..(268): a, c, t, g, unknown or other
  misc_feature (268)..(268): n is a, c, g, or t
  modified_base (304)..(304): a, c, t, g, unknown or other
  misc_feature (304)..(304): n is a, c, g, or t
  modified_base (333)..(333): a, c, t, g, unknown or other
  misc_feature (333)..(333): n is a, c, g, or t
  modified_base (459)..(459): a, c, t, g, unknown or other
  misc_feature (459)..(459): n is a, c, g, or t
  modified_base (567)..(567): a, c, t, g, unknown or other
  misc_feature (567)..(567): n is a, c, g, or t
tcagcgagagataccacgaccggtgctcgatttagagctcacgtattgagctctgggagaagagccccagccccagaattccgaggagtttccattcggtgatcagcactgaacacagaggactcaccatggagtttgggctgagcttgggttttccttgttgctattatagaaggtntccagtgtcaggtgcaactgggtgaatcggtgggggaggcttggtacaacggtccgtgggggacgtcccgtgacgactctcctggtgacngcctcgtggtacttctccttcagtgtactcctttangtagttgactccgtcgagcctcgaggcgnggggtctggaagtgtattcaagtacagttggagaagtgctacgtcccgaatactaccgacgcacgtactcgtgtaggaacgggtccggttacactactcgaccgacggaacaaccgtaaccaaacncgtaactatactacgagaatgaacgtacgcaagacgacgtcgaacggtacgaacggttccgtttaatacgttcggtacgaccggtacccgcccgacgtagactgaccnacgtcacgtacctaccggg

SEQ ID NO: 85256 - DNA, 742 bp, Homo sapiens
  misc_feature: GYAE6OF02JNX9R.11.16.B05.1.454.CMB.1.raw
  modified_base (311)..(311): a, c, t, g, unknown or other
  misc_feature (311)..(311): n is a, c, g, or t
  modified_base (509)..(509): a, c, t, g, unknown or other
  misc_feature (509)..(509): n is a, c, g, or t
  modified_base (554)..(554): a, c, t, g, unknown or other
  misc_feature (554)..(554): n is a, c, g, or t
  modified_base (599)..(599): a, c, t, g, unknown or other
  misc_feature (599)..(599): n is a, c, g, or t
  modified_base (618)..(618): a, c, t, g, unknown or other
  misc_feature (618)..(618): n is a, c, g, or t
  modified_base (686)..(686): a, c, t, g, unknown or other
  misc_feature (686)..(686): n is a, c, g, or t
  modified_base (704)..(704): a, c, t, g, unknown or other
  misc_feature (704)..(704): n is a, c, g, or t
tcagcgagagataccacgaccggtgctcgatttagagctcacgtattgagctctgggagaagagccccagccccagaattccgaggagtttccattcggtgatcagcactgaacacagaggactcaccatggagtttgggctgagtcgttcggttttcttgtcgtcttattagtaggtaggtcgtacgtgtcgtacgtaggtcgactaaggtgggtagtacgttcggggtagggggtcgttcggtttcggaacgtacggtccggggtaaggggtacccttccgtaggaacttccttccgtcgttgtcgacnccgtctacggtagtcctttccttccgtagacgttcttaccctttatttagtacggttacgttaccggtaccggtcccgcggtaccgtccgtaccgggcggtacggggcgttcggtagacggttggttaccttcgaaactcggtttaaggttgggtaaaacgggtgtcggtaaccctacgtactaacgttccgaacccncgacgtaaccgttctagtcggtaacgggtacccggttcctaaacncgtccgttaccgacgggtaaaccaactaacctaaacctaacggtntaaacttagttaaccgtanaaacggttcaacgtacgttaccgacgtaacgacgtaccggagtaacgaccggttaccgtttacttaancggttgacctccggtacnccgtaacaggcctcgacgcctactacgtgacgtacggg

SEQ ID NO: 85257 - DNA, 735 bp, Homo sapiens
  misc_feature: GYAE6OF02HWUNR.11.16.B05.1.454.CMB.1.raw
tcagcgagagataccacgaccggtgctcgatttagagctcacgtattgagctctgggagaagagccccagccccagaattccgaggagtttccattcggtgatcagcactgaacacagaggactcacatggagtttgggctgagcttgggttttcctgttgctattatagaggtgtcagtgtcaggtgcaactggtggaatcgtgggggagtcttggcaaggccgtggggactccctagacgtactctcctgtcgcacgtccttcgtggtacttcctccttcgagttcgtacctttccttttaagtggtacggtttcggacttccccggaccgagggtccctaccggagggggccgtaacggggggtcttaggggaaatttgggtaacttttacgaagtttacgtaaggtttcggggtaaaggtaaaggttcggacctaacggttaccctaaagttaacctaacccgacgtacaacggtaccttcggtagggtacgggtaaccgggtccggttaaccaccgtacgtccgtaccggaacgggtaaacctaaacccgtaaaccctaaaaaccgtcctaaacttaactacttacgtaaggtaaactacgtaactacgtaccgtagaacgtacgtacggaacggtaccgtaaccggttaccgtttacgttacgtacggtcgtaccggacccggacccgtaccgtacgtacgcgacgaccacgtactacgtcgtaccggg

SEQ ID NO: 85258 - DNA, 522 bp, Homo sapiens
  misc_feature: GYAE6OF02FG3WR.11.16.B05.1.454.CMB.1.raw
  modified_base (274)..(274): a, c, t, g, unknown or other
  misc_feature (274)..(274): n is a, c, g, or t
  modified_base (280)..(280): a, c, t, g, unknown or other
  misc_feature (280)..(280): n is a, c, g, or t
  modified_base (295)..(295): a, c, t, g, unknown or other
  misc_feature (295)..(295): n is a, c, g, or t
  modified_base (346)..(346): a, c, t, g, unknown or other
  misc_feature (346)..(346): n is a, c, g, or t
  modified_base (433)..(433): a, c, t, g, unknown or other
  misc_feature (433)..(433): n is a, c, g, or t
  modified_base (435)..(435): a, c, t, g, unknown or other
  misc_feature (435)..(435): n is a, c, g, or t
tcagcgagagataccacgaccggtgctcgatttagagctcacgtattgagctacgtggggagaagagcccccagccccagaattccgaggagtttccattccggtgatcagcactgaacacagaggactcaccatggagttgggctgagctgggtttccttgttgctatatagaaggtgtccagtgtcaggtgcaactggtgggaatctggggggaggcttgggtcaagcctgggggagtcccctgagactctcctgtgcagcctctggattcnctttcngtgactcctttatgngttggatccgcaggctccagggcaggggctgggaatgggagttttcatacnttgggtgaaagtggcagtcccatatacccacgcagactctgtgagggcggttcaccatctccagggacaactacaaaactcactatntntgaatgacagctagagactcgagacgacggtccgtttattacgtagtgccggacgcccggaccgactagcgacgccatccatctacg

SEQ ID NO: 85259 - DNA, 823 bp, Homo sapiens
  misc_feature: GYAE6OF02IGVRG.11.16.B05.1.454.CMB.1.raw
  modified_base (270)..(270): a, c, t, g, unknown or other
  misc_feature (270)..(270): n is a, c, g, or t
tcagcgagagataccacgaccggtgctcgatttagagctcacgtattgagctctgggagaagagcccagcccagaattccgaggagtttccattcggtgatcagcactgaacacagaggactcaccatgggagtttgggctggagcgttggttttccttgttgcttattatagaaggtgtccagtgtcaggtgcaacgtggtggaatcggtgggggagtcgttggtacaacggccgtggggacgtccctggacgtacttctccgtggtcncgacgtcctgttacggtatttcccttacctttgtaggttacgtaccttttccgtttttaagtaggttacggtttacggaaccgttcccgggacccgtacggggtccccttcccgggaagggggtaccggtaacgggggggtccgttaaggggtaaacgtttggggttaactttttacgtaaaccgttaacgttaagggttttcgggttaaaagggtaaacggtcggggtacctaaccggtttccctaaaggttttaccaacccggtaccgtaacgtacggtaaccgtttcgtacggtacggggttaaccgggttcccgtttaaccgacttaccttcgtaccgaacgggtaaccaacgtaaaccctaaaacgttaccaacgttaactacgttaccgtaagtaaacgtctaaccgtacgttcgtacgaagtccgagtaaccggcgttacccgggttacgttttacgttacgtcgggttacggcccgtaccgggtaccccggaacggtacgtaccgacgaggtacctacgttaccgtaccgttacggtacccgggg

SEQ ID NO: 85260 - DNA, 660 bp, Homo sapiens
  misc_feature: GYAE6OF02JFU1R.11.16.B05.1.454.CMB.1.raw
  modified_base (251)..(251): a, c, t, g, unknown or other
  misc_feature (251)..(251): n is a, c, g, or t
tcagcgagagataccacgaccggtgctcgatttagagctcacgtattgagctctgggagaagagccccagccccagaattccgaggagtttccattcggtgatcagcactgaacacagaggactcaccatggagtttggctgagcgtggttttcctgttgctattatagaaggtgtcagtgtcaggtgacaacgtggtaggaatcgtgggggagcttggacaagccgttgggatcccgtgacgtactctcngtgcaggcctagtgtacttccgtcttcgagttgaccttcttagtggtacgttggacctcccgcgtacggaccgtccgtagggccggaggggtcgtcgggtaatgggttactttacgacttacgagtttagggtactaagggttcgctaaacgtcccggtaatacgtaccgaacgtcgacgtactcgtgtacgggtacggtccgttacgaccgtacgtccgtaccgtaacgggtaactaacccgtaacctaaaaccgtactaacgtaacgttactacgtaacgaacgtcgaccgtacgacgtacgacgtacgtagacgtacgtacggttactttcgtacgtcggtacggtaccgacgtcccgtaacgtacgtacgaccgacgtccctacgtaacgtactccggtaacggg

SEQ ID NO: 85261 - DNA, 766 bp, Homo sapiens
  misc_feature: GYAE6OF02IMGUO.11.16.B05.1.454.CMB.1.raw
tcagcgagagataccacgaccggtgctcgatttagagctcacgtattgagctctgggagaagagccccagccccagaattccgaggagtttccattcggtgatcagcactgaacacagaggactcaccatggagtttgggctgagcgttgggttttccttgttgctattatagaaggtgtaccagtgtcaggtgacaactgggtggaatcggtgggggagtcgtttggacaacggtccgtgggggacgttcccgtggacgtacctccgtccttggtcgcacggtcccttcgtcggtactttccgttccttcgagttcgtacccttcttttacgtaggttacgttggaaccttcccgaccggtacggccgtaccggagggcggtaacggggtccgttaagggaagtttcggttactttacgtaacgttaacgttaggttacgggtaaaggtaaacggttcggaaccgtaaccggttaaccctataaccgtaaccgaccgacgtacgtacttcgtagggtacgggtacgggtacccgtactaccgtacgtccgtaccgacggacctaaaccgtaacccaaaacgttactaacttaacttaacgtacgtaaggtaactacgaacctaacggaccgtagaaccgtacggtacgtacgggaccgttaccggttaaccgtttacgttacgtcggtaccggaccggtaccccgccggtaaccgtacgttaccgcgtacgtaccgtacctacgtaccgtacggttaacccgggg

SEQ ID NO: 85262 - DNA, 820 bp, Homo sapiens
  misc_feature: GYAE6OF02JOEOY.11.16.B05.1.454.CMB.1.raw
tcagcgagagataccacgaccggtgctcgatttagagctcacgtattgagctctgggagaagagccccagccccagaattccgaggagtttccattcggtgatcagcactgaacacagaggactcacatggagttggctgagctgggttttctgtgctattatagagtgctagtgtacaggtgacaacgtggtagaatcggagggggagcttggacaacggtccgtgggggactcccgtggactacttctccgttgtcgactacggccttacggtggtactttcccttacccgttcgaaggttaccgttaccctttaccgttttagtacggttaacgggtttcggtaacccggttccccggtacccggtacggccccgtttaacccggggaaggggtcccggggttaaaggggggtcccgttaaacggggggttaaatttaccgggggtttaacttttaccgaacgtttaaccggttaggtttaacggggttaggtaaaacggtttcggaccgtttaaccggttaaccctaagttaccgtaaccgaacggtacgaacgttaaccgtttcggttaacgggtaccgggtaaccggggttacccggttaaccttaacccggtaccgtttaccggtaccgggaaaccggtaaccgtaaacctaaccctaaaaccgtacctaacgttaacgtaccttacggtagtaactacgtaacgtacgcgtacgagacgtacgacggtacctccggttagttactacgtacggtacgccggtaccgtccggtactgtacgacgtacggacttcgacgttactccggtacggg

SEQ ID NO: 85263 - DNA, 830 bp, Homo sapiens
  misc_feature: GYAE6OF02JA3SD.11.16.B05.1.454.CMB.1.raw
  modified_base (201)..(201): a, c, t, g, unknown or other
  misc_feature (201)..(201): n is a, c, g, or t
  modified_base (227)..(227): a, c, t, g, unknown or other
  misc_feature (227)..(227): n is a, c, g, or t
  modified_base (250)..(250): a, c, t, g, unknown or other
  misc_feature (250)..(250): n is a, c, g, or t
  modified_base (273)..(273): a, c, t, g, unknown or other
  misc_feature (273)..(273): n is a, c, g, or t
tcagcgagagataccacgaccggtgctcgatttagagctcacgtattgagctctgggagaagagccccagccccagaattccgaggagtttccattcggtgatcagcactgaacacagaggactcacatggagtttgggctgagctgggttttctgttgctattatgagtgtccagtgtcaggtgcaactggtggaatcgngggggagtctggtcagccgtgggacncctgagctctctgtgcagcctgngattctcctcagtcgcttacttngtaggttcgtagtaccgccgtacggtccgtccgaggggaccgaggggtccgttagggaaacgttgggtacgttttccgaaagttaacccgttaggtttacggggttaggtaaaacggttcgggtacctaaacggtccctaaacgttaaccgtaccctaaaccgggtaccagtaccgttttacggtgggtaccggtaaacggggttacccggtttacccgaaccgtaccttacccggttaacggaaccggggtaaacccttaaaccccgtaaaaccccgtaaaaacccgttacccgtaaaacctttaaacgttaaaccgtacccgtttaaagggtaaaagttacccggtaaacgttaccccggtaacggttacgggtaaaccgttaacccgggtaaccgtaaaccgggtaaccggttaaacccgggtttaaccggttttaaactttaccttaaccgggttacgggaacccgtttaaccccggggacccgggtaacccgtacggttacgaacccggtaaggaccgtaccgttaaacgttccggttaaccctaccggggg

SEQ ID NO: 85264 - DNA, 754 bp, Homo sapiens
  misc_feature: GYAE6OF02JSAXO.11.16.B05.1.454.CMB.1.raw
  modified_base (180)..(180): a, c, t, g, unknown or other
  misc_feature (180)..(180): n is a, c, g, or t
  modified_base (691)..(691): a, c, t, g, unknown or other
  misc_feature (691)..(691): n is a, c, g, or t
tcagcgagagataccacgaccggtgctcgatttagagctcacgtattgagctctgggagaagagccccagccccagaattccgaggagtttccattcggtgatcagcactgaacacagagactcaccatggagtttgggctgagctgggttttaccttgttgactatttatagaaggttntccagtgtcaggtgcaacgtggtggaatcgtagggggacgtcttggcaaggccgtggggtactcccgtgacgtaccttctccgtgtacgccgacgtccttcgtaggtactttcccttccgttacgaacggttcgtaacctttccgttttagtaggttaggtttacgggtaccttaaccccggccgtaacggtcccgttaccggaggggtaccggacggggtacggttaggtaacggttcggttactttaccgaacttacgtaggttttagggaacgtaaaggtccggaccgttacgtaacccgtaattaacccaccgtacgcggaacgtacttcgtaggtacgggaccggttccgtactaaccgtctacccgtacgaacggaaccttaaacccgtaaacctaaacgtacctacttaacgttaaccgtacgttaacggaaactaggtacgtaaccgtcgtacgaaccgtactacgggaaacgtaccgtaacggtttacctttagtccggtanccggtacggtaccacccggtactacgtaacgcgtaacggctaacgtacgtacgtacgtacggg

SEQ ID NO: 85265 - DNA, 742 bp, Homo sapiens
  misc_feature: GYAE6OF02H7XU2.11.16.B05.1.454.CMB.1.raw
  modified_base (166)..(166): a, c, t, g, unknown or other
  misc_feature (166)..(166): n is a, c, g, or t
  modified_base (189)..(189): a, c, t, g, unknown or other
  misc_feature (189)..(189): n is a, c, g, or t
tcagcgagagataccacgaccggtgctcgatttagagctcacgtattgagctctgggagaagagccccagccccagaattccgaggagtttccattcggtgatcagcactgaacacgagaggactcaccatgggtgtttgggctgagcgttggttttccttgttgntattatagaggtgtccgagtgtnaggtgacacgtggtaggaatcggtgggggagtcgttggtcaaggcccggttggggacgtcccgtaggacgtaccttccgtcccgttggtcgtcacggtccccttcgtcgggtacttttcccttaccttacgacgttcgtacctttccttttagtggttaggtttcggaccttccccggccgaggtcccgtacggacggggcggtaggggaccgttagggaagttgggtatttcgaattacgtagttagggtaaggaaggtcgactacggtaccattacctaccgacgacgtacgtacctcgtaggtacgggtaacgggtccgtaccacgtactaccgtacggaaaccggaccaaaccgttaaaccaaaaccttacccgtaaattacttaaacgtcgttaaacggtaactagtaaccgttacgacgttacgaacgtcgtaaccgtaaggaccgttaccggttacgttttacttacggtgtaccggaccggtacccggacccggtaccgtaagttaccgataccggtccactttacgtacgttacggtcccgggg

SEQ ID NO: 85266 - DNA, 160 bp, Homo sapiens
  misc_feature: GYAE6OF01EB172.25.34.D01.1.454.CMB.1.raw
  modified_base (124)..(124): a, c, t, g, unknown or other
  misc_feature (124)..(124): n is a, c, g, or t
  modified_base (130)..(160): a, c, t, g, unknown or other
  misc_feature (130)..(160): n is a, c, g, or t
tcagactgtacagtcacgaccggtgctcgatttagatcgtctgtgttgggtttgggcacagcggccctgggctgcctggtcaaggactacttccactgtacagtctgagcgggctggcaaggcncatagnnnnnnnnnnnnnnnnnnnnnnnnnnnnnnn

SEQ ID NO: 85267 - DNA, 130 bp, Homo sapiens
  misc_feature: GYAE6OF01AL7DC.25.34.D01.1.454.CMB.1.raw
  modified_base (130)..(130): a, c, t, g, unknown or other
  misc_feature (130)..(130): n is a, c, g, or t
tcagactgtacagtcacgaccggtgctcgatttagatcgtctgtgttgggtttgggcacagcggccctgggctgcctggtcaaggactacttccactgtacagtctgagcgggctggcaaggcgcatagn

SEQ ID NO: 85268 - DNA, 727 bp, Homo sapiens
  misc_feature: GYAE6OF01BP2I8.25.34.D01.1.454.CMB.1.raw
  modified_base (106)..(106): a, c, t, g, unknown or other
  misc_feature (106)..(106): n is a, c, g, or t
  modified_base (703)..(703): a, c, t, g, unknown or other
  misc_feature (703)..(703): n is a, c, g, or t
  modified_base (711)..(712): a, c, t, g, unknown or other
  misc_feature (711)..(712): n is a, c, g, or t
  modified_base (716)..(716): a, c, t, g, unknown or other
  misc_feature (716)..(716): n is a, c, g, or t
  modified_base (723)..(727): a, c, t, g, unknown or other
  misc_feature (723)..(727): n is a, c, g, or t
tcagactgtacagtcacgaccggtgctcgatttagatcgtctgtgttgggtttggcccagtctgtgctgtctcacgccaccctcagtgtcgtcggggccccccggnagagggtcgacatcttcttgttctggaagtcgctccaacggtcggacagtaatagtgtaagctggtaccagccaacctcccgaggaaccgcccccaagcctcctcatctataggaatgactcgacgccgtccctgagggtactaccgtgacccgtatttccgtcgtcggtacaccggtaacgttcgtcggcccttccggtcccgtccccttacccgtcggacctagtccgagggttccgggtccgttcccgggaaccggtaggcgtacgggacggtctaaggtaatttacgttaacgttggtcgtaggtttaggtttacgggacttcggaccgtaggttcgtcggtaccggggttccggtaccggggttcgggttcggggtacgggaccgggtaacgggtacccaaggtcctacgggtacccgtacggttaaccggtccgaccggtaacccggacgtcccgtcccggttacccccgtcgttaccgtacccgttcccgttccgtaccccccgtcccttacccgccttacgtaccgtacgtcggtaccgcggtacgggcggtaccggtggacccgggtagccgtaaactcgagtcgagngcgtagcnncagngtcacgnnnnn

SEQ ID NO: 85269 - DNA, 736 bp, Homo sapiens
  misc_feature: GYAE6OF01AYN7W.25.34.D01.1.454.CMB.1.raw
  modified_base (703)..(703): a, c, t, g, unknown or other
  misc_feature (703)..(703): n is a, c, g, or t
  modified_base (715)..(715): a, c, t, g, unknown or other
  misc_feature (715)..(715): n is a, c, g, or t
  modified_base (717)..(717): a, c, t, g, unknown or other
  misc_feature (717)..(717): n is a, c, g, or t
  modified_base (719)..(719): a, c, t, g, unknown or other
  misc_feature (719)..(719): n is a, c, g, or t
  modified_base (721)..(722): a, c, t, g, unknown or other
  misc_feature (721)..(722): n is a, c, g, or t
  modified_base (726)..(726): a, c, t, g, unknown or other
  misc_feature (726)..(726): n is a, c, g, or t
  modified_base (730)..(730): a, c, t, g, unknown or other
  misc_feature (730)..(730): n is a, c, g, or t
  modified_base (732)..(732): a, c, t, g, unknown or other
  misc_feature (732)..(732): n is a, c, g, or t
  modified_base (734)..(734): a, c, t, g, unknown or other
  misc_feature (734)..(734): n is a, c, g, or t
tcagactgtacagtcacgaccggtgctcgatttagatcgtctgtgttgggtttgggcccagtctgtgctgtctcagccaccctcagtgtctcgggggccccccgggcagagggtcgacatctcttgttctggaagtcgctccaacgtcggcagtaatagtgtaagctggtaccagcaactcccaggaaccgcccccacactcctcatgtatgggaatgactcagccgcccctcgacggggtccctgaccgtattctctcgcctccacgtcgtggccacctcacgccctcccgtcggcctacgtccggtgggtcctacccgaatccgtggaggtactcggacggtccgtaattttaagttagttgtcgacgaacgggtcgggttagggacttacggaacggtaacggggtaaacggttaaccgggtttagtacgggttttaccggttaacggggttaaacggtttaacgggggaaacccgtaaacggggttaccccgtaacccggttaccggttaacgggtaccgtaacccggacccccggaaacccggtaccccctaaccccccgtacgtccgttaacccgtaccttccgtttacccggttaccccctaccccgttccccttaccgtaaccgttaccgttacgtacgttaccgacggtacggccgggtaccgacgggtaccgaacgggtctacgtacgtacgngtagcgtgacgngncncnnagcncgancngncg

SEQ ID NO: 85270 - DNA, 130 bp, Homo sapiens; identical to SEQ ID NO: 85267
  misc_feature: GYAE6OF02F8M79.25.34.D01.1.454.CMB.1.raw
  modified_base (130)..(130): a, c, t, g, unknown or other
  misc_feature (130)..(130): n is a, c, g, or t

SEQ ID NO: 85271 - DNA, 128 bp, Homo sapiens
  misc_feature: GYAE6OF02F1YX4.25.34.D01.1.454.CMB.1.raw
  modified_base (128)..(128): a, c, t, g, unknown or other
  misc_feature (128)..(128): n is a, c, g, or t
tcagactgtacagtcacgaccggtgctcgatttagatcgtctgtgttgggtttggcacagcggccctgggctgcctggtcaaggactacttccactgtacagtctgagcggctggcaaggcgcatagn

SEQ ID NO: 85272 - DNA, 130 bp, Homo sapiens; identical to SEQ ID NO: 85267
  misc_feature: GYAE6OF02GN7LB.25.34.D01.1.454.CMB.1.raw
  modified_base (130)..(130): a, c, t, g, unknown or other
  misc_feature (130)..(130): n is a, c, g, or t

SEQ ID NO: 85273 - DNA, 598 bp, Homo sapiens
  misc_feature: GYAE6OF02GR2P5.25.34.D01.1.454.CMB.1.raw
  modified_base (391)..(391): a, c, t, g, unknown or other
  misc_feature (391)..(391): n is a, c, g, or t
  modified_base (468)..(468): a, c, t, g, unknown or other
  misc_feature (468)..(468): n is a, c, g, or t
  modified_base (578)..(578): a, c, t, g, unknown or other
  misc_feature (578)..(578): n is a, c, g, or t
  modified_base (581)..(581): a, c, t, g, unknown or other
  misc_feature (581)..(581): n is a, c, g, or t
  modified_base (585)..(587): a, c, t, g, unknown or other
  misc_feature (585)..(587): n is a, c, g, or t
  modified_base (591)..(598): a, c, t, g, unknown or other
  misc_feature (591)..(598): n is a, c, g, or t
tcagactgtacagtcacgaccggtgctcgatttagatcgtctgtgttgggtttgggcccagtctgtgctgtctcagccaccctcagtgtctggggcccccggcgagagggtcgacatctcttgttctggagtcgctccaacgtcggcagtaatagtgtaagctggtaccagcaactccaggaaccggcccccacactcctcatcgtagtgggaatgactcgagccgcccctacgacgggggtccccctggaccctattctcgtgtcccctacaccgtctcggcaccctcacgcctccctcggccacgtccgtcgggctccctaatccgtagacggtaatcgacggtcagtaaattactacgtcgtgtctaggtttggattacgccgtagtntcggagtcgggtcgtacggtggttcgggacggacgggaccagcgtacgaccgtacgtacggtcagacccgaggtccncgtccccgtacggtctaaccgtttccgttccccgacccttccctacctgtaccgtactacgtccacggtacgccgggtcgtacggccgtaacggccggtaccagtacgtncgngcgnnntcannnnnnnn

SEQ ID NO: 85274 - DNA, 443 bp, Homo sapiens
  misc_feature: GYAE6OF01AN3LW.37.41.D08.1.454.CMB.1.raw
  modified_base (436)..(443): a, c, t, g, unknown or other
  misc_feature (436)..(443): n is a, c, g, or t
tcagtagtgtagatcacgaccggtgctcgatttagtcacgcgagaaagggaaggggctggagtgggtttcatacattagtattagtggcagtagaatatattacgcagactctgtgaagggccgattcaccatctccagggacaatttcaagaactcactgaatctgcaaatgaacagcctgagagccgaggacacggccgtatattactgtgcgagaaccggtagcgggtcgtcaggggggaatctttactattattactacatggacgtctggggcaaagggaccacggtcaccgtctcctcagcctccaccaagggcccatcggtcttcccctggcaccctcctccaagagcacctctggggcacagcggcctgggctgcctgtcaaggactactccatctacactactgagcgggctggcaaggcgcatagnnnnnnnn

SEQ ID NO: 85275 - DNA, 448 bp, Homo sapiens
  misc_feature: GYAE6OF01A5RSI.37.41.D08.1.454.CMB.1.raw
  modified_base (440)..(448): a, c, t, g, unknown or other
  misc_feature (440)..(448): n is a, c, g, or t
tcagtagtgtagatcacgaccggtgctcgatttagtcacgcgagaaagggaaggggctggagtgggtttcatacattagtattagtggcagtagaatatattacgcagactctgtgaagggccgattcaccatctccagggacaatttcaagaactcactgaatctgcaaatgaacagcctgagagccgaggacacggccgtatattactgtgcgagaaccggtagcgggtcgtcaggggggaatctttactattattactacatggacgtctggggcaaagggaccacggtcaccgtctcctcagcctccaccaagggcccatcggtcttccccctggcaccctcctccaagacgcacctctcggggcacagcggccctgggctgcctggtcaaggctactccatctacactactgagcgggctggcaaggcgcatagnnnnnnnnn

SEQ ID NO: 85276 - DNA, 510 bp, Homo sapiens
  misc_feature: GYAE6OF01A49KJ.37.41.D08.1.454.CMB.1.raw
  modified_base (301)..(301): a, c, t, g, unknown or other
  misc_feature (301)..(301): n is a, c, g, or t
  modified_base (363)..(363): a, c, t, g, unknown or other
  misc_feature (363)..(363): n is a, c, g, or t
  modified_base (494)..(510): a, c, t, g, unknown or other
  misc_feature (494)..(510): n is a, c, g, or t
tcagtagtgtagatcacgaccggtgctcgatttagtcacgcgagaaagggaaggggctggagtgggtttcatacattagtattagtggcagtagaatatattacgcagactctgtgaagggccgattcaccatctccagggacaatttcaagaactcactgaatctgcaaatgaacagcctgagagccgaggacacggccgtatattactgttcgaaagataggtactcgtggttcggcgtacttttttaatgtccattctttgaccacgtggggccagggaccctggtcaccgtctcctnacgcctccaccaagggcccagtccggtccttcccccgtggccgtccctgcctcccgaggacnccaccctccgagacgccacgacggccggcccgtgggcctggcccttgggtaccaaacggtacccttaaccttcccaattcctaacctacctacgtgacggcgggcgtcgggacgaacgggccgacagtagnnnnnnnnnnnnnnnnn

SEQ ID NO: 85277 - DNA, 464 bp, Homo sapiens
  misc_feature: GYAE6OF01DFOCO.37.41.D08.1.454.CMB.1.raw
  modified_base (451)..(464): a, c, t, g, unknown or other
  misc_feature (451)..(464): n is a, c, g, or t
tcagtagtgtagatcacgaccggtgctcgatttagtcacgcgagaaagggaaggggctggagtgggtttcatacattagtattagtggcagtagaatatattacgcagactctgtgaagggccgattcaccatctccagggacaatttcaagaactcactgaatctgcaaatgaacagcctgagagccgaggacacggccgtatattactgtgcgagaaccggtagcgggtcgtcaggggggaatctttactattattactacatggacgtctggggcaaagggaccacggtcaccgtctcctcagcctccaccaacgggcccatccggtcttccccctggccaccctcctccaagacgcacctctggggcacgacgcggccctgggctcgccgtggtcaaggactacttccatctacactactgacgcgggctgggacaaggcgcatagnnnnnnnnnnnnnn

SEQ ID NO: 85278 - DNA, 580 bp, Homo sapiens
  misc_feature: GYAE6OF01CW2ZT.37.41.D08.1.454.CMB.1.raw
  modified_base (314)..(314): a, c, t, g, unknown or other
  misc_feature (314)..(314): n is a, c, g, or t
  modified_base (529)..(529): a, c, t, g, unknown or other
  misc_feature (529)..(529): n is a, c, g, or t
  modified_base (539)..(539): a, c, t, g, unknown or other
  misc_feature (539)..(539): n is a, c, g, or t
  modified_base (541)..(541): a, c, t, g, unknown or other
  misc_feature (541)..(541): n is a, c, g, or t
  modified_base (549)..(549): a, c, t, g, unknown or other
  misc_feature (549)..(549): n is a, c, g, or t
  modified_base (560)..(566): a, c, t, g, unknown or other
  misc_feature (560)..(566): n is a, c, g, or t
  modified_base (568)..(571): a, c, t, g, unknown or other
  misc_feature (568)..(571): n is a, c, g, or t
  modified_base (573)..(573): a, c, t, g, unknown or other
  misc_feature (573)..(573): n is a, c, g, or t
  modified_base (575)..(576): a, c, t, g, unknown or other
  misc_feature (575)..(576): n is a, c, g, or t
  modified_base (578)..(580): a, c, t, g, unknown or other
  misc_feature (578)..(580): n is a, c, g, or t
tcagtagtgtagatcacgaccggtgctcgatttagtcacgcgagaaagggaaaggggctggagtgggtttcatacattagtattagtggcagtagaatatattacgcagactctgtgaagggccgattcaccatctccagggacaatttcaagaactcactgaatctgcaaatgaacagcctgagagccgaggacgacggccgtatattactgtgcgagaaccggtaggcgggtcgtcgagggggaattctttactatttattactacatggcgtcgtggggacaaagggaccacggtcaccgtctcctcgacncctccgaccgaacggcccatccggtaccttccccgtggccacccctcctacaacgacgccaccgtcgtcgggacctacgacggtccggccgtgggccgtcggtccgtcggtacgtaaacggtaccttaccgttacccgtacttaccctaacgtaccttacgtaacggcgggcgggtcgttacggggaaccggaacgggccgaaccgtagtaccgncgtcagtgancngacgctangcatgactgcnnnnnnncnnnncncnncnnn

SEQ ID NO: 85279 - DNA, 633 bp, Homo sapiens
  misc_feature: GYAE6OF01A2SOS.37.41.D08.1.454.CMB.1.raw
  modified_base (598)..(598): a, c, t, g, unknown or other
  misc_feature (598)..(598): n is a, c, g, or t
  modified_base (600)..(603): a, c, t, g, unknown or other
  misc_feature (600)..(603): n is a, c, g, or t
  modified_base (605)..(605): a, c, t, g, unknown or other
  misc_feature (605)..(605): n is a, c, g, or t
  modified_base (607)..(609): a, c, t, g, unknown or other
  misc_feature (607)..(609): n is a, c, g, or t
  modified_base (611)..(623): a, c, t, g, unknown or other
  misc_feature (611)..(623): n is a, c, g, or t
  modified_base (625)..(630): a, c, t, g, unknown or other
  misc_feature (625)..(630): n is a, c, g, or t
  modified_base (632)..(633): a, c, t, g, unknown or other
  misc_feature (632)..(633): n is a, c, g, or t
tcagtagtgtagatcacgaccggtgctcgatttagtcacgcgagaaagggaaggggctggagtgggtttcatacattagtattagtggcagtagaatatattacgcagactctgtgaagggccgattcaccatctccagggcaatttcaagaactcaactgaatctgcaaatgaacagcctgagagccgaggacacggccgtatatacgtgtgcgagaaccggtgcgggtcgtcgagggggatctttactattattactacagtggacgtcgtgggacaaagggaccgacggtccgaccgtctcctcacgccctaccgaccgaacgggtcccacgttccggtcctttccccccgtggccctaccccttcccgtacccgaaacgacgcctaacccgtccggtcgggggacctaaccggaccgggccccgggtaccccggtcggggaccttccggtcccgtttacggggtacccgtaaacgggtaccgtttaccccgttacccgtaacgttaccttaacccgtaaccttaccgttacggacggggcccggggtccgttacgggaccgtaaaccgggccgtacgtaagtcggacgcagtcncnnnncncnnngnnnnnnnnnnnnncnnnnnngnn

SEQ ID NO: 85280 - DNA, 445 bp, Homo sapiens
  misc_feature: GYAE6OF02F9783.37.41.D08.1.454.CMB.1.raw
  modified_base (437)..(445): a, c, t, g, unknown or other
  misc_feature (437)..(445): n is a, c, g, or t
tcagtagtgtagatcacgaccggtgctcgatttagtcacgcgagaaagggaaggggctggagtgggtttcatacattagtattagtggcagtagaatatattacgcagactctgtgaagggccgattcaccatctccagggacaatttcaagaactcactgaatctgcaaatgaacagcctgagagccgaggacacggccgtatattactgtgcgagaaccggtagcgggtcgtcaggggggaatctttactattattactacatggacgtctggggcaaagggaccacggtcaccgtctcctcagcctccaccaagggcccatcggtcttccccctggcaccctcctccaagagcacctctggggcacagcggcctgggctgcctggtcaaggctactccatctacactactgagcgggctggcaaggcgcatagnnnnnnnnn

SEQ ID NO: 85281 - DNA, 449 bp, Homo sapiens
  misc_feature: GYAE6OF02JXBYL.37.41.D08.1.454.CMB.1.raw
  modified_base (438)..(449): a, c, t, g, unknown or other
  misc_feature (438)..(449): n is a, c, g, or t
tcagtagtgtagatcacgaccggtgctcgatttagtcacgcgagaaagggaaggggctggagtgggtttcatacattagtattagtggcagtagaatatattacgcagactctgtgaagggccgattcaccatctccagggacaatttcaagaactcactgaatctgcaaatgaacagcctgagagccgaggacacggccgtatattactgtgcgagaaccggtagcgggtcgtcaggggggaatctttacattattactacatggacgtctggggcaaagggaccacggtcaccgtctcctcagcctccaccaagggcccatccggtcttccccctggccaccctcctccaagacgcacctctggggcacagcggccctgggctgcctgtcaaggctacttcatctacactactgagcggctggcaaggcgcatagnnnnnnnnnnnn

SEQ ID NO: 85282 - DNA, 445 bp, Homo sapiens
  misc_feature: GYAE6OF02FRMOK.37.41.D08.1.454.CMB.1.raw
  modified_base (439)..(445): a, c, t, g, unknown or other
  misc_feature (439)..(445): n is a, c, g, or t
tcagtagtgtagatcacgaccggtgctcgatttagtcacgcgagaaagggaaggggctggagtgggtttcatacattagtattagtggcagtagaatatattacgcagactctgtgaagggccgattcaccatctccagggacaatttcaagaactcactgaatctgcaaatgaacagcctgagagccgaggacacggccgtatattactgtgcgagaaccggtagcgggtcgtcaggggggaatctttactattattactacatggacgtctggggcaaagggaccacggtcaccgtctcctcagcctccaccaagggcccatcggtcttccccctggcaccctcctccaagagcacctctggggcacagcggccctgggctgcctggtcaaggctacttccatctacactactgagcgggctggcaaggcgcatagnnnnnnn

SEQ ID NO: 85283 - DNA, 467 bp, Homo sapiens
  misc_feature: GYAE6OF02GQXMW.37.41.D08.1.454.CMB.1.raw
  modified_base (377)..(377): a, c, t, g, unknown or other
  misc_feature (377)..(377): n is a, c, g, or t
  modified_base (450)..(450): a, c, t, g, unknown or other
  misc_feature (450)..(450): n is a, c, g, or t
  modified_base (456)..(467): a, c, t, g, unknown or other
  misc_feature (456)..(467): n is a, c, g, or t
tcagtagtgtagatcacgaccggtgctcgatttagtcacgcgagaaagggaaggggcgtggagtgggtttcatacattagtattagtggcagtagaatatattacgcagactctgtgaaggccgattcaccatctccagggacaatttcaagaactcactgaatctgcaaatgaacagcctgagagccgaggacacggccgtatattactgtgcgagaaccggtagcgggtcgtcgagggggatcgtttactattattactacatggacgtcgtggggcaaagggaccacggtcaccgtctcctcagcctccaccgaacgggcccagtccggtccttccccctggcccaccctcctccaagacgcacctccgagacncacagccgcccgtgggctcgcctggtacaacggcctacttccatcacactactgagccggctggcaaggcganagtgcnnnnnnnnnnnn

SEQ ID NO: 85284 - DNA, 476 bp, Homo sapiens
  misc_feature: GYAE6OF02G4701.37.41.D08.1.454.CMB.1.raw
  modified_base (431)..(431): a, c, t, g, unknown or other
  misc_feature (431)..(431): n is a, c, g, or t
  modified_base (438)..(438): a, c, t, g, unknown or other
  misc_feature (438)..(438): n is a, c, g, or t
  modified_base (449)..(449): a, c, t, g, unknown or other
  misc_feature (449)..(449): n is a, c, g, or t
  modified_base (455)..(476): a, c, t, g, unknown or other
  misc_feature (455)..(476): n is a, c, g, or t
tcagtagtgtagatcacgaccggtgctcgatttagtcacgcgagaaagggaaggggctggagtgggtttcatacattagtattagtggcagtagaatatattacgcagactctgtgaagggccgattcaccatctccagggacaatttcaagaactcactgaatctgcaaatgaacagcctgagagccgaggacacggccgtatattactgtgcgagaaccggtagcgggtcgtcgaggggggaatcgtttactattattactacatggacgtctggggcaaagggaccacggtcaccgtctcctcagcctccaccaagggcccatcggtccttccccctggccaccctcctccaagacgccaccgtcgtcggggcacgacgccggccctgggctcgcctgggtcaaggacctactccactctacactacngagcggntcggacaggcncatagnnnnnnnnnnnnnnnnnnnnnn

SEQ ID NO: 85285 - DNA, 649 bp, Homo sapiens
  misc_feature: GYAE6OF02ISZRZ.37.41.D08.1.454.CMB.1.raw
  modified_base (185)..(185): a, c, t, g, unknown or other
  misc_feature (185)..(185): n is a, c, g, or t
  modified_base (404)..(404): a, c, t, g, unknown or other
  misc_feature (404)..(404): n is a, c, g, or t
  modified_base (560)..(560): a, c, t, g, unknown or other
  misc_feature (560)..(560): n is a, c, g, or t
  modified_base (581)..(581): a, c, t, g, unknown or other
  misc_feature (581)..(581): n is a, c, g, or t
tcagtagtgtagatcacgaccggtgctcgatttagtcacgcgagaaagggaaggggctggagtgggtttcatacattagtattagtggcagtagaatatattacgcagactctgtgaagggccgattcaccatctccagggacaatttcaagaactcactgaatctgcaaatgaacagcctgagngccgaggacacggccgtatattactgtgcgagaaccggtagcgggtcgtacgaggggggaacttcgtttaactattaacttactacagtggtacgtcgtggggacaaagggaccgacggtccacccgtctcctcgacgtcctacccgaaccgaacgggccctacgtccggtcccgttcccccgtcggcctaccctccctaccaaggacgccacctcggngggaccacgacgccggtaccgtcgggcctcgccgttgggtaccgaaccgggtaccttaacccgtttccaacgttaccgtaaccctaaccgttaccgtaggacgggaccgggtacgtacggaccggtaacggccgtaggtaactaggtcgagtctancgagtcacgatcgctagactnacactacgacacggtagtgtcacgacgtacgtacgtacgtctacgtacgtacgtacgtacgtagtacg

SEQ ID NO: 85286 - DNA, 166 bp, Homo sapiens
  misc_feature: GYAE6OF01C46G6.5.55.E11.1.454.CMB.1.raw
  modified_base (166)..(166): a, c, t, g, unknown or other
  misc_feature (166)..(166): n is a, c, g, or t
tcagatcagacacgcacgaccggtgctcgattagcactcgcacgttggtttgggaagaggaagactgacggtcccaggagttcaggtgctggcacagcggccctgggctgcctggtcaaggactacttcccgtgtctgatctgagcgggctggcaaggcgcatagn

SEQ ID NO: 85287 - DNA, 175 bp, Homo sapiens
  misc_feature: GYAE6OF01D4UTF.5.55.E11.1.454.CMB.1.raw
  modified_base (174)..(175): a, c, t, g, unknown or other
  misc_feature (174)..(175): n is a, c, g, or t
tcagatcagacacgcacgaccggtgctcgatttagcactcgcacggttgggttttgggggaagaggaagactgacggtcccccaggagttcaggtgctgggcacagcggccctgggctgcctggtcaaggactacttcccgtgtctgatctgagcggctggcaaggcgcatagnn

SEQ ID NO: 85288 - DNA, 174 bp, Homo sapiens
  misc_feature: GYAE6OF01DUR5H.5.55.E11.1.454.CMB.1.raw
  modified_base (173)..(174): a, c, t, g, unknown or other
  misc_feature (173)..(174): n is a, c, g, or t
tcagatcagacacgcacgaccggtgctcgatttagcactcgcacgttgggtttgggggaagaggaagactgacggtcccccaggagttcaggtgctgggcacagcggccctgggctgcctggtcaaggactacttcccgtgtctgatctgagcgggctggcaaggcgcatagnn

SEQ ID NO: 85289 - DNA, 176 bp, Homo sapiens
  misc_feature: GYAE6OF01A5RNN.5.55.E11.1.454.CMB.1.raw
  modified_base (174)..(176): a, c, t, g, unknown or other
  misc_feature (174)..(176): n is a, c, g, or t
tcagatcagacacgcacgaccggtgctcgatttagcactcgcacgttgggttttgggggaagaggaagactgacggtcccccaggagttcaggtgctgggcacagcggccctgggctgcctggtcaaggactacttcccgtgtctgatctgagcgggctggcaaggcgcatagnnn

SEQ ID NO: 85290 - DNA, 176 bp, Homo sapiens
  misc_feature: GYAE6OF01BJURG.5.55.E11.1.454.CMB.1.raw
  modified_base (173)..(176): a, c, t, g, unknown or other
  misc_feature (173)..(176): n is a, c, g, or t
tcagatcagacacgcacgaccggtgctcgatttagcactcgcacgttgggtttgggggaagaggaagactgacggtcccccaggagttcaggtgctgggcacagcggccctgggctgcctggtcaaggactacttcccgtgtctgatctgagcgggctggcaaggcgcatagnnnn

SEQ ID NO: 85291 - DNA, 179 bp, Homo sapiens
  misc_feature: GYAE6OF01DEBF0.5.55.E11.1.454.CMB.1.raw
  modified_base (174)..(179): a, c, t, g, unknown or other
  misc_feature (174)..(179): n is a, c, g, or t
tcagatcagacacgcacgaccggtgctcgatttagcactcgcacgttgggttttggggggaagaggaagactgacggtcccccaggagttcaggtgctgggcacagcggccctgagctgcctggtcaaggactacttccgtgtctgatctgagcgggctggcaaggcgcatagnnnnnn

SEQ ID NO: 85292 - DNA, 184 bp, Homo sapiens
  misc_feature: GYAE6OF01D5FZX.5.55.E11.1.454.CMB.1.raw
  modified_base (174)..(184): a, c, t, g, unknown or other
  misc_feature (174)..(184): n is a, c, g, or t
tcagatcagacacgcacgaccggtgctcgatttagcactcgcacgttgggttttgggggaagaggaagactgacggtcccccaggagttcaggtgctgggcacagcggccctgggctgcctggtcaaggactacttcccgtgtctgatctgagcggctggcaaggcgacatagnnnnnnnnnnn

SEQ ID NO: 85293 - DNA, 171 bp, Homo sapiens
  misc_feature: GYAE6OF02I6X7B.5.55.E11.1.454.CMB.1.raw
  modified_base (171)..(171): a, c, t, g, unknown or other
  misc_feature (171)..(171): n is a, c, g, or t
tcagatcagacacgcacgaccggtgctcgatttagcactcgcacgttgggtttggggaagaggaagactgacggtccccaggagttcaggtgctgggcacagcggccctgggctgcctggttaaggactacttcccgtgtctgatctgagcgggctggcaaggcgcatagn

SEQ ID NO: 85294 - DNA, 178 bp, Homo sapiens
  misc_feature: GYAE6OF02IGI33.5.55.E11.1.454.CMB.1.raw
  modified_base (170)..(178): a, c, t, g, unknown or other
  misc_feature (170)..(178): n is a, c, g, or t
tcagatcagacacgcacgaccggtgctcgatttagcactcgcacgttgggtttggggaagaggaagactgacggtccccaggagttcaggtgctgggcacagcggccctgggctgcctggtcaaggactacttccgtgtctgatctgagcgggctggcaaggcgcatagnnnnnnnnn

SEQ ID NO: 85295 - DNA, 172 bp, Homo sapiens
  misc_feature: GYAE6OF02I9QYZ.5.55.E11.1.454.CMB.1.raw
  modified_base (171)..(172): a, c, t, g, unknown or other
  misc_feature (171)..(172): n is a, c, g, or t
tcagatcagacacgcacgaccggtgctcgatttagcactcgcacgttgggtttggggaagaggaagactgacggtccccaggagttcaggtgctgggcacagcggccctgggctgcctggtcaaggactacttcccgtgtctgatctgagcgggctggcaaggcgcatagnn

SEQ ID NO: 85296 - DNA, 176 bp, Homo sapiens; identical to SEQ ID NO: 85289
  misc_feature: GYAE6OF02IV2IV.5.55.E11.1.454.CMB.1.raw
  modified_base (174)..(176): a, c, t, g, unknown or other
  misc_feature (174)..(176): n is a, c, g, or t

SEQ ID NO: 85297 - DNA, 177 bp, Homo sapiens
  misc_feature: GYAE6OF02F6KQS.5.55.E11.1.454.CMB.1.raw
  modified_base (174)..(177): a, c, t, g, unknown or other
  misc_feature (174)..(177): n is a, c, g, or t
tcagatcagacacgcacgaccggtgctcgatttagcactcgcacgttgggttttgggggaagaggaagactgacggtcccccaggagttcaggtgctgggcacagcggccctgggctgcctggtcaaggactacttcccgtgtctgatctgagcgggctggcaaggcgcatagnnnn

SEQ ID NO: 85298 - DNA, 173 bp, Homo sapiens
  misc_feature: GYAE6OF02F43Z1.5.55.E11.1.454.CMB.1.raw
tcagatcagacacgcacgaccggtgctcgatttagcactcgcacgttgggttttgggggaagaggaagactgacggtcccccaggagttcaggtgctgggcacagcggccctgggctgcctggtcaaggactacttcccgtgtctgatctgagcgggctggcaaggcgcatag

SEQ ID NO: 85299 - DNA, 174 bp, Homo sapiens
  misc_feature: GYAE6OF02FGSZP.5.55.E11.1.454.CMB.1.raw
  modified_base (174)..(174): a, c, t, g, unknown or other
  misc_feature (174)..(174): n is a, c, g, or t
tcagatcagacacgcacgaccggtgctcgatttagcactcgcacgttgggttttgggggaagaggaagactgacggtcccccaggagttcaggtgctgggcacagcggccctgggctgcctggtcaaggactacttcccgtgtctgatctgagcgggctggcaaggcgcatagn

SEQ ID NO: 85300 - DNA, 178 bp, Homo sapiens
  misc_feature: GYAE6OF02F3IW3.5.55.E11.1.454.CMB.1.raw
  modified_base (176)..(178): a, c, t, g, unknown or other
  misc_feature (176)..(178): n is a, c, g, or t
tcagatcagacacgcacgaccggtgctcgatttagcactcgcacgttgggttttggggggaagaggaagactgacggtccccccaggagttcaggtgctgggcacagcggccctgggctgcctggtcaaggactacttcccgtgtctgatctgagcgggctggcaaggcgcatagnnn

SEQ ID NO: 85301 - DNA, 187 bp, Homo sapiens
  misc_feature: GYAE6OF02GNFJX.5.55.E11.1.454.CMB.1.raw
  modified_base (159)..(159): a, c, t, g, unknown or other
  misc_feature (159)..(159): n is a, c, g, or t
  modified_base (174)..(187): a, c, t, g, unknown or other
  misc_feature (174)..(187): n is a, c, g, or t
tcagatcagacacgcacgaccggtgctcgatttagcactcgcacgttggggttttgggggaagaggaagactgacggtcccccaggagttcaggtgctgggcacagcggccctgggctgcctggtcaaggactacttcccgtgtctgatctgagcgggntggcaaggcgcatgnnnnnnnnnnnnnn

SEQ ID NO: 85302 - DNA, 213 bp, Homo sapiens
  misc_feature: GYAE6OF02HX9P5.5.55.E11.1.454.CMB.1.raw
  modified_base (177)..(213): a, c, t, g, unknown or other
  misc_feature (177)..(213): n is a, c, g, or t
tcagatcagacacgcacgaccggtgctcgatttagcactcgcacgtttggggttttggggggaagaggaagactgacggtccccccaggagttcaggtgctgggcacagcggccctgggctgcctggtcaaggctacttcccgtgtctgatctgagcgggctggcaaggcgcatagnnnnnnnnnnnnnnnnnnnnnnnnnnnnnnnnnnnnn

SEQ ID NO: 85303 - DNA, 236 bp, Homo sapiens
  misc_feature: GYAE6OF01CQ8JT.45.72.G06.1.454.CMB.1.raw
  modified_base (231)..(236): a, c, t, g, unknown or other
  misc_feature (231)..(236): n is a, c, g, or t
tcagacgcgatcgacacgaccggtgctcgatttagctacgactgcaagggaaagggaggtgtgtcacaagatttgggccctggtcaccgtctcctcagcttccaccaagggcccatcggtcttcccctggcgccctgctccaggagcacctctggggcacagcggccctgggctgcctggtcaaggactacttcctcgatcgcgtctgagcgggctggcaaggcgcatagnnnnnn

SEQ ID NO: 85304 - DNA, 768 bp, Homo sapiens
  misc_feature: GYAE6OF01CMMOI.45.72.G06.1.454.CMB.1.raw
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccaggggaaagagccaccctctcctgctgggccagtcagagtgttagcaaccacttagcctggtaccagccgaaacgtaaaccgtcggaccgaaggtccctacccgaacgtacccttccctacttaattttagttcggttttccttacctaaccggacgggtcccgtcgtacggttacctacccgacgtaccgttacggttacgaggtccgaccgtagggtcgggtcgtacgggaacgtaggtacgttaccacttcctaccaactactacgacgtcgacgtccgtgacgtacgtcgtaagaaagttttgtttcgactttaagtttttacttcgttcgtacgtacgtacgtaagttactaacgttaacgttaacggtcggttacgtttaacgtacggttttacggggttttccgggaaccggggtaaccggggtaaacctacgggttaaccggtaaaggtaaacctaaaccggtaaaaccgttaacggttcggggttaacggaccggttaccgaaccctaaccgttacgttaccggtttacgttaccctttaacttccgtttcccccgttaaccccg

SEQ ID NO: 85305 - DNA, 556 bp, Homo sapiens
  misc_feature: GYAE6OF01D3TFC.45.72.G06.1.454.CMB.1.raw
  modified_base (317)..(317): a, c, t, g, unknown or other
  misc_feature (317)..(317): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccaggggaaagagccaccctctcctgctgggccagtcagagtgttagcaaccacttagcctggtaccagcagaaacctggccaggctcccagactcctcatttatggttcttctaccaggggccnctggtactcccagccaggttcagtgccaggtggtctgggacagagttcactctcaccatcagcagcctgcagtctagaagtatttgtcgtagttttatttcttgtctagctagtatacaattaacgtggtcttagttacgtagttttggaccgtaggggaaccagtacgtaggtaaatacgaaacgtaacgtggtagcgtcgaccacctacgtcttacgttcttctagtccttaccccg

SEQ ID NO: 85306 - DNA, 583 bp, Homo sapiens
  misc_feature: GYAE6OF01DXCZI.45.72.G06.1.454.CMB.1.raw
  modified_base (316)..(316): a, c, t, g, unknown or other
  misc_feature (316)..(316): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccaggggaaagacgccacctctcctgctgggccagtcagagtgttagcaaccattagcctggtaccagccagaaacctggccaggctccagactcctcattttatggttcttcaccgagggccntggtactcccagccaggttcagtcgccgagtggggtctgggacaggtagttccactctcactatcagcagcctagcagtctgaagtatttgacttagtttatttctgttcagtcctagttatctaataacgtggtacttgtacgttagttttcggaccgtaggggtaaccaacggtacgttaagggaaaacttaccgaaaacggtaccgtaggttgggaccgttgaccctactacgtctacggttcctttactacttcccgttaccc

SEQ ID NO: 85307 - DNA, 575 bp, Homo sapiens
  misc_feature: GYAE6OF01ALQHY.45.72.G06.1.454.CMB.1.raw
  modified_base (543)..(543): a, c, t, g, unknown or other
  misc_feature (543)..(543): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccaggggaagagccaccctctcctgctgggccagtcagagtgtagccaactcttagcctggtaccagcaacgaacctggccaggcctacccgagacctcctactattttatcggtttcttctaccgacgggcctcgtggtactcccgagtccgtaggttcagtcgccgtaggtcgggtcgtgggacaggtacgttcactctacaccatcagcacgtcctgctagtctagaattgtttcgagttattttcttcgtagtctagctagtactcgtaatacgtgtacttagttacgttacggttcggaccggtaggaacctagtacgtagaactaacgaacgtacgtgtacgtcncgactactgtcttactctctcgttcccgtccg

SEQ ID NO: 85308 - DNA, 221 bp, Homo sapiens
  misc_feature: GYAE6OF01DUIK7.45.72.G06.1.454.CMB.1.raw
  modified_base (218)..(221): a, c, t, g, unknown or other
  misc_feature (218)..(221): n is a, c, g, or t
tcagacgcgatcgacacgaccggtgctcgatttagctacgactgcaagggaaaggggaagaggaagactgacggtcctcccaggagttcaggtgctgggcaccttgggcacgggggaggtgtgtcacaagatttgggctctgggcacagcggccctgggctgcctggtcaaggactacttcctcgatcgcgtctgagcgggctggcaaggcgcatagnnnn

SEQ ID NO: 85309 - DNA, 558 bp, Homo sapiens
  misc_feature: GYAE6OF01BAVXZ.45.72.G06.1.454.CMB.1.raw
  modified_base (245)..(245): a, c, t, g, unknown or other
  misc_feature (245)..(245): n is a, c, g, or t
  modified_base (305)..(305): a, c, t, g, unknown or other
  misc_feature (305)..(305): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccaggggaaagagccaccctctcctgctgggccagtcagagtgttagcaaccncttagcctggtaccagcagaacctggccaggctccaggctcctcatctatggtgcttccnccagggcctctggtcgtccccgccaggttcagtggcaggtcggtctgggacagagtttcactctcaccatcagcagtcctgcagtctagtaagtatttgcgttatttattattgtctgctattataatagtctggtccctggtaccgttcggacccgtagggacccgtagggttagaaactacgaaaacgtacgtggtcggtctcgccacctattccgttcgttaccttaccgtacttcccgttccccgtacc

SEQ ID NO: 85310 - DNA, 632 bp, Homo sapiens
  misc_feature: GYAE6OF01E3E2A.45.72.G06.1.454.CMB.1.raw
tcagacgcgatcgacacgaccggtgctcgatttagctacgactgcaagggaaaggggagagctctggggaggaactgctcagttaggacccagacggaaccatggaagccccagcgcagcttctcttcctcctgctactctggctcccagaaaccattggagaaatactgatgacgcagttccagccaccctgtctgtgtctccgaggggaaagacgcccaccctctcctgctgggccagtcagagtgttagccaacctacttagcctggtaccagcaacgtaaacctggccaggcctcccagtacctcctctagtttactcggttcttcctaccgagggtcctcgtggtactcccagtccctaggttcagtcgccgtaggtcggtcgtgggactaggtagtttccacgttcctaccaacctatccgacgccacgccgtgctacgtcgtagtaacgtatttcgtacttagtttactttcgttgtctagtctagtactactattaacgtgtacgttacgttaacgttacggttttacggaccggtacgggacccgaaaggtaccgtaacggtaaagtaaccgtaaacggtaacgttcggtacggtaccgtacggacctaccgttgtcgttacg

SEQ ID NO: 85311 - DNA, 744 bp, Homo sapiens
  misc_feature: GYAE6OF01CQYI1.45.72.G06.1.454.CMB.1.raw
  modified_base (218)..(218): a, c, t, g, unknown or other
  misc_feature (218)..(218): n is a, c, g, or t
  modified_base (310)..(310): a, c, t, g, unknown or other
  misc_feature (310)..(310): n is a, c, g, or t
tcagacgcgatcgacacgaccggtgctcgatttagctacgactgcaaggggaaagggggaggaactgctcagttaggacccagacggaaccatggaagccccagcgcagcttctcttcctcctgctactctggcctcccagaaaccattggagaaatactgatgacgcagtttccagccaccctgtctgtgtctaccgaggggaacacgtccaccctntcctgctgggccagtcagagtgtagcaactctagctggacagcagaactggcagctccagactctctattatggttctactacgcgggtccnctggtactccagtcctaggttcaggtcgccgtaggtcgggtacgtagggaaccgtagtaacggtttcaaccgttcgtaccaacccgtaattccgaacgccgtaacggcccttagggaccctaagggttacctaagggtaaacgtttagttttttcgggaaccttaacggtttaccgttaacttttaacccggttagttaacccgaaaaccgtaggtaacccgtttaacgaaggttaacggtttccggtacccgggtacctttacccgggtaaccggttttacggggaaccgggttaacgggtaaacccggaaggggttaagggaacgttaaacggaaacccggtaaaacggtaaaccgtggggttacggaccgttacggaccctaaacgtacgttccgttacgttaccttaccgtacttcccgtttacccccgg

SEQ ID NO: 85312 - DNA, 658 bp, Homo sapiens
  misc_feature: GYAE6OF01BC070.45.72.G06.1.454.CMB.1.raw
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaatactgatgacgcagtttccagccaccctgtctgtgtctccgaggggaaagacgccaccctctcctgctgggccagtcagagtgttagccaaccacttagcctggtaccagcagaaacctggacccaggcctcccagacctcctactattttagtcggttttccttaccgtacccgacgggggtccccgtcgttagggttaccttccccgaacggtccccgtaacggggttttccaaggttcggccccgtaagggttcgggggtacgtagggggactaggtacggtttccacgttcctacgacccaagtccagccgtagccctagctacgtcgtagtaagttattttggacttagttttattctagttcagtctagtatactatacgtgctgtactgggtttacgaccgtaggggacctagaccgtaggtaactacgtaaacgacgtggtacgattcggaccaaccgtgttaaccttgttacccttacctcccgttccccgtaccc

SEQ ID NO: 85313 - DNA, 533 bp, Homo sapiens
  misc_feature: GYAE6OF01BCWHC.45.72.G06.1.454.CMB.1.raw
  modified_base (244)..(244): a, c, t, g, unknown or other
  misc_feature (244)..(244): n is a, c, g, or t
  modified_base (376)..(376): a, c, t, g, unknown or other
  misc_feature (376)..(376): n is a, c, g, or t
  modified_base (517)..(517): a, c, t, g, unknown or other
  misc_feature (517)..(517): n is a, c, g, or t
  modified_base (521)..(521): a, c, t, g, unknown or other
  misc_feature (521)..(521): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccaggggaagagccaccctctcctgctgggccagtcagagtgttagcaaccncttagcctggtaccagcagaaacctggccaggctcccagactcctcatttatggttcttcctaccgagggccgctggtactcccagccaggttcagtgtcaggtgggtctgggacagtagttcactctcacntcagcagcctgctagtctgaagtattttgctagtttatttctgtcagtctagtctcatactggcttagtacgtagtttggtcaagggaccagctaggtaactacgaaacgtactggtagcgtgcctaccatcgttacgttnttcnttcccgttcccg

SEQ ID NO: 85314 - DNA, 573 bp, Homo sapiens
  misc_feature: GYAE6OF01C9CL4.45.72.G06.1.454.CMB.1.raw
  modified_base (331)..(331): a, c, t, g, unknown or other
  misc_feature (331)..(331): n is a, c, g, or t
  modified_base (546)..(546): a, c, t, g, unknown or other
  misc_feature (546)..(546): n is a, c, g, or t
  modified_base (559)..(559): a, c, t, g, unknown or other
  misc_feature (559)..(559): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccgaggggaaagcgccaccctctcctgctgggccagtcagtagtgttagcaacctacttacgcctggtaccagccaagaaaccctggaccaggcctacccagacctcctcatttatcggtttccttctaccgagggccnctggtactcccagtccagggttcaggtcgccgtaggtggggtctgggacaggtacgttcactctcaccatcagcacgcctgctagtctaggtaagtatttgcttagtttatttcgttgtctagtctagtatcatactggtctgtacgtagtttcggacgtagggacctagtacgtagtaaactacgtaaacgtacgtcggtaggctcgacacctntcttacgtcttcncttccgttaccccg

SEQ ID NO: 85315 - DNA, 586 bp, Homo sapiens
  misc_feature: GYAE6OF01AQHIW.45.72.G06.1.454.CMB.1.raw
  modified_base (202)..(202): a, c, t, g, unknown or other
  misc_feature (202)..(202): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagataccactggagaaatagtggtgacgcagtctccaggcaccctgtctgtgtctccgagggganagagtcaccctctcctgcacggccagtcaaagtgttcgcgaccggatacttagcctggtaccagcagagacctggccagccctccaggcctcctcatctatggtgctatcctccgacgggcctcgtggtcgtcccccgcgtacggtttcgacggtcggctagggttcgggtcgtggggaactaggtacgtttcacttcctcgaccgtcacgcacgtccgtgggacgtcctgtatgtattttgcttagtttcttctgtcacgtctacggtccgttccgcccgtacgcccgtacctccgtacggtttccggggaccgggggtccgaggggtgagtacggtggacggtacgacggtggtcggctcggcacctattctgttccttacg

SEQ ID NO: 85316 - DNA, 624 bp, Homo sapiens
  misc_feature: GYAE6OF01DFEX7.45.72.G06.1.454.CMB.1.raw
  modified_base (325)..(325): a, c, t, g, unknown or other
  misc_feature (325)..(325): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctcgaggggaaagagccaccctctcctgctgggccagtcagagtgttagcaaccattagcctggtaccagacagaaacctggccaggcctcccagacctcctctatttatcggtttcttcctaccgacgggtccnctcggtactcccgagtcctaggttcagtcgccgtaggtggggtctggggactaggtagttccacgttcctccaccatcgagcacgcctgctagtcgtagtaagtattttgacttagttttatttctgtctagtctagttatactataacgttggcttacggttaaccttagggttttcggaccggtaacggggtaccgtaaggtacgtaagggtaaaacgtaccgaaacggtaacgtaggtacggtcgtcgaccgtaacctacgttcgttcgttaccttacgtccttcccgttaccccg

SEQ ID NO: 85317 - DNA, 749 bp, Homo sapiens
  misc_feature: GYAE6OF01CO5IP.45.72.G06.1.454.CMB.1.raw
  modified_base (97)..(97): a, c, t, g, unknown or other
  misc_feature (97)..(97): n is a, c, g, or t
tcagacgcgatcgacacgaccggtgctcgatttagctacgactgcaagggaaagggggaggaactgctcagttaggacccagacggaaccatggaanccccagcgcagcttctcttcctcctgctactctggctccagaaaccattggagaaatactgatgacgtcagtttccagccaccctgtctgtgtctccgaggggaaagcgccaccctctcctgctgggccagtcagtagtgttagcaacctcttacgcctggtaccagacaacgaaacctggaccaggtccctccgaagtacctcctatacttttacgcgggttttcctacctaaccggaggggtcccctgttcggtaacctcccaggtccctaagggttcaacggttcgccgtaagggttcgggtaccttaggggacctaggttacgttctaacgtcctacgacctagtccgaacgtcctgtcccgttagcgttaacgttccgtaaggtaacgtttacgttttacgtacgtttaacggttttactttccgttcgtacgtacgtacgttacgttaacgtacgttaacttacgttacggttacgttacggttacgttacgggttttacggaccggtaacgggttaaccctacggtaacggttaacggtaaagtacccgtaaacggtaaccggttaccggtaggtaccttcggtaacccgtaacttacgttaccgtttacgtacccttttaaccgtaccgtttcccgttaccccg

SEQ ID NO: 85318 - DNA, 633 bp, Homo sapiens
  misc_feature: GYAE6OF01C9GOG.45.72.G06.1.454.CMB.1.raw
  modified_base (202)..(202): a, c, t, g, unknown or other
  misc_feature (202)..(202): n is a, c, g, or t
  modified_base (287)..(287): a, c, t, g, unknown or other
  misc_feature (287)..(287): n is a, c, g, or t
tcagacgcgatcgacacgaccggtgctcgatttagctacgactgcaagggaaagggggaggaactgctcagttaggacccagagggaaccatggaagccccagctcagcttctcttcctcctgctactctggctcccagagacctccggagaaattgtcttgacacagtctccagccattctgtctctctctccgagggganacagcccaccctctcatgcagggccagtcagagtattagaacatactggctggtatcaatacaagcctggccacgggtccccggntcctcatctaatgatgcttccagcgaggccacgtggcactcccagcctaggttcagggtcggcggttgggttcgcacgtagcttcactctacaactatacacgcacgtacctacctaactacgtaagttacgtttacgactacgttacttaacgttactacgttaccgaactacgtaccgtaactaacggtacgttcgggtaccgtaccttaccttacggtttccggggacgggtaacgggtaaccggaaaggggttacgggaagtaaaccggttaacgaaaaccggttaacgttacgggtacggaccggttacgaccctacccgtaacttccgttggtttacccg

SEQ ID NO: 85319 - DNA, 242 bp, Homo sapiens
  misc_feature: GYAE6OF01CO73N.45.72.G06.1.454.CMB.1.raw
  modified_base (221)..(242): a, c, t, g, unknown or other
  misc_feature (221)..(242): n is a, c, g, or t
tcagacgcgatcgacacgaccggtgctcgatttagctacgactgcaaggggaaaggggaagaggaagactgacggtcctcccaggagttcaggtgctgggcaccgttgggcacggggagtgtgtcaacaagatttgggctctgggcacagcggccctgggctgcctggtcaaggactacttcctcgatcgcgtctgagcgggctggcaaggcgacaatagnnnnnnnnnnnnnnnnnnnnnn

SEQ ID NO: 85320 - DNA, 609 bp, Homo sapiens
  misc_feature: GYAE6OF01CC2N2.45.72.G06.1.454.CMB.1.raw
  modified_base (204)..(204): a, c, t, g, unknown or other
  misc_feature (204)..(204): n is a, c, g, or t
  modified_base (403)..(403): a, c, t, g, unknown or other
  misc_feature (403)..(403): n is a, c, g, or t
  modified_base (429)..(429): a, c, t, g, unknown or other
  misc_feature (429)..(429): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccgaggggaaangccaccctctcctgctgggccagtcagagtgttagcaaccacttagcctggtaccagcagaaacctggccaggctcccagactcctcattttatcggtttctttcctaacccgaggggcccgtcgtgggtactcccgaggtccgtagggttcaggtcgccgtaggtggggtctggggacaggtacgttcactctcaccntcagcacgcctgcacgtctgtaagtntttgtcgttagttttactttcttgtctagtacgtagttactacgtattaacgtggtctaggttacgttggttttcgggaccgtaacggggtaccgaacggtacgtaaggtaaacgtaacgaaacggtacgtggtagcggtcgaccgtaccacttcgtacgttcttctcttcccgttcccg

SEQ ID NO: 85321 - DNA, 806 bp, Homo sapiens
  misc_feature: GYAE6OF01DI6U2.45.72.G06.1.454.CMB.1.raw
tcagacgcgatcgacacgaccggtgctcgatttagctacgactgcaagggaaagggggaggaactgctcagttaggacccagacggaaccatggaagccccagcgcagcttctcttcctcctgctactctggctccagaaaccattggagaaatactgatgacgcagtttccagccaccctgtctgtgtctccgaggggaaagcgccaccctctcctgctgggccagtcagagtgttacgcaacctacttacgcctggtaccagcaacgaaacctggaccacggcctacccgacgtacctccgtctaattttacgttcggtttacctttccgtaccggacggggtccgtcgtttacgggtaacctccccgaacgtcccgtagggtttcgacggtccgccgtagggttcggggtccgtagggggaactacggtacggtttcctaaccgttcctaccgtaaccctagttaccgaacggtaccgtaacggacccttggaacccgttaggttaccgttaagggttaaacgttttacgtttttacggtaccttttaaaggttttttacgttttacccgttggttaaccgtaacggttaacctaaggtttaacctttaacgtaacgtttaaccggtgggtaccgtttaggtttaaccggtttacgggttttaccgggaccgggttaacggggtaaccctagggtaccgtaaaggtaaaaccgtacgtaaaccggtaacggttggtacggggtcctacggaccctaaccgtacgtttcctacgtttaccttacctccgtttccccgtaccccg

SEQ ID NO: 85322 - DNA, 776 bp, Homo sapiens
  misc_feature: GYAE6OF01DHZB4.45.72.G06.1.454.CMB.1.raw
  modified_base (203)..(203): a, c, t, g, unknown or other
  misc_feature (203)..(203): n is a, c, g, or t
  modified_base (218)..(218): a, c, t, g, unknown or other
  misc_feature (218)..(218): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccgaggggaanacgccaccctctccngctgggccagtcagagtgttagcaacctacttagcctggtaccagcagaaacctgggaccaggcctcccagtacctcctctatttacttggttccttacgtaccgacggggtccgcgttggtacctcccaggtccgtaggtttcacggttcgaccgtaggtcggggtcgtaggggactaggtacgttaccacgttcctacaaccgtactaccgacgtccgaaccggtccctaggacgtaacgttaccgttaggtaaacggtttacttttacggtactttacggtttttaacttttcgttacgggttacctaacgtacgttacggtttaactttacgttaacgttaacggttcgggtacgtttacggtttaaccggtttacggggtttttacgggaaccgggttaaccgggggtaaccgtaacgggttaccggtaaacgggttaaaacgtaaccggtaaaaacggttaaccggttacggggtacggtacggttaccggaccctaacccgttaacgttccgttacgtttccctttacctacccgtttcccgttaccccgg

SEQ ID NO: 85323 - DNA, 227 bp, Homo sapiens
  misc_feature: GYAE6OF01DC3G4.45.72.G06.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (208)..(208): a, c, t, g, unknown or other
  misc_feature (208)..(208): n is a, c, g, or t
  modified_base (211)..(227): a, c, t, g, unknown or other
  misc_feature (211)..(227): n is a, c, g, or t
tcagacgcgatcgacacgaccggtgctcgatttagctacgactgcaagggaaagggaagaggaagactgacggtcctcccaggagttcaggtgctgggcaccttgggcacgggggaggtgtgtcacaagatttgggctctgggcacagcgccctgggctgcctggtcaaggctactctcgatcgcgtctgagcggntggcaaggcnanagnnnnnnnnnnnnnnnnn

SEQ ID NO: 85324 - DNA, 924 bp, Homo sapiens
  misc_feature: GYAE6OF01CJA7U.45.72.G06.1.454.CMB.1.raw
tcagacgcgatcgacacgaccggtgctcgatttagctacgactgcaagggaaagggggaggaactgctcagttaggacccagacggaaccatggaagccccagcgcagcttctcttcctcctgctactctggctccagaaccattggagaaatactgatgacgcagtttccagccaccctgtctgtgtctccgaggggaaagacgcccaccctctcctcgctcgggccagtcagtagtgttagccaacctacttagcctggtaccagtcaacgaaacctcggccacggcctacccgagtacctcctactattttacgtcggtttcctttccgtaaccgtcgggtccgtcgtcgggtacctcccgacggtccgtaggttccgaaggtcgaccgtaggttcggggtacgtggggtaactggtaacgtttccacttccgtcccaacctcgtacgaacgtccacggtccctaggacctacggttccgtaaggtaaggtttacgtttttacggacgtttacgttttttaacttcgttacgggttacgtaacggttaccgtaagggtttaccttaacgtaacgttttaaaccggttacgggttacgttttaaccggtttaacggttttaacgggggttttttaccccgggggtaaccccgggggttaaacggggggtaaacccccgtaaccgggtttaaaccggtaaaccgggggttaaaaaaccttaaaacccgggttaaaaaacccgggttaaaccgggtttttaacccgggggttaacccgggttaacccgggtttaacccccggtaaccccgttaaaccccgggtttaaaaccccgtttttccccgggttttaaccggggttttaaccccctttttaaccccttaaacccggggtttttaaccccccccccttttaccccccgggg

SEQ ID NO: 85325 - DNA, 682 bp, Homo sapiens
  misc_feature: GYAE6OF01BC4RL.45.72.G06.1.454.CMB.1.raw
  modified_base (301)..(301): a, c, t, g, unknown or other
  misc_feature (301)..(301): n is a, c, g, or t
  modified_base (453)..(453): a, c, t, g, unknown or other
  misc_feature (453)..(453): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgctagtttccagccaccctgtctgtgtctccgaggggaaagacgccaccctctcctgcgtggccagtcagagtgtagcaaccactagcctggtaccagcagaacctggaccacggcctaccagacctcctctatttntcggttccttctaccggaggccgtctcggtactcccacggcctaggttcgacggttcgaccgtaggtcggggtcgtggggaactgtacgttccgacttcctaccacctatcgacgcctacgtccttagacctacggtactggtaaacgtttntttacggacgtttacgttttactttcgttacgtacgtaacgtactaagttacttacaagttacgtggtcttacgtaacggttacggtttccggacggttacggggtaaccaagggtaccgtaaggtaaacctaaccgtaaaaccggttacgtacgggtacggtaccggtcgacccgtaaaccgtcgtttaccggtctttaccctaccgttctttacccccggttccccg

SEQ ID NO: 85326 - DNA, 619 bp, Homo sapiens
  misc_feature: GYAE6OF01ARY9Z.45.72.G06.1.454.CMB.1.raw
  modified_base (202)..(202): a, c, t, g, unknown or other
  misc_feature (202)..(202): n is a, c, g, or t
  modified_base (234)..(234): a, c, t, g, unknown or other
  misc_feature (234)..(234): n is a, c, g, or t
tcagacgcgatcgacacgaccggtgctcgatttagctacgactgcaagggaaagggggaggaactgctcagttaggacccagagggaaccatggaagccccagctcagcttctcttcctcctggcactctggctcccagataccaccggagaaattgtgttgacacagtctccagccaccctgtctttgttccaggggaaanagccaccctctcctgcagggccagtcagggtnttaacagctacttagcctaggtaccaaacaaaaacctggaccaggcctcccaggctcatcatctacctgacgcagtcgaaacgcgggaccacgtcggacactcccgacgccgtaggttcgaggtgggtacgggttggtttcgggactacgaagtaccttcaacgttcctacactaactccagtcacgtcctaccaactagaagtagtttgactacgttactattactatacaacagacgtactagtacgtcgaccgtctacgtacgttacggacggacgggtaaccgaggtacggagtacaacgaaacgtaacgtaggtcggacgtcgacgtacctacgtacgttcgttaccttactacttacccttacccgtccgtacgtaccg

SEQ ID NO: 85327 - DNA, 721 bp, Homo sapiens
  misc_feature: GYAE6OF01DBQJ9.45.72.G06.1.454.CMB.1.raw
tcagacgcgatcgacacgaccggtgctcgatttagctacgactgcaagggaaagggggaggaactgctcagttaggacccagacggaaccatggaagccccagcgcagcttctcttcctcctgctactctggctccagaaaccattggaagaaatactgatgacgctagttccagccaccctgtctgtgtctccgaaggggaagacgcccaccctctcctgcgtgggccagtcagtagtgttagacaacctacttacgccgttaggaccagacgacgaaacctcgggccacggcctacccaacgacctcctacgtattttacgttggtttacctttacctaccggacgggtccgtcggttcggtaccgttcccacggtacccgtaggttactacggtccgccgtaggttcgggtcgttagggacgtaaggtacgttacgtacttccgacctaccacttacgaacgtctaccgtccgtgacgtgtactaggtaacgtttagtttcgtaacgttttagttttacgttcgttaggtctaaggtctagttactactacgttaacgtcgggtcttacggttaacggtttggttaccgggccggtaagggtacctaggtacggttaaaggtaaaccgtaacgaacggttacgttacggtacggtccgttacacccgttacgttacgtccgtttacgtttcccgttactccgtttccccgttaacccg

SEQ ID NO: 85328 - DNA, 674 bp, Homo sapiens
  misc_feature: GYAE6OF01BFYPC.45.72.G06.1.454.CMB.1.raw
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgctacgtttccagcccaccctgtctgtcgtctccgaagggggaaacgcgcccaccctctcctggccgtgggccagtcaggtagttgttacgaccaacctacttacgccgtggtaaccagaccgaacggtaaacccgtggacccgacggacctacccgacgaccctccctactaattttacgtcggtttccttccgtaccggtacggggcccgtcgttacggtactccccgaggccgtacgggttcaggtccgacgtacgggtcgggtacgtgggaactggtacgttccacgtctaccacctagtccagcaccgctacgcgtacgtactagtagttactttacgtagtttacgttttactttacgtgtacgtagtacgtactaatcgtaatacgtacgtctaggttacgtggttaccggacggtacggaccgtaggtacgtaagtaacgtaacgaaacgtagtacggtagacgtccgctactgtccttactacgttctacgttccctaccg

SEQ ID NO: 85329 - DNA, 768 bp, Homo sapiens
  misc_feature: GYAE6OF01AYLCP.45.72.G06.1.454.CMB.1.raw
  modified_base (145)..(145): a, c, t, g, unknown or other
  misc_feature (145)..(145): n is a, c, g, or t
  modified_base (166)..(166): a, c, t, g, unknown or other
  misc_feature (166)..(166): n is a, c, g, or t
  modified_base (200)..(200): a, c, t, g, unknown or other
  misc_feature (200)..(200): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccnttggagaaatactgatgacgnagtttccagccacctgtctgtgtctcagggaagngccacctctcctgctgggccagtcagagtgtagcaacctacttagacctggtaccagacaacgaaccctggtacccaggtcctacccgagtacccttccgtatacttttagtcgtttaccttacgtacccgacggggtcccgtcgttaggtacctccccgaggtcccttaacggggtttcaacggtcggaccgtagggtcgggtacggtacggggactaggtaccggttaccacttccgtacacctactcgacggtaccacggtccctagtacgagttaccgtaggtacgttagttttacgtacgttacgtttttaacgtttccgttacggttactaacggtaccgttaacggttacttaaccgttaacgtttaaccgttacggttaccgttaggtttaaccggtttacggggtttttaccggaacccgggtaaccggggtaaccgtaacgtaacggttaaggaaaccttaaacgaaaccggtttaacggtcggttacggaccgttcgtaccgtaccgttacgtaccgtttcgttaacccgttacgttcccgttcccgttaacccccg

SEQ ID NO: 85330 - DNA, 766 bp, Homo sapiens
  misc_feature: GYAE6OF01AVEZ2.45.72.G06.1.454.CMB.1.raw
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccgaggggaagacgcccaccctctcctgcgtgggccagtcagagttgttagcaaccacttagcctggtaccagcaacgaaacctggaccaggcctcccagacctcctactatttatcggtttcttacgtaccgagggtccgtcgttaggtactcccgtacgcccgtacgggtttccaacggttccgacggttcggggttccgtacggggtacggtaacggtacggtttacccgtacgttacccgtacctaacccgaactttaccgaacggtacccggaacggtcccccttacggaccgttaacggttacgttaacggttaagttaacgttttttcggttacccgtttagtttttaacgtttttccgttcgtttaacggtagtacgttaaccgttacgttactaacgtttaacggttacgtacttcggtttacgtttacggtttcggtaccggtacggggtaacctacggtaacggtacggtaaactaacgttaaaccgaaaggttcgtacgggttactacggacctacccgtagtcgtttacgttcctttacgacctttccgttccccgtaccg

SEQ ID NO: 85331 - DNA, 830 bp, Homo sapiens
  misc_feature: GYAE6OF01CFHE2.45.72.G06.1.454.CMB.1.raw
  modified_base (200)..(200): a, c, t, g, unknown or other
  misc_feature (200)..(200): n is a, c, g, or t
tcagacgcgatcgacacgaccggtgctcgatttagctacgactgcaagggaaagggggaggaactgactcagttaggacccagacggaccatggaagccccagcgcagcttctcttcctcctgctactctggctccagaaccagttgagaatactgatgacgcagtttccagccacctgtctgtgtctaccgagggaacncgaccaccctctaccgtcgcgtcgggacccagttccgagtacggttcgttaacggaccaaccgtaacgttacggcccttacggttaaccagaccgtaacggtaaacccgtcggaccgaggtaccctacccggacgtaccctaccgtacttaagtttacgtacggtttacctaccgtaaccggtaggtcccgtactacgggtacctacccggacgtacctagggttacccagggttacgacccggttagggtacggttaccggtacgggtaactacgggttaaccgttaccgtaacgttcccggttaaccaacccgttacgttaccgacggaaccccgtacgggtaccttacggtaccgtaacggtttacgtaacggtttaaaacctttcggttttaacgtaaccgttttaacgttttacgtttacgtaaccggttacgtaacgtacgttaacgttactaacgttaacggttaaccgttggtaccgtttaacggtaacggtttacggttttaccgggaccccgttaaggggaaccttaggtacgtaacgttaaaccggactaaacggttacgtcgtacgacgttacgaccgtacttacgtcgtaacttccgttactccgtcccgttacccg

SEQ ID NO: 85332 - DNA, 828 bp, Homo sapiens
  misc_feature: GYAE6OF01EJTFG.45.72.G06.1.454.CMB.1.raw
  modified_base (508)..(508): a, c, t, g, unknown or other
  misc_feature (508)..(508): n is a, c, g, or t
tcagacgcgatcgacacgaccggtgctcgatttagctacgactgcaagggaaaggggaggaactgctcagttaggacccagacggaaccatggaacgcccagcgcagcttctcttcctcctgctactcgtggcctccagactaccgaccggaagtaaattgtgttacgacactacgtcctaccacgccctaccttgttcgtttcgtttaccgaagggtaaacgcgaccctacccttctcgtgaccgacggaccgtaggtacggacgtcgtacgtaaggttaacgtacgttacggtcgtacggtaaacccaaacgtaacggaaaccgtcggaccgtacggcctaccggacgtcctccttacgacctaccagtacgactcgtactaactaacccgaacggtaccgggtcccctcggggacccttaccggaacgtacgttaccgggtttcccgaggacgtagggtttccgggcgtagggaactcggttacgtcctacctacgcctaccggnacggctacgtcgtacggcttaccggatgttacgtttcgttacggttacttacggttttacgccgttagtacgaccgttacgtaccggtttcccgtacccggtacgtccccggttaccgtttccgtacccggggttacggggttacccggggggtacgggtaaccggttaggggtaacgggttagtaccgggaacgggtaaccggtaccgggtacggttacggtcgggaacctttccggaccctaacccggttttgttcccggttacgtttaaccggtccctttaacccggttccgtacccgttcttaaccgttggtaccg

SEQ ID NO: 85333 - DNA, 653 bp, Homo sapiens
  misc_feature: GYAE6OF01BK1Y9.45.72.G06.1.454.CMB.1.raw
  modified_base (335)..(335): a, c, t, g, unknown or other
  misc_feature (335)..(335): n is a, c, g, or t
tcagacgcgatcgacacgaccggtgctcgatttagctacgactgcaagggaaaggggagagctctggggaggaactgctcagttaggacccagacggaaccatggaagccccagcgcagcttctcttcctcctgctactctggctcccagaaaccattggagaaatactgatgacgcagtttccagccaccctgtctgtgtctccgaggggaaagagccacccctctcctgctgggccagtcagagtgttagcaacctacttagccgtggtaccagcaagaacctggccaggctcccagacctcctctatttatcggttcttctaccgagggccncgtcggtactcccagcctaggttcacgttcgccaggtcgggtcgtaggggactaggacggttcacttccgtacacctatcaagccacgcctaggcctagtctagtaaagtgttttcggacttaacggttttatttcgtcgtactagtcctacggtccgtttaacccggccctaacccgggtccgtccgttaccggttaccggtttacccggggggccggggggtaacccgtaggggggttccgaaggtacgttgggaaacggtaccggtaacggtcgggtacgggtactcggaccctacgtacttccgttggttaccc

SEQ ID NO: 85334 - DNA, 724 bp, Homo sapiens
  misc_feature: GYAE6OF01A8VS9.45.72.G06.1.454.CMB.1.raw
  modified_base (256)..(256): a, c, t, g, unknown or other
  misc_feature (256)..(256): n is a, c, g, or t
  modified_base (410)..(410): a, c, t, g, unknown or other
  misc_feature (410)..(410): n is a, c, g, or t
  modified_base (511)..(511): a, c, t, g, unknown or other
  misc_feature (511)..(511): n is a, c, g, or t
  modified_base (571)..(571): a, c, t, g, unknown or other
  misc_feature (571)..(571): n is a, c, g, or t
  modified_base (601)..(601): a, c, t, g, unknown or other
  misc_feature (601)..(601): n is a, c, g, or t
tcagacgcgatcgacacgaccggtgctcgatttagctacgactgcaaggggaaagggggaggaactgctcagttaggacccagacggaaccatggaagccccagcgcagcttctcttcctcctgctactctggcctacccaagaaaccagtttagggaagtaaataccgtggaatcgaccgtctagtttccacgccctaccctgtctgtcgtcctacggagggaaacgcgccctaccctctcgcgcgtcgggaccnggtaccaggtacggttagttacgacctaaccgtactcgccgtacgtaccgagaccaacggtaaaccgtcggaccgacggtacctacccaacgtccctacctacgttagttttattccggttctaccgaaccggtggtccgtactaggttacccnccgtaccgtacgttacggtaacgtcgtacgtcggtacggttcggcggtaggaacgacggtcgctacgtccgtaactactcggtacacgtacgcgtacccgngtacgtacgtcgaagttcgtttactttgtaacgtttacgtttagtcttacgtcttaacgngttactctaagttacgttgacgttaggttnttaacgttacggggtacgttacccgaagggaactaccgaagtaagtaaccgtaaacgaaccggttaggcgtacgtcccgtacgacttccggaattccttagttcctaacctccgttcgtcccg

SEQ ID NO: 85335 - DNA, 811 bp, Homo sapiens
  misc_feature: GYAE6OF01CQ7AJ.45.72.G06.1.454.CMB.1.raw
  modified_base (97)..(97): a, c, t, g, unknown or other
  misc_feature (97)..(97): n is a, c, g, or t
  modified_base (211)..(211): a, c, t, g, unknown or other
  misc_feature (211)..(211): n is a, c, g, or t
  modified_base (230)..(230): a, c, t, g, unknown or other
  misc_feature (230)..(230): n is a, c, g, or t
  modified_base (255)..(255): a, c, t, g, unknown or other
  misc_feature (255)..(255): n is a, c, g, or t
tcagacgcgatcgacacgaccggtgctcgatttagctacgactgcaagggaaagggggaggaactgctcagttaggacccagacggaaccatggaancccccagcgcagcttctcttcctcctgctactctggcctcccagaaacctattaggaagaaatactgatgacgctagttccagcccaccttgtctgtcgtctaccgaagggaancgcccacctctcctgccgnggccagtcagtagtgtacgctaacncttagcctggtaccagacaacgtaaccgtcggacctaacggcctacccagaccttcctacgtattttacgtcggttaccttaccgaccgtagggccctacgtcgtaaccgtcccgtacgacccgtacggtttaccgacgtccgaccgtaggttcgggtacgtacggggtaacgtaggtaaccgtttcaaccgttcctaaccgtaaacctcgtttaccgaaacggtcccgtaaccgtacccgtcgtaccggtagttaccgttaacggtaaacgttttctttacggttaccgttttaagtttttaccgttaccgttacgttacgtaacgttagtaacgttacgtacgtaacgttaacgtacgtttaccgttacggtttaacgttcggggtttaccgggaccggttaacggggtaacctacgggttaaccggtaaaaggttaaaccgaaaccggttaaaaccggttcggtaacgggtaccggtaccgtaaccggaccgttaacccgttgtttaccgttaccgttaccctttacgttaacccgtttccccgtttaccccg

SEQ ID NO: 85336 - DNA, 891 bp, Homo sapiens
  misc_feature: GYAE6OF01CZ6WA.45.72.G06.1.454.CMB.1.raw
  modified_base (145)..(145): a, c, t, g, unknown or other
  misc_feature (145)..(145): n is a, c, g, or t
  modified_base (219)..(219): a, c, t, g, unknown or other
  misc_feature (219)..(219): n is a, c, g, or t
  modified_base (824)..(824): a, c, t, g, unknown or other
  misc_feature (824)..(824): n is a, c, g, or t
tcagacgcgatcgacacgaccggtgctcgatttagctacgactgcaagggaaagggggagaactgctcagttaggacccagacggaaccatggaacgcccagcgcagcttctcttcctctgctactctcggacctccaagaaacngttaggaataaacttactgatgacgcgttacgttaccacgcctaccgtgttctgtctacgtacggaagggaacncgaccctaccgttctcgttcggccgtcggacgtacggttacgaggtacggttacgttacgaacctaaccgtacgtttacggaccgtttacgggaaccgaaacggaccgaaaaccggtaaacccggtcgggaacccgtaaccgggtaccttaaccccgaacgttaccccgttacctttaacgtttaacgtttacggtttaccggttttaaccgtttacccggttaaaccggccgggttaccgtacgtttacccggtacgtacccggtaaacggtccgtaacggtttccgaacggttccggaaccggtagggtttccgggggtacggttaagggaacccgttaagggttacctacggtaaccctacctaccgtaaactacgtcccgaaggaccccggtaacgttcccgggtaacgaccgtttaaacgggttctaaaacggttaagttttacgttacgtttacgttttaacgtttacgttcgtagggtactaacgtagtactagttactagttacgagttcacggttgtttacggtacggaccgaagggtaccaagggtaacctaaacgggtaaacctaggttaaccgtacggttaacggcgttaacncgggttaaacccacgtttaaccgtcctttaaacggttaccttacccgtaccggtttcccctaaccgg

SEQ ID NO: 85337 - DNA, 515 bp, Homo sapiens
  misc_feature: GYAE6OF02G63VN.45.72.G06.1.454.CMB.1.raw
  modified_base (203)..(203): a, c, t, g, unknown or other
  misc_feature (203)..(203): n is a, c, g, or t
  modified_base (316)..(316): a, c, t, g, unknown or other
  misc_feature (316)..(316): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccaggggaaanagccaccctctcctgctgggccagtcagagtgttagcaaccacttagcctggtaccagcagaaacctggccaggctcccagactcctcatttatggttcttctaccagggccnctggtactcccagccaggttcagtgccagtggtctgggacagagttcactctcaccatcagcagcctgcagtctgaagtatttgctagtttatttctgtctagctagtatcatactgctgtactagtttcggccgtagggaccaagcgtagaactcgaaacgtacgtggtgcgtgcacatctgtctactacttctcccg

SEQ ID NO: 85338 - DNA, 514 bp, Homo sapiens
  misc_feature: GYAE6OF02HT92H.45.72.G06.1.454.CMB.1.raw
  modified_base (203)..(203): a, c, t, g, unknown or other
  misc_feature (203)..(203): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccaggggaaanagccaccctctcctgctgggccagtcagagtgttagcaaccattagcctggtaccagcaagaaacctggccaggctcccagactcctcattttatggttcttctaccgaggggccgctggtactcccagccaggttcagtgccaggtgggtctgggacagagttcactctcacatcagcagcctgcagtctgaagtattttgctagtttatttctgtcagtctagtatctatactgctgtactagtttgctagggaccaagctagaatcaaacgtacgtgtgctgcactatctgttcttctactcttcccg

SEQ ID NO: 85339 - DNA, 220 bp, Homo sapiens
  misc_feature: GYAE6OF02FWRHE.45.72.G06.1.454.CMB.1.raw
  modified_base (217)..(220): a, c, t, g, unknown or other
  misc_feature (217)..(220): n is a, c, g, or t
tcagacgcgatcgacacgaccggtgctcgatttagctacgactgcaagggaaaggggaagaggaagactgacggtcctcccaggagttcaggtgctgggcaccttgggcacggggaggtgtgtcacaagatttgggctctgggcacagcggccctgggctgcctggtcaaggactacttcctcgatcgcgtctgagcgggctggcaaggcgcatagnnnn

SEQ ID NO: 85340 - DNA, 609 bp, Homo sapiens
  misc_feature: GYAE6OF02I3T56.45.72.G06.1.454.CMB.1.raw
  modified_base (212)..(212): a, c, t, g, unknown or other
  misc_feature (212)..(212): n is a, c, g, or t
  modified_base (258)..(258): a, c, t, g, unknown or other
  misc_feature (258)..(258): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccaggggaaagagccacctntcctgctgggccagtcagagtgttagcaaccattagcctggtaccngcagaaacctggccaggctcccagactcctcatttatggttcttctaccgagggccgctggtatccccagccagttcagtgccagtggctgggacagagttcactctcaccatcagcagcctgcagtctgaacgtatttgctagtttatttctagttcacgtacagttatctactaacgtggtacgttagttactaggtttttcggaccgtaagggggtaccgtaaaggtccgttaaggtaaacgttacgtaaaacggtaaccgttacggttacggaccgtttaacgcccgttaaacccgtaacttaccgttacggttacctttaccgtaactttccccgttaacccccgg

SEQ ID NO: 85341 - DNA, 750 bp, Homo sapiens
  misc_feature: GYAE6OF02I0QIN.45.72.G06.1.454.CMB.1.raw
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccacctgtcctgtctcacggaaggaagcgaccctacctcctcgtcgtcggtccggacgtacgtacgaggttaggttaggttacgaacctaaccttaacgttaccgtccggttaaccgaccgacgaacgaaaccgtaaccggtccgacggacgtccccaccgaacgtacccttcctattaattaggttcgtttaccttacctaacgggccgggccttcggtagtaccctaccgacgtacgttacgtacgtggtccgaccgtagggtcggttcggtacggacgtaggttactactactcctaaccaactacgacgcgacgaccgtcgtcgacgttacgtagtaacggtaattttcgttacgtagttttaattttacgttcgtacgtagtacgtacgttaactactacttaaacgttaggtcgttacgttacgttacgttttacgggttacggaacggggtaaccgtaaacgacgttaaggaaacgttaacgtaaccggtaaacgttacgtcgggtactacggtactaccgaacgttacgttccggttacttaccgtacttccgttacccgtaccccg

SEQ ID NO: 85342 - DNA, 588 bp, Homo sapiens
  misc_feature: GYAE6OF02IW8BN.45.72.G06.1.454.CMB.1.raw
  modified_base (202)..(202): a, c, t, g, unknown or other
  misc_feature (202)..(202): n is a, c, g, or t
tcagacgcgatcgacacgaccggtgctcgatttagctacgactgcaagggaaagggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgcagggccagtcagagtattagaacatacttggcctggtatcaatacaagcctggccgacgggtccccggctcctcatctatgatgccttccagcacgggccacgtggcactcccagccgaggttcaggtcggcgggttgggtttggcacgagtacttcactctcaacatcagcacgcctaccaacctagaacgtagttttagtacgttcttatttactgtaccaactcgtacgtacagtacgttcggccgtctctaccgtttcgggacgggtaacgggaccgtaagggtaggaacggtacgtaaccgaaaaccggtaacgtggtacggtactacggacctaacccgtatccgttacggttaccttaccg

SEQ ID NO: 85343 - DNA, 508 bp, Homo sapiens
  misc_feature: GYAE6OF02IBC70.45.72.G06.1.454.CMB.1.raw
  modified_base (315)..(315): a, c, t, g, unknown or other
  misc_feature (315)..(315): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccaggggaaagagccaccctctcctgctgggccagtcagagtgttagcaaccacttagcctggtaccagcagaaacctggccaggctcccagactcctcatttatggtcttctaccagggccnctggtatcccagccaggttcagtgccagtgggtctggggacagagttcactctcaccatcagcagcctgcagtctgaagtattttgctagtttatttcttgtctagcagtatcataactgctgtacagttttggcagggaccaagctagaatacaacgacgtgtgctgacaccatctgtcttctactctcccg

SEQ ID NO: 85344 - DNA, 778 bp, Homo sapiens
  misc_feature: GYAE6OF02IA1AK.45.72.G06.1.454.CMB.1.raw
  modified_base (158)..(158): a, c, t, g, unknown or other
  misc_feature (158)..(158): n is a, c, g, or t
  modified_base (348)..(348): a, c, t, g, unknown or other
  misc_feature (348)..(348): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagataccaccggagaaattgngttgacgcagtctccaggcacccttctcgtctccacgggaaaggaagcacccctcctcctcgcgacggccgacgtcgagaactaacttacttcggcgagactactttacgaccgtcggttaccgaacgcgaacgaaaccgtacggcgacggtacccgacgcgtcctccatctatagatgtccttccacgnacggaccgaaccttagggcacttaccccgacgaccgtacggttactagtcgggccgggttgggggtttttcggggccaacccaagggtaaacccgtttcgttacccgtactttaccccggaacgaaaaccttacgtaccgaccgaccggtaccccgttacccctaaacccgttaaccggaaaggttaaactttttcggtaccgtaccggttacgttaacctttaacgtttacggtaccttaaaccgaacggtacggttacccaaggtagttaccggtccggtccctactaccgtttacccggtgggaaccggggtaacgaaaccgggttagggacgtaactaccgtaaacggaaacgttacggtgggtaccgttacggaccgaaccctaaccgtagtttcccggtacttttcccgaactttacccccggg

SEQ ID NO: 85345 - DNA, 550 bp, Homo sapiens
  misc_feature: GYAE6OF02G8K7V.45.72.G06.1.454.CMB.1.raw
  modified_base (303)..(303): a, c, t, g, unknown or other
  misc_feature (303)..(303): n is a, c, g, or t
tcagacgcgatcgacacgaccggtgctcgatttagctacgactgcaagggaaagggggaggaactgctcagttaggacccagacggaaccatggaagccccagctcagcttctcttcctcctgctactctggctcccagataccaccggaaaaattgtgttgacacagtctccaggcaccctgtctgtgtctccaggggagacggccaccctctcctgcagggccagtcagtatgttagcaccaacttagcctggtaccaacagagacctgcccaggcctacccaaactcctcatctctggtntatctaccagggccactggtctcccagacaggttcaagggcaggtgggtctgggacaggagttcactctcacatcaggcggcctgcagtctagaagtgttttaggtactttattactgtcagtatagtataatctacgtcggtacctacgtacgtttcgggaccgggtaccgaagcgtaggagtacgtacgaaacgtactaggtcgcgtgcactatctcgtcttctactccttcccgcctactctcg

SEQ ID NO: 85346 - DNA, 577 bp, Homo sapiens
  misc_feature: GYAE6OF02GF228.45.72.G06.1.454.CMB.1.raw
  modified_base (203)..(203): a, c, t, g, unknown or other
  misc_feature (203)..(203): n is a, c, g, or t
  modified_base (408)..(408): a, c, t, g, unknown or other
  misc_feature (408)..(408): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccaggggaaangccaccctctcctgctgggccagtcagagtgttagcaaccacttagcctggtaccagcagaacctggccaggctcccagactcctcatttatggttcttctaccgagggccgctggtactcccagcctaggttcagtcgccaggttcgggtctggggacaggtacgttcactctcaccatcagcagcctgctagtctagtaagtntttgacttagtttatttcgtgttcgtagtctagtatactataacgtgtcgttagttacgtagttttcggaccgtagggacctaagtacgtaggtaactacgtaacgtacgtaggtacggtcgtcgtaccgtacctagttacgttcgttcttacgtacttccttaccccg

SEQ ID NO: 85347 - DNA, 552 bp, Homo sapiens
  misc_feature: GYAE6OF02FY80N.45.72.G06.1.454.CMB.1.raw
tcagacgcgatcgacacgaccggtgctcgatttagctacgactgcaagggaaagggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctccaggctcctcatccatgatgcatccaacgacgggtccctgggccgtcccagacagggttccgtggcagtggggtctggggacagagttcactctcaccgtcagcagcctggacgcctgatgtatttgctagtttacttcgtgtcagcagtccgttccgccaccgccgcttccaccgtttcgggccgggggtaccgaggggttcggagagtagacgacgacgtggtggctgacctaccgagttcgtcgttcttcgacttcctccccgactacg

SEQ ID NO: 85348 - DNA, 690 bp, Homo sapiens
  misc_feature: GYAE6OF02JWWI4.45.72.G06.1.454.CMB.1.raw
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccgaggggaagagccaccctctcctgctgggccagtcagagtgttagcaaccacttagcctggtaccagcaagaaacctggaccaggcctcccagacctcctctatttactcggtttccttaccgtaccgacggggtcctcgttacggtactcccgagtccgtagggtttccacggttcgaccgtagggttcggggttcgtacggggactaggtcgttccgacttccgtcaccgtagtcacggccacggtcctaggacgtacgtcgtagtaagttacgtttgtacttagtttacgtttcgtaggttactacgtacgtagtacttactaacttaacggttggacttaggttacgtttacggttttccgggaaccggtacgggtaacctaacgggtacgttaaggaaccgttaacgaaaccgttacggtcgggttacggacttacggaccttaaccgactttccgttacgttaccttaccttaccgttacccttaccccg

SEQ ID NO: 85349 - DNA, 534 bp, Homo sapiens
  misc_feature: GYAE6OF02FM12S.45.72.G06.1.454.CMB.1.raw
  modified_base (203)..(203): a, c, t, g, unknown or other
  misc_feature (203)..(203): n is a, c, g, or t
  modified_base (410)..(410): a, c, t, g, unknown or other
  misc_feature (410)..(410): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccatcctgtctgtgtctccaggggaaanagccaccctctcctgctgggccagtcagagtgttagcaaccacttagcctggtaccagcagaaacctggccaggcctcccagacctcctcatttatggttcttctaccagggcctctggtactcccgagcctaggttcaggtcgcctaggtgggtctggggacaggtagttcactctcacctatcagcagcctgcagtctagaagtntttgcttagtttatttctgttcagtctagtatcattaacgtggcttgtacttggtttcggcgtagggaccagcgtaggactacgaaacgtacgtggtggctgacactatctgtcttctacttcc

SEQ ID NO: 85350 - DNA, 662 bp, Homo sapiens
  misc_feature: GYAE6OF02F8X6G.45.72.G06.1.454.CMB.1.raw
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccgaggggaaagagccaccctctcctgctgggccagtcagagtgttagcaaccacttagcctggtaccagcagaaacctggccaggctccagactcctcatttatggttcttctaccgagggccgtctggtactcccagccgtaggttcagttcgccgtaggtggtctggggacaggtacgttcactctcaccatcagacacggccctagctagtccgtagtaagtagttttcgacgtttagttttactttcgttcgttacgtaaggtacctagttactactaactttaaccgttggttaccttaggttacgtttaacggtttttcgggacccggtaacgggggaaccctaaaggtccgtaacggtaaaccgtacgtaaaacggtaacgttagggtacggtaccggtacggtacccgtaaccgtacttaccggttcgttaccctttcttacccgttcccgtttaccccgg

SEQ ID NO: 85351 - DNA, 584 bp, Homo sapiens
  misc_feature: GYAE6OF02JHBL6.45.72.G06.1.454.CMB.1.raw
  modified_base (203)..(203): a, c, t, g, unknown or other
  misc_feature (203)..(203): n is a, c, g, or t
  modified_base (385)..(385): a, c, t, g, unknown or other
  misc_feature (385)..(385): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccaggggaaangccaccctctcctgctgggccagtcagagtgttagcaaccacttagcctggtaccagcagaaacctggccaggctcccaggctcctcatccatgatgcatccaacaggtccctggcctcccagcaggttccgtggcagtgggtctggggacagtagtcactctcaccgtcagcagccgtggngcctgatgtatttgctagtttacttctgttcagtcacgtccgttccgccgaccgccgtccgtcgtaccgtttccggggaccgggggtaccgtagggggttacggaacggtagtacggacggacgtaacgttcgggtaggtcctggtccctaaccgtacgttccgttcgttccgtttactacgttccccgtttaccccgg

SEQ ID NO: 85352 - DNA, 558 bp, Homo sapiens
  misc_feature: GYAE6OF02GAJCC.45.72.G06.1.454.CMB.1.raw
  modified_base (202)..(202): a, c, t, g, unknown or other
  misc_feature (202)..(202): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccaggggaangccacctctcctgctgggccagtcagagtgttagcaaccacttagcctggtaccagcagaaacctggccaggctccagactcctcatttatggttcttctaccgagggcctcgtggtactcccgagcctaggttcagtcgccaggtggtctgggacagagttcactctcaccatcagcacgcctgcagtctagtaagtatttgcttagtttattctgtactagtactagttatctattaacgtgtcttagtacgtagtttcggaccgtacgggaccagtacgtagtaactacgaacgtacgtcggtacgtcgtacgaccgtactacgttcgtacgttactctacttcccttacccg

SEQ ID NO: 85353 - DNA, 583 bp, Homo sapiens
  misc_feature: GYAE6OF02G0PR3.45.72.G06.1.454.CMB.1.raw
  modified_base (207)..(207): a, c, t, g, unknown or other
  misc_feature (207)..(207): n is a, c, g, or t
tcagacgcgatcgacacgaccggtgctcgatttagctacgactgcaaggggaaagggggaggaactgctcagttaggacccagacggaaccatggaagccccagcgcagcttctcttcctcctgctactctggcctcccagaaaccattggagaaatactgatgacgcagtttccagccaccctgtctgtgtctccgaggggaaagngccaccctctcctgctgggccagtcagagtgttagcaaccacttagcctggtaccagcagaacctggccaggctcccagactcctcatttatggttcttctaccagggcccagtcggtatcccgagcccaggttcagtgccagtgggtctggggacagtagttcatctcacctatcagcacgcctgcaggtctagaagtatttgctagtttatttcgtgtctagctagtatctattaatgctagttactagttttggccgtagggggtaccaaaggtccgtagggaaactccgaaaagtaaccgtgggttacggacgttaggacctaacccgtattcccgttagttaccctttaccgtacccgttcccccggtacc

SEQ ID NO: 85354 - DNA, 595 bp, Homo sapiens
  misc_feature: GYAE6OF02FKMKH.45.72.G06.1.454.CMB.1.raw
  modified_base (202)..(202): a, c, t, g, unknown or other
  misc_feature (202)..(202): n is a, c, g, or t
  modified_base (286)..(286): a, c, t, g, unknown or other
  misc_feature (286)..(286): n is a, c, g, or t
  modified_base (343)..(343): a, c, t, g, unknown or other
  misc_feature (343)..(343): n is a, c, g, or t
tcagacgcgatcgacacgaccggtgctcgatttagctacgactgcaagggaaagggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgcagggccagtcagagtattagaacatacttggcctggtatcaatacaagcctggccagggtccccgntcctcatccatgatgcatccaagcgggtccctggccgtcccaggacctaggttccgnggctaggtgggtctgggacaggtacgttcacgttctaccaccgtcacgcacgccgtaggacgtcctaggtatgtacttttcgacgttagttttacttcgtcgttacaggtctacggtccgtccgccaccggcccgtctccgtaccggtttccggggacgggggtaccggtaggggttgggaaggtcgtaggtaacggaacgtagttcgggtcggtcgtacggacctaccgacgttcgtcgttctacttaccg

SEQ ID NO: 85355 - DNA, 599 bp, Homo sapiens
  misc_feature: GYAE6OF02GHT6Z.45.72.G06.1.454.CMB.1.raw
  modified_base (203)..(203): a, c, t, g, unknown or other
  misc_feature (203)..(203): n is a, c, g, or t
  modified_base (382)..(382): a, c, t, g, unknown or other
  misc_feature (382)..(382): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccaggggaaangccacctctcctgctgggccagtcagagtgttagcaaccacttagcctggtaccagcagaaacctggccaggcctcccagactcctcattttatggttcttctaccgagggtcccgcttggtactcccagtcccaggttcagtcgccaggtgggtctgggacagtcgttcactctcacntcagcagcctgcagtctagaagtatttgcttagtttatttcgtgttcagtctagttactactaattaacgtggtacttaggttaacgttagggtttttacgggaccggtaacggggtacccgtaaagtacgttaaggaaacttaccgaaacggtaacgttggtacggtctacggacctaccgtacttccgttcgttcttacgtacttccttaccccg

SEQ ID NO: 85356 - DNA, 636 bp, Homo sapiens
  misc_feature: GYAE6OF02GIGN4.45.72.G06.1.454.CMB.1.raw
  modified_base (203)..(203): a, c, t, g, unknown or other
  misc_feature (203)..(203): n is a, c, g, or t
  modified_base (244)..(244): a, c, t, g, unknown or other
  misc_feature (244)..(244): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccgaggggaangccaccctctcctgctgggccagtcagagtgttagcaaccncttagcctggtaccagcagaaacctggccaggcctcccagcctcctcatttatggtttcttctaccgagggcctctggtactccccagccctaggttcagtcgcctaggtcgggtctggggacaggtcgttcactctcaccgatcagcacgcctgctagtctagaagtagttttcgcgttagtttactttcgtgttacaggtctagtacttactaacttaacgtcggttacttacggttaacgtttaggtttttaccgggaccggtaacgggggtaaccctaaggtacccgttagggtaaaccgttaccgtaaaacggtaaccgttagggtcggtacctcggtaccctaccgtacgttcttacgttcctttacgtaccttcccgttaccccg

SEQ ID NO: 85357 - DNA, 592 bp, Homo sapiens
  misc_feature: GYAE6OF02FXTDI.45.72.G06.1.454.CMB.1.raw
  modified_base (205)..(205): a, c, t, g, unknown or other
  misc_feature (205)..(205): n is a, c, g, or t
  modified_base (321)..(321): a, c, t, g, unknown or other
  misc_feature (321)..(321): n is a, c, g, or t
  modified_base (410)..(410): a, c, t, g, unknown or other
  misc_feature (410)..(410): n is a, c, g, or t
  modified_base (423)..(423): a, c, t, g, unknown or other
  misc_feature (423)..(423): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccgaggggaaagngccaccctctcctgctgggccagtcagagtgtagcaaccacttagcttggtaccagcagaaacctggccaggcctccagacctcctcatttatcggttcttcgtaccaggggtccnctggtactcccagtccaggttcaggtcgccaggtcgggtctggggacaggtagttcacttctcacatcagcacgctgcagtcagaagtntttgctagttttnttcgtgttcagtactagttactctaagtaaccgtggtcttaggttacgttaggtttcggaccgtaggggtaacctaggtaccgtaaggtaacttacgaaacgtacggttggtacggtcgtacgaccgtaccgtacttcgttacgttccttacgtacttccccgtacccg

SEQ ID NO: 85358 - DNA, 634 bp, Homo sapiens
  misc_feature: GYAE6OF02GHAF4.45.72.G06.1.454.CMB.1.raw
  modified_base (319)..(319): a, c, t, g, unknown or other
  misc_feature (319)..(319): n is a, c, g, or t
  modified_base (358)..(358): a, c, t, g, unknown or other
  misc_feature (358)..(358): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccgaaggggaaagagccaaccctctcctgctgggccagtcagagtgttagcaaccacttagcctggtaccagcagaaacctggccaggctccagactcctcatttagtggttcttctaccagggccnctggatccagcaggttcagtgctagtggtctgggacagngttcatcgtacaactatcagcagcctgactagtctgaagtatttgactagtttatttcttgtactagtaccgtagtactacgtaattaacgtggtccttagttaacgttagtttttacggaccggtaacgggggaacctaaacggtacgttaaggtaaaacgttaccgaaaaaacggtaaccgttacgggtacggtacccgttagtaacccgtaaccgttaacgttccgttaaccgtttccgtttaaccggttaacctttcccggttaccccccgg

SEQ ID NO: 85359 - DNA, 686 bp, Homo sapiens
  misc_feature: GYAE6OF02JB0G2.45.72.G06.1.454.CMB.1.raw
  modified_base (203)..(203): a, c, t, g, unknown or other
  misc_feature (203)..(203): n is a, c, g, or t
  modified_base (590)..(590): a, c, t, g, unknown or other
  misc_feature (590)..(590): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccgagggaagngccaccctctcctgctgggccagtcagagtgtagacaaccacttagcctggtaccagaccagaaacctggccaggtcctcccgagaccttcctactatttacgtcggtttacttcctaccgaggggcccgtacgtggtacctccccaagtccgtagggtttcagttacggccgtacggttggggtcctggggacaggtacttaccgtacgtcctaccgtacctaacgtacagaccgtacgaccttgtaccaagttccgtaagaaacgtttcgtttacggtcgttaagtttttacttccgttgttaccagtcttaagtacttctaacgtacgtcggtcgttagttaacgttagttttaccgggacctaacgggggtaaccctaacggnggttaaccgggaactaccgtaaacggtacggttggtacggtcctaacgggcctaaccgtcttacgttccttactttcgaaccgtttccttacccgg

SEQ ID NO: 85360 - DNA, 551 bp, Homo sapiens
  misc_feature: GYAE6OF02F7X6D.45.72.G06.1.454.CMB.1.raw
  modified_base (201)..(201): a, c, t, g, unknown or other
  misc_feature (201)..(201): n is a, c, g, or t
  modified_base (287)..(287): a, c, t, g, unknown or other
  misc_feature (287)..(287): n is a, c, g, or t
  modified_base (353)..(353): a, c, t, g, unknown or other
  misc_feature (353)..(353): n is a, c, g, or t
  modified_base (369)..(369): a, c, t, g, unknown or other
  misc_feature (369)..(369): n is a, c, g, or t
  modified_base (374)..(374): a, c, t, g, unknown or other
  misc_feature (374)..(374): n is a, c, g, or t
  modified_base (399)..(399): a, c, t, g, unknown or other
  misc_feature (399)..(399): n is a, c, g, or t
  modified_base (546)..(546): a, c, t, g, unknown or other
  misc_feature (546)..(546): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagataccaccggagaaattgtgttgacacagtctccagccattctgtctctctctcgagggganacagccaccctctcatgcagggccagtcagatattagacatactggcctggtatcaatacagcctggccagggtccccgctccgtnatctatgatgcttcgagcgaggccagtggcactccagcctaggtcaggtggtcggttgggttgcanagacttcactctacanatcancgacgcctaccaaccgtagaacgtntttcgctagttctttattactagtacacgtacgtacgtaacacgtactccggcgtccttacgttacgtttcgggtagggaggtaaccgtagggtggacgaataaccgaaacggtacgttggtcgcgttacgcctacgtcttaccgtntcccg

SEQ ID NO: 85361 - DNA, 740 bp, Homo sapiens
  misc_feature: GYAE6OF02HFF0J.45.72.G06.1.454.CMB.1.raw
  modified_base (201)..(201): a, c, t, g, unknown or other
  misc_feature (201)..(201): n is a, c, g, or t
  modified_base (614)..(614): a, c, t, g, unknown or other
  misc_feature (614)..(614): n is a, c, g, or t
  modified_base (630)..(630): a, c, t, g, unknown or other
  misc_feature (630)..(630): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactgtgctcccagatacctctggagaaattgtcttgacacagtctccagcctattctgtctctctctccgaggganacacgccaccctctacatgacgacggcagtacagagtataagaatatacttcgctagtatacaaatacgaagcctacggaccgtaccgggtcccccgcttacccgtactaagtccttaagtcgtaacgttacgtaccttaccgacgaccggtaacggtacccaacgttcggaacctaccgtacccgacgtacccgttaagggttacgacgggttcgggtaccggggtttggggtttacgaccgtaacgtaaccgttaacctttaccgtaacccgttcccttaacgaaaccgtaaacgttccgaaaccggacgtaaccctaccccggtttaaaccaaaacccgtttagggtaaacgtttaccgttttacgaacgttaaacgttactttaaacgttacgtacgtaaacctaaacncgggttaactaaacgngttaaccgtcggtcctacgtaccgtacggttacgggacgggaacgtacgtaaagggtcgaacgtaactacgaaacgttacgtggtaggcctaggacctaactagtacctg

SEQ ID NO: 85362 - DNA, 713 bp, Homo sapiens
  misc_feature: GYAE6OF02HOZ5W.45.72.G06.1.454.CMB.1.raw
  modified_base (639)..(639): a, c, t, g, unknown or other
  misc_feature (639)..(639): n is a, c, g, or t
tcagacgcgatcgacacgaccggtgctcgatttagctacgactgcaagggaaagggggaggaactgctcagttaggaccagacggaaccatggaagcccagcgcagcttctcttcctcctgctactctggctccagaaacctattggagaaactactgatgacgctacgttccagccacctgtctgtcgtctcgagggaagacgccacctctcctgcgtcggcagtcagtagtgtacgaccaactacttacgcgttacggtaccacgtacaacggaaccgtcggaccacggtacctacccgagtaccttcctacttaagtttacggttcggtttaccttacgtaaccgggacgggtaccgtcgttaccggttaccacccgtacggccgttaaggttccgaacggtccgtacggtgggttaccgggtacgtacggggtactaggttacgttacctaccgttctaaccgtacgtaacgttaccgaacggtccgaacgtccggtggtaacctcggttaacgaggttaaacgtttcctttagggtaacctttaggttttcgttacgtggtaacgtaggtaactacgtacttaacgtacgtaacgtcgttcgtagtttacgtcggttaacggacggacgtaacngtaacgtacggtaactacccgaagtcgcggtacgtatccgaactctacgtcttcgtacctatccgttccgtacg

SEQ ID NO: 85363 - DNA, 665 bp, Homo sapiens
  misc_feature: GYAE6OF02FT5ZT.45.72.G06.1.454.CMB.1.raw
  modified_base (200)..(200): a, c, t, g, unknown or other
  misc_feature (200)..(200): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagataccaccggaaaaattgtgttgacacagtctccaggcaccctgtctctgtctccaggggngacagccacctctctgcaggccagtaggagtgtcagtaacgtacttagggcttagggtaccaacgagaaaacctcggaccaggacctcccaggtacctcctcactaccagtgtatcgcactccaacgacggtccctggcctacccgagaccgtacgggtttccggtggaccgacggttggggtccgtaggggtaccaggttacggttacaccgttcgtaccgaaccgtcgaacgccgacgtccgtggacgtccgtagtactcggtagttttgtcttagtttaccttacgtgtcgagtcgacgttccggttccgcccgaccggtccgtccgtcgtaccggtttcgggaccgggggtaccgtcggggtagacggtagtacggacgtacggtaccgtagtcggtacgtcggacctaccgtacgttcgttacgtctttaccgtacgttcccgttacccgtcgtaacccg

SEQ ID NO: 85364 - DNA, 814 bp, Homo sapiens
  misc_feature: GYAE6OF02JIMQT.45.72.G06.1.454.CMB.1.raw
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccacctgtctgtgtctccgaggggaagcgccaccctctcctgctcgggccagtcagagttgttagccaacctacttacggcctacgggtaaccagaccaagaaacctggaccacgggtcctacccagtaccttccgtacctaattttaacgttcggtttactttacctaaccggtacggggtccccgtcggttacgggttaacctacccggtaacggtccccgttaagggtttaccgaacggttccggtacccggtaagggtttccggggtaccggttacgggggaacttaacgggtacggtttacccaccgttccgtaccgtaaccctacgttacgacgtccgtaaccggtcctacggaaccgtacgttacgtaacggtaacgttacgttttcggaccgtttaacgttttacgtttacctcggttaacgacgtactaacggttaacttacgtaacctttaacgtcgggttaccttacggttaccgttagggttttaccgggaccgttaacggggtaacccgtaaggtaccgtaaggtaactacgtaaacgtacggttcggttacggtacctacggtaccaaccgttacgttaaccggtttccgttaccgtttaacgtacccgtttcccgttaccccgg

SEQ ID NO: 85365 - DNA, 756 bp, Homo sapiens
  misc_feature: GYAE6OF02HL9TU.45.72.G06.1.454.CMB.1.raw
  modified_base (204)..(204): a, c, t, g, unknown or other
  misc_feature (204)..(204): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccacctgtctgtgtctccgaaggggaaancgccacccgtctcctgctgggccagtcagtagtgttagccaaccgtacttaggcctggtaccagccaagaaaccctggcccaggcctacccccgagtaccctcctactatttacgtggtttccttaccgtacccgagggtcccgcgttggtacctcccgagtcccgtaggtttccaggttcgcgtacggtggggttccgtaggggacctaaggtcgtttccacgttcgtccaacctcgtaccaacggcctaccgggtccctaggtaccgtacggtacctaggttaaacgggtttacgttttacggtaccttttaaagttttaccgtttaacgttaccggttacctaagttaccttaagttaacttccgtaagttccggacggggtacctaacggtttacgggttttaccgggacccggtaaacggggaacctaacgggtaccggttaggaacgtaaaccggtaccgtaaaccggtaacggttcggtacggttacgtccgtaaccgtaaccgtcgttacgtccgtttacgttcctaccgttcccgttaccccg

SEQ ID NO: 85366 - DNA, 757 bp, Homo sapiens
  misc_feature: GYAE6OF02IYA15.45.72.G06.1.454.CMB.1.raw
  modified_base (206)..(206): a, c, t, g, unknown or other
  misc_feature (206)..(206): n is a, c, g, or t
  modified_base (255)..(255): a, c, t, g, unknown or other
  misc_feature (255)..(255): n is a, c, g, or t
tcagacgcgatcgacacgaccggtgctcgatttagctacgactgcaaggggaaagggggaggaactgctcagttaggaccagacggaaccatggaagccccagcgcagcttctcttcctcctgctactctggcctcccagaaccattggagaaatactgatgacgctagtttccagccacctgtctgtcgtctaccgaaggggaancgcccacccgttctccgtcgcgtcggaccagtcaggagtgtagcaaccncttacgcctacggtaccagaccaacgaaccgtcggaccgaggtcctacccgagtacctccttagtacttttacgttccggttacttacctacccggacgggtcccgtcgttacggtactccccgagtccgtaaggttccgaagtcggacgtacggttggtacgtcgggaactaggtaccggtttcaccgttacgacctaaccgttagtacccaacgggttaccgaccgggtttcctaacgggtccttaacggtacgttaacgggttaacgttacgtttttcgtacggttttaacgtttcgtttacgtacggttacgtacgttacttacggtaacttccgtaattacggttcgtacgttcgttaacgtttcggttacggtaccggtaagggtaacctacggtaacgagggttaacgaccgtaaaacggtcgttaacggtgtaccgtacgtacctacggttaacttcgttaggtttactaccgtttacccggttaccttcccgg

SEQ ID NO: 85367 - DNA, 661 bp, Homo sapiens
  misc_feature: GYAE6OF02HME5R.45.72.G06.1.454.CMB.1.raw
  modified_base (216)..(216): a, c, t, g, unknown or other
  misc_feature (216)..(216): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggaagaaatactgatgacgcagttccagccaccctgtctgtgtctaccaggggaaagacgccaccctcncctgctgggccagtcagtagtgtagcaaccacttagcctggtaccagccaagaaacctggaccgaggcctcccagacctcctctattttagtcggtttctacctaccgacgggccctgtggtacctcccgagtcgtacgggttccaggttaccgccgtagggtggggtccttgggaacaggttcttaccacttcctacaaccgtatcagcgtagccctagcctaggttccaaggtaacggtttacttttggaacttttagtttacgttacgtaggttcctaagtctaaagtttactacgtaacgtttaaccgtgggtacctttacggttaacgttaggttccgggaacggtaacgggaccctaaaggtcgtaaggaacttaacgaacgtaacgtgggtggacgtaacgactaccattcggttactcgttaactcgttcctacccg

SEQ ID NO: 85368 - DNA, 741 bp, Homo sapiens
  misc_feature: GYAE6OF02JTAPC.45.72.G06.1.454.CMB.1.raw
  modified_base (234)..(234): a, c, t, g, unknown or other
  misc_feature (234)..(234): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccacctgtctgtcgtctccgaggggaaagcgccacctctcctgcgtcgggccagtcagngtgttagacgaaccacttacgccgtggtacccagacctaagaaccctggccaggtcctacccagaccttcctactacgtttagttcggttccttacgtaccgtcgggccgtacgttggtacctcccacgtaccgtacggttcacggtcgaccgtagggtcggtcgtagggaacgtagtacgttaccacgttcctaccgtaccggttcaacggccgtacggtcccggttggaccggtcctaggtactttcggtagttttacgacgttttagtttaccgttacgtcgttaacgcgttaccgttcggttacccgttcccgtacgtacccggtcccgttacgttccgttaacccggggtttccggggggaccgggggtaaccctggggggtacgtacggtacggtaggaaccgggtaactacgggttcggtcggggtcctacgtacccggtaacttccggttgtttacccgttcgttccgtaacccggttttccctaccccgggtactcgg

SEQ ID NO: 85369 - DNA, 737 bp, Homo sapiens
  misc_feature: GYAE6OF02GIUK7.45.72.G06.1.454.CMB.1.raw
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggaagaaatactgatgacgcagtttccagccaccctgtctgtgtctccgaaggggaagcgccacctctcctgcgtcgggccagtcgagtagttgttaacgaccaacctacttacgccgtggtaccagcaacgaaaccgtcggaccgaggtcctacccaacggaccttccctacacttccgaattcgactgacctactacccaacggtaccgggttcccgtcgggtccgtacccgtaacggtaccgtacggggttcccggtacggacggtacggttcggggtcggtacggggaactaggtaacgttccaaccgttccgtaccgaccgtcacgccgtacgcccgtggacgtcctaggtacgtttagttagtttacgctttaacgttttcttacgttcgttacgtacgtacgttacgtacttaacctaattaaccgtggtacgttacggttacgttacgggttttacgggaaccgggtaacgggtaaccgtaaggtacggtaaaccggtaacgtaaccgtaaacggtcgtacggtacggtacgtaccgaccgtaacgtcttaccgttcgttaaccctttccgtacgttccccg

SEQ ID NO: 85370 - DNA, 642 bp, Homo sapiens
  misc_feature: GYAE6OF02FP6O4.45.72.G06.1.454.CMB.1.raw
  modified_base (206)..(206): a, c, t, g, unknown or other
  misc_feature (206)..(206): n is a, c, g, or t
  modified_base (267)..(267): a, c, t, g, unknown or other
  misc_feature (267)..(267): n is a, c, g, or t
  modified_base (303)..(303): a, c, t, g, unknown or other
  misc_feature (303)..(303): n is a, c, g, or t
  modified_base (308)..(308): a, c, t, g, unknown or other
  misc_feature (308)..(308): n is a, c, g, or t
  modified_base (412)..(412): a, c, t, g, unknown or other
  misc_feature (412)..(412): n is a, c, g, or t
  modified_base (418)..(418): a, c, t, g, unknown or other
  misc_feature (418)..(418): n is a, c, g, or t
tcagacgcgatcgacacgaccggtgctcgatttagctacgactgcaagggaaagggggaggaactgctcagttaggaccccagacggaaccatggaagccccagcgcagcttctcttcctcctgctactctggctcccagaaaccattggagaaatactgatgacgcagtttccagccaccctgtctgtgtcgtccagggggaaanacgccacccgtctcctgactgggccagtcaggagtgttagcaaccattacgcctggtaccngcaagaaacctggccaaggcctcccgagactcctanatttntggttctactaccgagggtcccgactggtactcccgagccgtaggttccagtcgtccgaggtgggtctgggacaggacgttcaacgtctacaccgtatccgaancgtacncctagcgagttctagtaacgttatttacgacttaacggtttactttcgtagtacctagtacccgaagttacgtactaactaaacgtggtaccttaggttacgttagggttttaccggacgtaaggggaaccctaaggaccgttaagaacttacgaaacgtacgtgtacggtacctaggaacctaccgtaattccgttagttaccttacgtacttccctaccccg

SEQ ID NO: 85371 - DNA, 865 bp, Homo sapiens
  misc_feature: GYAE6OF02I1Y3D.45.72.G06.1.454.CMB.1.raw
  modified_base (199)..(199): a, c, t, g, unknown or other
  misc_feature (199)..(199): n is a, c, g, or t
tcagacgcgatcgacacgaccggtgctcgatttagctacgactgcaaggggaaagggggaggaactgctcagttaggacccagacggaaccatggaagccccagcgcagcttctcttcctcctgctactctggctcccagaaaccattggagaatactgatgacgcagttccagccacctgtctgtgtctcgagggaanacgccacctctctcgctgggccagtcagagtgtacgacaacctacttacgccgtacggtaccagacgaacgaaaacccgttcggaccacgggtccctacccgacgacccttccctacctagttttacgttcggtttccttaccgtaaccggtacgggccgtacgtttcggtaacctcccccgtaaggtcccgtacggtttacgacggtacacccggtacgggtttcggggtaccggtagggggtaacccgtaaggtaccggttacctacccgttacccttaccaaaccgtacgttacccgagtaacccgtacccggccgtaggtcccgtaattcgggttacgttaaaaggtttctttttaccggtacgttttaacgttttaacgttttccgtaacgtcggtaacgttccgttaacgtttactaaccttaagttaacccgggttcgttaccgttttagtttaaaccgggtttcgggttttaccgggaaccgggtaaccggggtaacccgttaaacggtaaccgttaacggaaaaccgttaccggaaaaccggttaccggttagggttaccgtaacccgggttacccgtaaccggttaacccttacgttttaaccggtttaccttaccccgtttacccgtttaacccggttaccccttaacccccggg

SEQ ID NO: 85372 - DNA, 760 bp, Homo sapiens
  misc_feature: GYAE6OF02G3WEJ.45.72.G06.1.454.CMB.1.raw
  modified_base (205)..(205): a, c, t, g, unknown or other
  misc_feature (205)..(205): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgctagtttccagccaccctgtctgtgtctccgaaggggaangccaccctctcctgctgggccagtcaggagtgttacgcaacctacttagcctaggtaccagcaagaacctggccacggcctaccgagacctcctactatttagttcggtttacctttaccgtaccgtacggggtcccgtcgttacgggttacctccccgacgtccgtaaggttcaacggtcgccgtagggttcgggtccgtggggacaggtacgttccacttctaccaaccgtactcgagtaccgtacgccgtacgctaacggttacgtagtaaagtttcgttttaggacttttaaggttttacgtttaccgtacgttacgaacgttaccgttaacggttcccgtttaccccgaccgtacccggtacccgtcttacccggttacccggggtttccggggggaccgggggttaaccgtacgggggttagggtacgtaacgggtagggtaaaccgggtaccgtaacggttacgggtccgggtaccgttacggaccccttaaccgttacgttccgtttacggttacctttaccgaccgttttccccgttacccgtacg

SEQ ID NO: 85373 - DNA, 801 bp, Homo sapiens
  misc_feature: GYAE6OF02JMN3M.45.72.G06.1.454.CMB.1.raw
tcagacgcgatcgacacgaccggtgctcgatttagctacgactgcaaggggaaagggggaggaactgctcagttaggacccagacggaaccatggaagccccagcgcagcttctcttcctcctgctactctggctcccagaaaccattggagaaatactgatgacgctagtttccagccaccctgtctgtgtctaccgaggggaaagcgcccaccctctcctgcgtcgggccagtcagtgtgtacgacacctactcgcctaggaccagcaagaaccgtggccaggtccctccacgtacttcctactactttacgttcggtttccttaccgaccggacgggtcccgtcgttacggttaacctccccgacgtccgttacggttccgtaaggtccggacccgtagggttccggggtacgtaggggtaccctagggttcgttacctaccgttccgtaaccgacccacgttaccagggtaccccgtaccggtcccttacggaccttaacgtccggttaacggtaacggtttacgttttacgtccgttttaaagttttaccgtttccgttacgtacgtacggtaccttagttaccgtacctaaaggttacgttcggtaccgttagtttaacccggttttggtttacgggaacccgggtaacgggtaacccgaagttcggtaaacgttaacgtaacggtaaaccgttagggttaccgggttacgttaccgttaaccggacccggttacctttacggtttaccggtttccgttaacccgttttacgtacccgttttccccgttacccgg

SEQ ID NO: 85374 - DNA, 705 bp, Homo sapiens
  misc_feature: GYAE6OF02JQ80Q.45.72.G06.1.454.CMB.1.raw
  modified_base (351)..(351): a, c, t, g, unknown or other
  misc_feature (351)..(351): n is a, c, g, or t
  modified_base (670)..(670): a, c, t, g, unknown or other
  misc_feature (670)..(670): n is a, c, g, or t
  modified_base (687)..(687): a, c, t, g, unknown or other
  misc_feature (687)..(687): n is a, c, g, or t
tcagacgcgatcgacacgaccggtgctcgatttagctacgactgcaaggggaaagggggaggaactgctcagttaggacccagacggaaccatggaagccccagcgcagcttctcttcctcctgctactcgtggcctacccaagaaacctagttggaagtaaatactgtatgacgctacgttcagcccacctgtctgtcgtcctaccggaaggggaaactcgcccctaccttcgtccgtgccgtcgggaccagtccgagtagtcgtacgaccaacctcgtcgtaccgtcggtaaccagaccaaacggtaaccgtcggaccgtacggccctacccgacgtcccctaccgttnttaacgttttactcgggtttacctaccgtaacggaccgggtcctacggttacggtaccgtcccaacgggtccgtacggttacgaggttcccgacggtacgggtttacggcggtacgggaactcggtacgttcctacgtccgtacacccgttagaccgaggtccctacggtccgtacgtacgtacgtactagggtaacgttagtttcggtactttaaggtttccgttacgtcgttacgagtaccgtattctacgtacgtacgttcgtgtacgttcgtacggttcggacgtacggactgtacgtagatacgtatgtcggtncgtatccagtgttactnttctcgtacctccgtacg

SEQ ID NO: 85375 - DNA, 830 bp, Homo sapiens
  misc_feature: GYAE6OF02IO0IY.45.72.G06.1.454.CMB.1.raw
  modified_base (520)..(520): a, c, t, g, unknown or other
  misc_feature (520)..(520): n is a, c, g, or t
tcagacgcgatcgacacgaccggtgctcgatttagctacgactgcaaggggaaagggggagaactgctcagttaggacccagacggaaccatggaacgccccagcgcagcttctcttcctcctgcctactctggcctaccgagacgaccctccgggaataaacttggtcttagaccacgtagtcctaccgacggcctaccctgtcctcgtcgtcctaccggagggtaacaccgtacgccctacccttcctccgtgcgtacgggccaggttacggcgttagacgtaagtaacgttacgtacggctacggtaaccaacgtacgtaaccgtgaccgaggccctccgagtcctacctacacttcctaagtccgaatcgtaccgtaacgtaccgaaccggcggttcccgtacgggtcccgtaccgtaacggtacggttacccggttcgggacgtaccggtggggttacgggttaccgacgggacgtaccggttaccgtttccacccgttaccgccgaacccgttnacggtcccacggtcgtaggaccgtacggtctaagtttacgttacggttttacgtttagtttacctcggtttaacgcgtacgttaccgggttacgtcccgttacccggaccgtacggtcccggttacgttaccgggttacccggggttttcccgggggggaaccggttacgggtttaaccgggggcgttaaccgggtagtaaccgggaacgtaacgttccgggttaaggtccgttaaccgcggtaaacccgtcgtacgttttcggcccttttaacggttacccctaccttcccggtaacctccggtaaccg

SEQ ID NO: 85376 - DNA, 530 bp, Homo sapiens
  misc_feature: GYAE6OF01BRG21.43.22.B11.1.454.CMB.1.raw
  modified_base (338)..(338): a, c, t, g, unknown or other
  misc_feature (338)..(338): n is a, c, g, or t
  modified_base (462)..(462): a, c, t, g, unknown or other
  misc_feature (462)..(462): n is a, c, g, or t
tcagtgtgagtagtcacgaccggtgctcgatttagacgacagctcaggggggtctcagagaggagccttagccctggactccaaggcctttccacttggtgatcagcactgagcacagaggactcaccatggaattggggctgagcgtggtttcgtgtaggctatttagtaaggtgtcagtgtgaggtgcagctggtggagtctgggggagcctggggtccagcctggggggtccctgagactctcctgtgcagcctctggactcacctttagtagttattggatgaccgtgggtccgccaggctccgaggggaaggggctgggagtgggtggccaanataaaccaagatggaagtgagaaatatatgtggactctgtgaagggccgattcaccatcaccagagacaacgcaagagctcactgtctctgacaatcgaacagcctgagagtcgaggcacggtntgtgtattagtgtgagagtacgtaccggtaagggttccggttaacacggtaggagtcggacggtcggg

SEQ ID NO: 85377 - DNA, 292 bp, Homo sapiens
  misc_feature: GYAE6OF01BTW9N.43.22.B11.1.454.CMB.1.raw
  modified_base (287)..(292): a, c, t, g, unknown or other
  misc_feature (287)..(292): n is a, c, g, or t
tcagtgtgagtagtcacgaccggtgctcgatttagacgacagctcagggattcctgaccgattctctggctccaagtctggcacgtcagccaccctgggcatcaccggactccagactggggacgaggccgattattactgcggaacatgggacagcagcctgaatacttgggtgttcggcggagggaccaggctgaccgtcctaagtcagcccaaggctgccccctcggtcactctgttcccacctcctcactactcacactgagcgggctggcaaggcgcatagnnnnnn

SEQ ID NO: 85378 - DNA, 290 bp, Homo sapiens
  misc_feature: GYAE6OF01B269E.43.22.B11.1.454.CMB.1.raw
  modified_base (284)..(290): a, c, t, g, unknown or other
  misc_feature (284)..(290): n is a, c, g, or t
tcagtgtgagtagtcacgaccggtgctcgatttagacgacagctcagggattcctgaccgattctctggctccaagtctggcacgtcagccaccctgggcatcaccggactccagactggggacgaggccgattattactgcggaacatgggacagcagcctgaatacttgggtgttcggcggagggaccaggctgaccgtctaagtcagcccaaggctgcccctggtcactctgttcccacctcctcactactcacactgagcgggctggcaaggcgcatagnnnnnnn

SEQ ID NO: 85379 - DNA, 519 bp, Homo sapiens
  misc_feature: GYAE6OF01BQ9PG.43.22.B11.1.454.CMB.1.raw
  modified_base (400)..(400): a, c, t, g, unknown or other
  misc_feature (400)..(400): n is a, c, g, or t
  modified_base (462)..(462): a, c, t, g, unknown or other
  misc_feature (462)..(462): n is a, c, g, or t
  modified_base (476)..(476): a, c, t, g, unknown or other
  misc_feature (476)..(476): n is a, c, g, or t
tcagtgtgagtagtcacgaccggtgctcgatttagacgacagctcagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcctggggtccagccgtggggggtccctgagactctcctgtgcagcctctggactcacctttagtagttattggatgacctgggtccgccaggctccgagggaaggggctggagtgggtggccaacataaaccaagatggaagtgagaaatactatgtgactctgtgaaggcgattcacatctcaganacacgccaagagctcactgtctctgcaatagaacagacctagagagtcgagacacggctgtntattatgtgcgagngtaccaagggtccggtttactacgtacggaatgggagtccggg

SEQ ID NO: 85380 - DNA, 602 bp, Homo sapiens
  misc_feature: GYAE6OF01C49NM.43.22.B11.1.454.CMB.1.raw
  modified_base (266)..(266): a, c, t, g, unknown or other
  misc_feature (266)..(266): n is a, c, g, or t
tcagtgtgagtagtcacgaccggtgctcgatttagacgacagctcagggggtctcagagaggagccttagccctggactccaaggcctttccacttggtgatcagcactgagcacagaggactcaccatggaattgggctgagctgggttttccttgttgctattttagaaggtgtccagtgtgaggtgcagctgggtggagtcgtgggggagccgtggggtcccaggccgtgggggggtccctggagactctcctgtgcagcctntggactctacctttagtagttatggatgacctgggtccgcaggctccgagggagggctggagtgggtgccaagataaaccaagatggaaatgaagaaatactatgtaggactcgtagtaggaagggcccgtaattccgaaccatcctaccgaagacgaaaccaaacgacccaaagacgaccttacaactcgtctctagacaaatcgaaccagcctagaaggtacgtaccggaaggacccgagggtcttggttacgtaattcgtaggtgaccggaagtactacccggaaagggtttcccgggttaatacccgtaaggaagttgggaaccgttcgggg

SEQ ID NO: 85381 - DNA, 520 bp, Homo sapiens
  misc_feature: GYAE6OF01BKVNT.43.22.B11.1.454.CMB.1.raw
  modified_base (413)..(413): a, c, t, g, unknown or other
  misc_feature (413)..(413): n is a, c, g, or t
  modified_base (423)..(423): a, c, t, g, unknown or other
  misc_feature (423)..(423): n is a, c, g, or t
  modified_base (433)..(433): a, c, t, g, unknown or other
  misc_feature (433)..(433): n is a, c, g, or t
tcagtgtgagtagtcacgaccggtgctcgatttagacgacagctcagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcctgggtccagccgtggggggtccctgagactctcctgtgcagcctctggactcacctttagtagttattggatgacctgggtccgccaggctccgagggaggggctggagtgggtggccaacataaaccaagatggaagtgaagaaatactatgtggactctgtgaaggccgattcacatctccagagacaacgcaagnctcatgctcngcaatgaacngcctgagagtcgagacacggtctggtgtattacgtgtcgcgtagactaccgaaggttccggttactacgtacggaatgggacgtcgg

SEQ ID NO: 85382 - DNA, 768 bp, Homo sapiens
  misc_feature: GYAE6OF01DA0KB.43.22.B11.1.454.CMB.1.raw
  modified_base (331)..(331): a, c, t, g, unknown or other
  misc_feature (331)..(331): n is a, c, g, or t
  modified_base (342)..(342): a, c, t, g, unknown or other
  misc_feature (342)..(342): n is a, c, g, or t
  modified_base (353)..(353): a, c, t, g, unknown or other
  misc_feature (353)..(353): n is a, c, g, or t
  modified_base (634)..(634): a, c, t, g, unknown or other
  misc_feature (634)..(634): n is a, c, g, or t
tcagtgtgagtagtcacgaccggtgctcgatttagacgacagctcaggggggtctcagagaggagccttagccctggactccaaggcctttccacttggtgatcagcactgagcacagaggactcaccatggaattgggctgagctgggttttccttgttgctattttagaggtgtccagtgtgaggtgcagctggtggagtcgtggggggagccgtggggtccaggcccgtgggggggtcccctgagactctcctgtgcagcctctggacctctacctttagtagttattggatgacgtgggtccgccaggctccgaggggagggctggngtggtgccaanactaaacaagngtaggaagtgaagaaatactagtgtcggacttcgtggtacggaaggggtcccgtaatttaccgaaccctaacgttccctacccgaaagggtaaccggaacccaaaacccggcccgtaaaaaacgggcgtacccttaccgaaacccgtttcgggtttaccctccgttaaggtaaccctaaaaagttcggaaaccaacggtccccgttaggaaacggtaacgggtaccgggaaacgggtaacccgaccggggtccttaagggtttacgttaaacgttttccgnggggttaacggacccggtaaggttaaccgttaacccccgggttaaaacggggggttttccccccgggtttttaaaacaaacccggggtttaaccggggaaaacttcggggggttaaccccgtttaccggggggg

SEQ ID NO: 85383 - DNA, 598 bp, Homo sapiens
  misc_feature: GYAE6OF01APR9C.43.22.B11.1.454.CMB.1.raw
  modified_base (334)..(334): a, c, t, g, unknown or other
  misc_feature (334)..(334): n is a, c, g, or t
tcagtgtgagtagtcacgaccggtgctcgatttagacgacagctcagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcctgggtccagccgtggggggtccctgagctctcctgtgcagcctctggactcactttagtagttattggatgacctgggtcccgccaggctccgagggagggctgggagtgggtgccaanataaaccaagatggaagtgaagaaatctaatggtaggactcgtgtaggaaacgggcctattcacctatcctaccaagacgaaccaacgaccaagacgcctacacttgtcctctagaccaaatcgaacacgccctaggaacgtacggtacggaacggaccacgggtcttaggttagtattacgtggttgacggtaagtacgtacccggtaaggggtttccccgggtttaaactaccggtaaagggaactggggtaccgttcgggg

SEQ ID NO: 85384 - DNA, 291 bp, Homo sapiens
  misc_feature: GYAE6OF01BCGGJ.43.22.B11.1.454.CMB.1.raw
  modified_base (287)..(291): a, c, t, g, unknown or other
  misc_feature (287)..(291): n is a, c, g, or t
tcagtgtgagtagtcacgaccggtgctcgatttagacgacagctcagggattcctgaccgattctctggctccaagtctggcacgtcagccaccctgggcatcaccggactccagactggggacgaggccgattattactgcggaacatgggacagcagcctgaatacttgggtgttcggcggagggaccaggctgaccgtcctaagtcagcccaaggctgccccctcggtcactctgttcccgcctcctcactactcacactgagcgggctggcaaggcgcatagnnnnn

SEQ ID NO: 85385 - DNA, 784 bp, Homo sapiens
  misc_feature: GYAE6OF01DLII2.43.22.B11.1.454.CMB.1.raw
  modified_base (638)..(638): a, c, t, g, unknown or other
  misc_feature (638)..(638): n is a, c, g, or t
tcagtgtgagtagtcacgaccggtgctcgatttagacgacagctcgaggggggtcacagagaggagccttagccctggactccaaggcctttccacttggtgatcagcactgagcacagaggactcaccatggaagttgggctgagcttgggttttccttgttgcttatttagaaggtgtcagtgtgaggtgcagcgtgggtggaggtcggtgggggacgtccgtggggtccgaggtcccggttcgggggggtccctggacgtaccttccgtccgtggtcgcacggtccctcgtcggtacctaccgttaaccgttttaagttagtttaagttggacttcggtacccggttcggggttcccgaccgtaggcccgttaccgggaagggggaacgggtcgtaggggtacgggtcggggtacggaacccaaacgtaaacgtaaaaaccggaaaggtaagttaaggggaaagttaggaaaacgtaaacttaacgttaagtggtacggtactgtacgggtacgggaaacgggtcccgtaactttaccgaacccgtattcccgtaacgaacgggtaacgaaacccgaaacccgaccgtaaaggccgtacctaccgacgttgtcctacgacgaactaagccgaacncgcgtagacgtacgtacggacgaaccgtcggtcttaggttcgtaacgttaggttcggaggtaccaaggttacccgtaacgggttaacgggttttaccccggttaataccccgggaaagggtacggttcgggtaaccgggttcgggg

SEQ ID NO: 85386 - DNA, 650 bp, Homo sapiens
  misc_feature: GYAE6OF01CAXB4.43.22.B11.1.454.CMB.1.raw
  modified_base (355)..(355): a, c, t, g, unknown or other
  misc_feature (355)..(355): n is a, c, g, or t
  modified_base (524)..(524): a, c, t, g, unknown or other
  misc_feature (524)..(524): n is a, c, g, or t
tcagtgtgagtagtcacgaccggtgctcgatttagacgacagctcaggggggtctcagagaggagccttagccctggactccaaggcctttccacttggtgatcagcactgagcacagaggactcaccatggaattggggctgagctgggttttccttgttgctattttagaggtgtccagtgtgaggtgcagctggtggagtcgtgggggagccgtgggtccagccgtggggggtccctgacgactctcctgtgcagcctcgtggtactctaccttttagtagttattggatcgaccgtgggtcccgccgaggcctccgaggggaacgggcgtgggaggtggggtcgaccaaanaactaaaccgaagagtaggaagtagaagtaaatacgtagtggtaggactcgtggtacggaacgggccgtagttccaccgtatcctaccaagacgaacaacgccaagactcactactcgtactctacgacaaagtacaacacgacctaggaagacggtacgacgggaccncggtcttaggtacgttagttaccgtggtacgggacgaaacgtacgttaacccgggtaaacgggttttaccccgggtttaacgtaaacccggtaagggtaacggttcgggtacccgggttaccgggg

SEQ ID NO: 85387 - DNA, 522 bp, Homo sapiens
  misc_feature: GYAE6OF01EO2QV.43.22.B11.1.454.CMB.1.raw
  modified_base (298)..(298): a, c, t, g, unknown or other
  misc_feature (298)..(298): n is a, c, g, or t
  modified_base (332)..(332): a, c, t, g, unknown or other
  misc_feature (332)..(332): n is a, c, g, or t
  modified_base (402)..(402): a, c, t, g, unknown or other
  misc_feature (402)..(402): n is a, c, g, or t
  modified_base (438)..(438): a, c, t, g, unknown or other
  misc_feature (438)..(438): n is a, c, g, or t
tcagtgtgagtagtcacgaccggtgctcgatttagacgacagctcaggggggtctcagagaggagccttagccctggactccaaggcctttccacttggtgatcagcactgagcacagaggactcaccatggaattggggctgagcgtggtttcgtgtaggctatttagaaggtgtccagtgtgaggtgcagctggtggagtctgggggagcctgggtccagccgtggggggtccctgagactctcctgtgcagcctctggactcaccttttagtagttattggatgacctgggtccnccaggctcgagggagggctggagtgggtgccaanataaaccagatggaagtgaagaaatactatgtaggactctggtgaagggccagttcactatcctacaganacacgcaagagctagacttgctctagacaatgaacngacctgagagtgagacaggctgtgtattacgtgtgacgagctaccgaagggttccggttaacacgtaggaatgggaacgtcggg

SEQ ID NO: 85388 - DNA, 796 bp, Homo sapiens
  misc_feature: GYAE6OF01DM1GE.43.22.B11.1.454.CMB.1.raw
  modified_base (177)..(177): a, c, t, g, unknown or other
  misc_feature (177)..(177): n is a, c, g, or t
tcagtgtgagtagtcacgaccggtgctcgatttagacgacagctcaggggggtctcagagaggagccttagccctggactccaaggcctttccacttggtgatcagcactgagcacagaggactcaccatggaattgggctgagcttgggttttccttgttgctattttagaaggtntccagtgtgaggtgcagctgggtggagtcggtgggggacgtccgtggggtcccaggtcccgggttcgggggggttcccctaggacggtaccttccgttccctggtcgccgagcccttcgtggtaccttcttaacccttttagtagtttagttggatcgtaccggttcgggtcccgccgtaagggccgtaccggagggggaaggggtccgtaggggtagtgggggtacggaacccaaactaaacgtaaaaccgaggtaacgtagggaaagtaggaagtaaatacgtagtgtacggtactcgtgggtaacgaacgggtccgtaacttaccgaacctacttccgaccgaaaggacgaaacccgaacggtacccaaaaggtacgtcccttacgtaccgttcggtccctacgttacggaacctaaagtcggaaacctagtccggtaaggacgggtaacgtaccgggaagggaaaccctgggtccgtttaggtttaacgtacgtttaacgtggtaaaccggtagtaaccggtaaccggttacccgggttaagggttttaaccccggggtttaaacttaaacccgggtaagggttaaggtcccggggttaaccggtacccgggggg

SEQ ID NO: 85389 - DNA, 637 bp, Homo sapiens
  misc_feature: GYAE6OF01EMORU.43.22.B11.1.454.CMB.1.raw
tcagtgtgagtagtcacgaccggtgctcgatttagacgacagctcagggggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagccgtgggtccaggccgtggggggtccctgagactctcctgtgcacgcctctggactcctacctttagtagttattggatgaccgtgggtccgccgaggcctccggaggggaaggggcgtgggaggtggggtcggaccaaacgaataaaaccgaagatagggaagtaggaagaaatactagtgtggactcgtgtaggaagggccgtattcgacctatcctaccagacgacaacgacaagacgctcactcgtctctagactaaatcgaacgcgtacctaggagtacgggtaccggaaggacccgaacgggtctggttacgttacgttaccgtggtcggacgaaggtcgttaacccgggtaagggtttaccccggggttttaactaacccggttaagggaacggttcggggaccgttcccggggg

SEQ ID NO: 85390 - DNA, 587 bp, Homo sapiens
  misc_feature: GYAE6OF01CXOMY.43.22.B11.1.454.CMB.1.raw
  modified_base (422)..(422): a, c, t, g, unknown or other
  misc_feature (422)..(422): n is a, c, g, or t
  modified_base (429)..(429): a, c, t, g, unknown or other
  misc_feature (429)..(429): n is a, c, g, or t
tcagtgtgagtagtcacgaccggtgctcgatttagacgacagctcagggggggtctcagagaggagccttagccctggactccaaggcctttccacttggtgatcagcactgagcacagaggactcaccatggaattggggctgagctgggttttccttgttgctattttagaggtgtccagtgtgaggtgcagctggtggagtcgtgggggagccgtggggtccaggccgtggggggtccctgagactctcctgtgcagcctcgtggactctacctttagtagttattggatgaccgtcgggtccgccaggctccgaggggacgggcgtggaggtgggtcgaccaacataaaaccgagagtaggaagtagaagtaaatactagtgtggactctggtagaacgggccgattccgactatccnccaaganacaacgccaaagagctacactcgtctctagacaagtcaacgacgcctaggaggtacggtagaacggacgtacgggctggttatacttcgtgtggacgagaccttaccgggtaacggttccggtttaaacaacgtaggtaagtcgggaacgttccgggg

SEQ ID NO: 85391 - DNA, 703 bp, Homo sapiens
  misc_feature: GYAE6OF01C76PH.43.22.B11.1.454.CMB.1.raw
  modified_base (606)..(606): a, c, t, g, unknown or other
  misc_feature (606)..(606): n is a, c, g, or t
  modified_base (617)..(617): a, c, t, g, unknown or other
  misc_feature (617)..(617): n is a, c, g, or t
  modified_base (631)..(631): a, c, t, g, unknown or other
  misc_feature (631)..(631): n is a, c, g, or t
tcagtgtgagtagtcacgaccggtgctcgatttagacgacagctcaggggggtctcagagaggagccttagccctggactccaaggcctttccacttggtgatcagcactgagcacagaggactcaccatggaattggggctgagtcttgggttttccttgttgcttattttagaggtgtccagtgtgaggtgcagctggtggagtcggtgggggacgcgtcgggtccaggccggtggggggtccctggacgtacctctccgtggtcgcagcccttcgtacggtacctccttaacccgttttagttaggtttaagttggggtattacggtacccgttcggggtccccgaccgtacgggtccgtacccgggaagggggaacggggtccggttaggggtaagggttcgggggtacgggaaccccaaaataaaccggttaaaaaccgaaaggtacgtagggaaaggtagaaaagtaaaagtacgttagtaggtacgtacgttcgtagggttagggaacgggtaccctattacccgaacctagtcctaccgaagacgaaaccaaccgacgaagactccgtacacttcgtcctatcgaactaagtcgaacncgtcagaaggngtacggagaaccgnggtctgtactagtgtgtcgagagccgttacggaacgggtttccctaagtacgtaagtcgtcgggtctcgggg

SEQ ID NO: 85392 - DNA, 297 bp, Homo sapiens
  misc_feature: GYAE6OF01D8AJI.43.22.B11.1.454.CMB.1.raw
  modified_base (263)..(263): a, c, t, g, unknown or other
  misc_feature (263)..(263): n is a, c, g, or t
  modified_base (289)..(297): a, c, t, g, unknown or other
  misc_feature (289)..(297): n is a, c, g, or t
tcagtgtgagtagtcacgaccggtgctcgatttagacgacagctcagggattcctgaccgattctctggctccaagtctggcacgtcagccaccctgggcatcaccggactccagactggggacgaggccgattattactgcggaacatgggacagcagcctgaatacttgggtgttcggcggagggaccaggctgaccgtcctaagtcagcccaaggctcgcccctcggtcactctcgttccccacctcctcactactcacnctgagcgggctggcaaggcgcatagnnnnnnnnn

SEQ ID NO: 85393 - DNA, 1054 bp, Homo sapiens
  misc_feature: GYAE6OF01DH262.43.22.B11.1.454.CMB.1.raw
tcagtgtgagtagtcacgaccggtgctcgatttagacgacagctcaggggggtctcagagaggagccttagccctggactccaaggcctttccacttggtgatcagcactgagcacagaggactcacatggaagttgggctgagcttgggttttccttgtgcttattttagaagtgtccagtgtgaggtgcagcgtgggtggagtcggtgggggacgtccgtggggtccaggtcccggtcggggggtccctggacgtaccttccgtccgtggtcgcctacggcccttcgtcggtaccttccttaaccgttttaaggttaagtttaagttggtaagtcggtacccggttcgggggtccccgaccggtacgggtacccgttacccgggaaaggggggtaacgggggtccgttagggggtaacgggttcgggggtaacgggtaaaccccaaaaaccgtaaaacgtaaaaaacccggtaaaagggtaaggttaagggggaaaaaggttaagggaaaaacggttaaaaaacgttaaccgttaaaggtttcggggtaacgggtaaccgtttaccggttaaggggtaaaccggggtaaaacgggggtcccccttaaaacgttttaaccccggaaacccttaaccgttaccccgttaaccggaaacgggtaaaccggaaaaccccgaaaaaccccgggaaaccccgtaaaagggacccgttacccgttaacccgtaccggtttaccgggttaccccttaccggtttaaaccggaaaccgttaaaaaagtaccggtaaaacccgtacgggtaaccccgttaggggaaaccgggttaaccgggtaaccgggaaacggggttaacccgtaccgggtaccgttttaaggtttacgttaaaggttttaaccggtcgggttaacgggacccggttaaacggtaccccggtttaaacccccgggttaaaacggggggtttttaacccccggttttaaaacccttaaaccgggggttaaaaccggggtttaaacggttccgggggtaaccccggggtttaaccggggggg

SEQ ID NO: 85394 - DNA, 754 bp, Homo sapiens
  misc_feature: GYAE6OF01DS57M.43.22.B11.1.454.CMB.1.raw
tcagtgtgagtagtcacgaccggtgctcgatttagacgacagctcaggggggtctcagagaggagccttagccctggactccaaggcctttccacttggtgatcagcactgagcacagaggactcaccatggaattggggctgagcgttgggttttccttgttgcttatttagaaggtgtcagtgtgaggtgcagcgtggtggagtcggtgggggacgccgtgggtccaggtccggtcggggggtccctggacgtacctcctccgtgtgccgacgtcctcgtcggtacctccttaaccttttaggttagtttagttggatcgaccgttcggggtcccgccgacgggtccgtaccggaagggggaacggggtcgtaggggagggttcgggggtacggaccctaaaacgaaacgtaaaaaccgaagtaagtaagggaaagtagaaagtaaaatacgtagtggtaggtacttgtaggtacggaacgggtcctagttacccacctacgtcctaaccgaagaacgtaaccaaccggaccgaagtcacctacgacttcgctacgagaacaagtacgaacgcgtactaggaagtacgtaaccgggaaggacctacggggtactttacgggtgttaacgttttaccggagggttcggaaccggtaacgttaaccggttacccgggttaaaccggggttttccccgggtttaaacaacccggtttaacggggaacggttccgggaacggggtttacccggggg

SEQ ID NO: 85395 - DNA, 761 bp, Homo sapiens
  misc_feature: GYAE6OF01DFLDY.43.22.B11.1.454.CMB.1.raw
tcagtgtgagtagtcacgaccggtgctcgatttagacgacagctcaggggggtctcagagaggagccttagccctggactccaaggcctttccacttggtgatcagcactgagcacagaggactcaccatgggaattggggctgagcttgggttttccttgttgcttattttagaaggtgtccagtgtgaggtgcagctgggtggagtcgtgggggagccgtggggtcccaggcccggtgggggggtcccctggacgacctctcctgtgcacgcctcgtcggtacctcttaccttttagttagttagttggatcgaccgtcgggtcccgccgacggtcctacggaggggagggcgtgggaggtcggggtacggacccaaagtaactaaaaccgaagtacgtaagggtaagtacggaaagtaaaacttacgtagttaggtacggtacttcggtagggtaacgggaacggggtaccgtaacttaccgaacctacgttacccgtacccgaaaggaacgaaacccgaaacccgaccgaaacggacgtcccttaccgtaaccttccggtccttacgtacgtaaccgaaacgttaccgaacaccggtacgtaggaacggtacggtaccgggaacggtaacccgacggtcgttacggttagttaacggtttacgtggtacggacgtaggtaccgttaaccgggttaacgggtttacccggtttaacgtaacgggtaacgggtaaacgtcggggttaccgtaccggggg

SEQ ID NO: 85396 - DNA, 617 bp, Homo sapiens
  misc_feature: GYAE6OF01CHJS5.43.22.B11.1.454.CMB.1.raw
  modified_base (438)..(438): a, c, t, g, unknown or other
  misc_feature (438)..(438): n is a, c, g, or t
  modified_base (470)..(470): a, c, t, g, unknown or other
  misc_feature (470)..(470): n is a, c, g, or t
tcagtgtgagtagtcacgaccggtgctcgatttagacgacagctcaggggggtctcagagaggagccttagccctggactccaaggcctttccacttggtgatcagcactgagcacagaggactcaccatggaattggggctgagctgggttttccttgttgcttattttagaaggtgtccagtgtgaggtgcagctggtggagtcgtgggggagccgtgggtccagccgtggggggtccctgagactctcctgtgcagcctctggacctctacctttagtagttattggatgacctgggtccgccaggctccgaggggagggctgggagtgggtgccaacataaaccaagataggaagtgaagaaatactatgtggactcgtgtaggaagggccgtattccacctatcctaccaagacgaaccaaccgaccaagacnctaccacttcgtctcgtagactaaatcgaacngacctaggagagtacgaacggacgacggtcgttagtagttacgttacgtggtcggacggtaagtcgttacccgggtaacggggttttacccgggttttaactaaccgggttaaacgggtaacggttcgggtaaccggttaccggggg

SEQ ID NO: 85397 - DNA, 290 bp, Homo sapiens
  misc_feature: GYAE6OF01B0GEY.43.22.B11.1.454.CMB.1.raw
  modified_base (286)..(290): a, c, t, g, unknown or other
  misc_feature (286)..(290): n is a, c, g, or t
tcagtgtgagtagtcacgaccggtgctcgatttagacgacagctcagggattcctgaccgattctctggctccaagtctggcacgtcagccaccctgggcatcaccggactccagactggggacgaggccgattattactgcggaacatgggacagcagcctgaatacttgggtgttcggcggagggaccaggctgaccgtcctaagtcagcccaaggctcgcccctggtcactctcgttccccgcctcctcactactcacactgagcggctggcaagcgcatagnnnnn

SEQ ID NO: 85398 - DNA, 834 bp, Homo sapiens
  misc_feature: GYAE6OF01A7US8.43.22.B11.1.454.CMB.1.raw
tcagtgtgagtagtcacgaccggtgctcgatttagacgacagctcagggggtctcagagaggagccttagccctggactccaaggcctttccacttggtgatcagcactgagcacagaggactcaccagtggaattggggctgagtcgttggttttccttgttgtcttattttagagtgtcagtgtgaggtgcagcgtggtggagtcggtggggacgtccgtcgggtccgacggtccggttcggggggtccctggacgtcctccgtcgtgtcgcacgccgttcgtcggaccttaccgtaccttttaggttacgtttagttgggacttccggtaccggttcgggtacccgaccgacgggtcccgtacccgggaagggggtaacggggtccgtaggggtacgggttcgggggtacgaacccaaaacgtaaaccgtaaaaaccgtaaaggtaagttaacggggaaaaggtaaggaaaacgtaaacgttaacgttaaggtcggttacgggtaccttaccggttagggacgggtaaaccggggtacccgttaacttcccgaaaccttcgttacccgaaccgaagaacccgaaacccgtaaacccgaacgtaacggtaaacgttccccgtaacgtacccgtttcgtttacccgtcgttaaccggaaacctttaaacggacgtaaaccgtccggtaaccggtaggtaacgggtaccgggttaccggaacgggtacccgtacggtgttagttacgttctaaggttcggacgtacggtactcggttaaccggtagggtttaacccgttagtaacgtacgggtaagtcgggtaccggtacgggg

SEQ ID NO: 85399 - DNA, 293 bp, Homo sapiens
  misc_feature: GYAE6OF01CTJSZ.43.22.B11.1.454.CMB.1.raw
  modified_base (290)..(293): a, c, t, g, unknown or other
  misc_feature (290)..(293): n is a, c, g, or t
tcagtgtgagtagtcacgaccggtgctcgatttagacgacagctcagggattcctgaccgattctctggctccaagtctggcacgtcagccaccctgggcatcaccggactccagactggggacgaggccgattattactgcggaacatgggacagcagcctgaatacttgggtgttcgggcggagggaccaggctgaccgtcctaagtcagcccaaggctcgccccctcggtcactctcgttcccacctcctcactactcacactgagcgggctggcaaggcgcatagnnnn

SEQ ID NO: 85400 - DNA, 864 bp, Homo sapiens
  misc_feature: GYAE6OF01D8STN.43.22.B11.1.454.CMB.1.raw
tcagtgtgagtagtcacgaccggtgctcgatttagacgacagctcaggggggtctcagagaggagccttagccctggactccaaggcctttccacttggtgatcagcactgagcacagagactcacatggaattggggctgagcgttggttttccttgttgtcttattttaggaaggttgtccagtgtggaggtgcagtcgtggtggaggtcggtgggggacgccgtgggtccgacggtccggttcggggggtcccctggacggtccttccgtccgttggtcgcgtacgtcccttcgtacggtaccttaccttaaccgtttttaaggttagtttagttagggtacttacgggtacccggttcgggggttccccggacccggaacggggtcccggttacccggggaaaggggggggtaacggggggtccggttagggggtaacgggggttcgggggtaccgggaaacccgtaaaaccgtaaaaccgtaaaaaacccggaaggtaacggttaaagggggaaaggttaacgaaaaggtaaaaacttacgttaagttcgggtacggtaaccgttcgttacgggtaacgggaaaccggttccgtaacgtttacccaacccttagtccctacccgaaggaaccgaaacccgaaacgaccaaaggcgtaccctacgtaccgttcgttacctcgtaacgaactaaagtacggtaaacgcgtaaccgtaggaacgggtacgtaccggaacgggtaacccgacggttcggtagttacgttacgttacggttggtaccggaagtacgtacccggttaaccgggtaacggtttcccgtttaagaccggtaaggtacgtccgggtacgggtccgggg

SEQ ID NO: 85401 - DNA, 295 bp, Homo sapiens
  misc_feature: GYAE6OF01C83W2.43.22.B11.1.454.CMB.1.raw
  modified_base (288)..(295): a, c, t, g, unknown or other
  misc_feature (288)..(295): n is a, c, g, or t
tcagtgtgagtagtcacgaccggtgctcgatttagacgacagctcagggattcctgaccgattctctggctccaagtctggcacgtcagccaccctggcatcaccggactccagactggggacgaggccgattattactgcggaacatgggacagcagcctagaatacttgggtgttcggcggagggaccaggctgaccgtctaagtcagcccaaggctcgccccctcggtcactctcgtcccaccctcctcactctcacactgagccggctggcaaggcgcatagcnnnnnnnn

SEQ ID NO: 85402 - DNA, 603 bp, Homo sapiens
  misc_feature: GYAE6OF01BCI14.43.22.B11.1.454.CMB.1.raw
  modified_base (216)..(216): a, c, t, g, unknown or other
  misc_feature (216)..(216): n is a, c, g, or t
  modified_base (466)..(466): a, c, t, g, unknown or other
  misc_feature (466)..(466): n is a, c, g, or t
tcagtgtgagtagtcacgaccggtgctcgatttagacgacagctcagggggggtctcagagaggagccttagccctggactccaaggcctttccacttggtgatcagcactgagcacagaggactcaccatggaattggggctgagctgggttttccttgttgctattttagaaggtgtccagtgtgaggtgcagctgggtggagtcgtggggganccgtgggtccaggccgtggggggtccctgagactctcctgtgcagcctctggactctacctttagtagttattggatgaccgtggtccgccgaggctccggaggggaaggggctgggaggtgggtcggaccaaacgataaaaccgaagatagggaagtgaagtaaactactagtgtaggactcgtggtaggaacgggtccgattaccaccgtatccgtaccgaagacgaaccaaacggacccaaaggacncctactacgtgtcctctagacaaatcgaacacgtccgtaggacggtagtacggaaggaccgacggtctggttagtacttacgtgtgacgagctaccgacgggttcggttaactacggtaaggagttcggcggtcggg

SEQ ID NO: 85403 - DNA, 744 bp, Homo sapiens
  misc_feature: GYAE6OF01BCL9C.43.22.B11.1.454.CMB.1.raw
  modified_base (565)..(565): a, c, t, g, unknown or other
  misc_feature (565)..(565): n is a, c, g, or t
tcagtgtgagtagtcacgaccggtgctcgatttagacgacagctcagggggtctcagagaggagccttagccctggactccaaggcctttccacttggtgatcagcactgagcacagaggactcaccatggaattggggctgagctgggttttccttgttgcttattttagaagtgtccagtgtgaggtgcagctggtggagtcgtgggggagccgttggggtccaggcccggttgggggggtcccctggacgtaccttcctccgtgtcgccgtacgtcccttcgtcggtaccttccgtaaccgtttttaggttaagttttagttgggattcggtacccggttcgggtccccgcccgtaggccgtaccgggaagggggtaacggggtcgtaggggaggttcgggggtacggacccaaagtaacctaaaaaccgagtacgtagggaaagtgaaagtaaactacgtagtggtacgtactcgtggtaggaacgggtctattccactactcaccagacgaaccgaacgcaagcgtacctcgacttgtcctctacgaactaagtcgaacnccggacgtaggacgggtacgtaccggaacgggtactaccgggtgttacggtagtttaaccgtttacggtacgggtcgtaacgggtaacgttccgttaaacccgggttaacgggggttttaccccggtttaaaccgtaaccggttaaaggggtacgttccggggtaacggtcccgggggg

SEQ ID NO: 85404 - DNA, 776 bp, Homo sapiens
  misc_feature: GYAE6OF01D557A.43.22.B11.1.454.CMB.1.raw
  modified_base (614)..(614): a, c, t, g, unknown or other
  misc_feature (614)..(614): n is a, c, g, or t
tcagtgtgagtagtcacgaccggtgctcgatttagacgacagctcaggggggtctcagagaggagccttagccctggactccaaggcctttccacttggtgatcagcactgagcacagaggactcaccatggaattggggctgagcgttgggttttccttgttgcttattttagaaggtgtccaggtgtgaggtgcagcgtggtggagtcggtggggagccgtgggtccgaggccggtcgggggtccctggacgtactccgtccgtgtcgcacgtcccttcgtcggtaccttccgttaaccgttttaaggttaggtttagtttaggacttcggtaccccggttcggggttccccgaccggacggtacccgtaccgggaaggggggtaacggggccggttaggggagggttcggggtacgggaaccctaaaacgtaacgttaaaaaccgaaggtaagtagggaaagtagaaaagtaaacttacgtagtcggtaggtacctgtacggtagggaaacggtccgtagtaccacctacgtcctaccgaagaacgaacccgaaaccgaccgaaagctacctaccgtacttcgtccttacggacaacgtaaagtacgaacncgtacgtagaacgtacggtacgaacgggacgtacggtattggttactacgttacgtacggttacggacgtaacgtacccggtaaccgtttaaaccgggggttcccgttttaaaacgaaccgggttaacgggtaaacgggttcggtaacgggtaccccggggg

SEQ ID NO: 85405 - DNA, 625 bp, Homo sapiens
  misc_feature: GYAE6OF01CYTUD.43.22.B11.1.454.CMB.1.raw
  modified_base (190)..(190): a, c, t, g, unknown or other
  misc_feature (190)..(190): n is a, c, g, or t
  modified_base (212)..(212): a, c, t, g, unknown or other
  misc_feature (212)..(212): n is a, c, g, or t
  modified_base (323)..(323): a, c, t, g, unknown or other
  misc_feature (323)..(323): n is a, c, g, or t
  modified_base (350)..(350): a, c, t, g, unknown or other
  misc_feature (350)..(350): n is a, c, g, or t
  modified_base (368)..(368): a, c, t, g, unknown or other
  misc_feature (368)..(368): n is a, c, g, or t
  modified_base (394)..(394): a, c, t, g, unknown or other
  misc_feature (394)..(394): n is a, c, g, or t
  modified_base (402)..(402): a, c, t, g, unknown or other
  misc_feature (402)..(402): n is a, c, g, or t
  modified_base (429)..(429): a, c, t, g, unknown or other
  misc_feature (429)..(429): n is a, c, g, or t
  modified_base (470)..(470): a, c, t, g, unknown or other
  misc_feature (470)..(470): n is a, c, g, or t
  modified_base (487)..(487): a, c, t, g, unknown or other
  misc_feature (487)..(487): n is a, c, g, or t
tcagtgtgagtagtcacgaccggtgctcgatttagacgacagctcaggggggtctcagagaggagccttagccctggactccaaggcctttccacttggtgatcagcactgagcacagaggactcaccatggaattggggctgagcggtgtttcgtgtaggctatttagtaaggtgtcagtgtgaggtgnagtcgtggtggagtgtggggcncgtcgggtccacggtccgtcgggggtcctaggacgtctctccgtgtgcacgcctcgttggacctccttaaccgtttaagttattacgttggagtcgtaccgttcgggcccncgacggtcaccgtagggaggtgtaggnggtcggagactaaacaanaaaccgagagtaggatagaacgtaanacgtagtngtcctgtggaagcggatctacaccgtntccgtacagacgacgaacctcgactagccagtctgtctacngaaccaagtacacgtanacgtagacgtacgacgacgtccgagttcgtagttcgttaacgttacggtgtccgaacggtacgttcggttaacccggtttaacggtttaccccggtacgtttaaccggttaaaggcccgggtttagggaacggtcggg

SEQ ID NO: 85406 - DNA, 738 bp, Homo sapiens
  misc_feature: GYAE6OF01B2EYX.43.22.B11.1.454.CMB.1.raw
  modified_base (301)..(301): a, c, t, g, unknown or other
  misc_feature (301)..(301): n is a, c, g, or t
  modified_base (533)..(533): a, c, t, g, unknown or other
  misc_feature (533)..(533): n is a, c, g, or t
  modified_base (568)..(568): a, c, t, g, unknown or other
  misc_feature (568)..(568): n is a, c, g, or t
  modified_base (578)..(578): a, c, t, g, unknown or other
  misc_feature (578)..(578): n is a, c, g, or t
tcagtgtgagtagtcacgaccggtgctcgatttagacgacagctcagggggggtctcagagaggagccttagccctggactccaaggcctttccacttggtgatcagcactgagcacagaggctcaccatggagttggggctgagcgttgggttttccttgttgtcttattttaggaggtgtcgagtgtggaggtgcagtcgtgggtggaggttcgggtgggggacgtccggttcggggtccgacggtcccgggttcgggggggttcccctggtaacgtccttccgttccgttggtcgccncgccttcgtcggtaccttccttaccgttttaggtttaagtttagttcgggtatacggtaccggtccgggtccgaccggtacggtccgttaccggggaagggggtacggggtcggtggggtgggtacggggtcgaacccgaaacaacgtaaaaccgaaggtaaggtaacgggaagtaagaaagtaaatacgttagtcggtaggtactcgtgggtacggaacggctactcactntaccgacagaacgaacaaccgacaagcgactcgtntcgtctacgngtaacaaatacgaacgacgacgtaggaggtacacgggaacgaacgcggtagtcgttagttacgttggttcggagtacggacgttaccggtaacggttaccgggtttaacgtttaaccggtacggttaaacggtaggttaaccgggtccgggtaaccgggg

SEQ ID NO: 85407 - DNA, 625 bp, Homo sapiens
  misc_feature: GYAE6OF01BCD2L.43.22.B11.1.454.CMB.1.raw
  modified_base (169)..(169): a, c, t, g, unknown or other
  misc_feature (169)..(169): n is a, c, g, or t
  modified_base (183)..(183): a, c, t, g, unknown or other
  misc_feature (183)..(183): n is a, c, g, or t
  modified_base (525)..(525): a, c, t, g, unknown or other
  misc_feature (525)..(525): n is a, c, g, or t
  modified_base (574)..(574): a, c, t, g, unknown or other
  misc_feature (574)..(574): n is a, c, g, or t
  modified_base (600)..(600): a, c, t, g, unknown or other
  misc_feature (600)..(600): n is a, c, g, or t
tcagtgtgagtagtcacgaccggtgctcgatttagacgacagctcgagggggtctcagagaggagccttagccctggactccaaggcctttccacttggtgatcagcactgagcacagaggactcacatggaattgggctgagcgtggtttcctgtgctatttagagtntcagtgtgagtgcngcgtggtggagtcggtggggcgtccgtgggtccaggtccggttcgggggtccctgacgtactccgtccgtaggtcgcgacgtcctgtaccggtccttaccgtacttttagttagtttatggtactacggtaccgtcgggtcccgaccgaggtcctaccgggagggagggtctgggacgggtgggtacggaacaaacgaacgtaaacgaaggagtaaggaagtagaaactaaattacgtagtcgtgtactgtaggtacgtacgggtctagtaccgtacctagtccgaacacgaacgaaccgaaccacgaacgcgacctaccgagtctctagacgaacgttaancgaactcaccgtagagtcgagaacgtcgacgtcgtatgtactgtgcganacggtctaccggtaggttaccgttanacggttaagagttcggcgtaccggg

SEQ ID NO: 85408 - DNA, 995 bp, Homo sapiens
  misc_feature: GYAE6OF01DQSKB.43.22.B11.1.454.CMB.1.raw
  modified_base (194)..(194): a, c, t, g, unknown or other
  misc_feature (194)..(194): n is a, c, g, or t
tcagtgtgagtagtcacgaccggtgctcgatttagacgacagctcgagggggtctcagagaggagccttagccctggactccaaggcctttccacttggtgatcagcactgagcacagacggactcaccatggaattgggctgagtcgttcgggttttccttgttgcttatttagagtgtcagtgtgaggtgcngcgtgggtggtaggtcggtagggggacgtccgtcggggtaccgacggtcccggggttcgggggttccccgtaggaccgtaccgttcccgtcgttcggtacgacctacgtccctacggtcggtaccttaccgtttaaccgtttagtttagtttacggttaggaccttcggtaccccggttcggggtccccggtaaccggtacggtacccggttaccggggaagggggtaacggggtccgttagggggtaccgggttaggggtacccgaaaccccgtaaaagtaaaaccgtaaaaccggtaaaggaaggttaacgggtaaacggtaaaggtaaaaaggttaaaaccgttaacgtttaaggtacgggtaacggtaaccgtttaggttacgggtaacgggtaaaccggtaccgttaacccttaccgtaaccgtaccgttacccgtaacgaaacgggaaccgtaaacccggaaacccgttaaccggaaacgtcgttaaccctaccgttaaccggttacgttacccaacggttacaaaacggttaaactaccgtaaaaccgggtcctaaccggtaaggtaacccggggtaacgggtaaaccgggaaccgggtaaacccccggtaggggttaacccgtttaggggtttaaccttaaccgttacggggttacggttaacccggtaaacgggtaaggtttaaccccccgggttaacgggttttaacccggggttttaaacccccggttttaaggtaaaccccgttaggtaaacccgggggtttacggtaaccccgggtttacccgggggg

SEQ ID NO: 85409 - DNA, 704 bp, Homo sapiens
  misc_feature: GYAE6OF01CVLLU.43.22.B11.1.454.CMB.1.raw
tcagtgtgagtagtcacgaccggtgctcgatttagacgacagctcagggggtctcagagaggagccttagccctggactccaaggcctttccacttggtgatcagcactgagcacagaggactcaccatggaattgggctgagctgggttttccttgttgctattttagaggtgtccagtgtgaggtgcagcgtggtggagtcggtgggggacgccgtggggtcccaggtcccggttggggggtcccctggacgtacctctccgtgtcgcagccttctggacctctacctttagttagttattggatgaccgtgggtcccgccgacggcctccgaggggaacgggcgtggggaggtcggggtcggacccaaacgaataaaaccgaagagtagggaagtacgaaagtaaaattacgtaagtggtaggacttcgtgtaggaaggtcccgaagttccaccgtatcctaccgaagaacgacgaaaccgacccaaagacgtcctacacgttgtacctcgtacgaactaagtccgaaactcgtaccctaggaacgtacgtaccggaacggaacctcgggtcttaaggttacggttaactttaccgtgggtccgaacggtaacgtaacccgttacccggttaaacgggggtttccccgttttaaaccgtaaccgttaacgggtaacggttcggggtaccgttacccggggg

SEQ ID NO: 85410 - DNA, 298 bp, Homo sapiens
  misc_feature: GYAE6OF01DDQJR.43.22.B11.1.454.CMB.1.raw
  modified_base (289)..(298): a, c, t, g, unknown or other
  misc_feature (289)..(298): n is a, c, g, or t
tcagtgtgagtagtcacgaccggtgctcgatttagacgacagctcagggattcctgaccgattctctggctccaagtctggcacgtcagccaccctgggcatcaccggactccagactggggacgaggccgattattactgcggaacatgggacagcagcctgaatacttgggtgttcggcggagggaccaggctgaccgtcctaagtcagcccaaggctcgccccctcggtcactctcgttcccacctcctcactactcacactgagcgggctggcaaggcgcatagnnnnnnnnnn

SEQ ID NO: 85411 - DNA, 889 bp, Homo sapiens
  misc_feature: GYAE6OF01C17F3.43.22.B11.1.454.CMB.1.raw
  modified_base (204)..(204): a, c, t, g, unknown or other
  misc_feature (204)..(204): n is a, c, g, or t
  modified_base (220)..(220): a, c, t, g, unknown or other
  misc_feature (220)..(220): n is a, c, g, or t
  modified_base (397)..(397): a, c, t, g, unknown or other
  misc_feature (397)..(397): n is a, c, g, or t
  modified_base (672)..(672): a, c, t, g, unknown or other
  misc_feature (672)..(672): n is a, c, g, or t
tcagtgtgagtagtcacgaccggtgctcgatttagacgacagctcagggggtctcagagaggagccttagccctggactccaaggcctttccacttggtgatcagcactgagcacagagactcaccatggaagttcgggctgagtcgttggttttccttgttgacttattttagaaggtgtccagtgtgaggtgcagcgtaggnggagtcggtggggacnccgtcgggtaccacggccggttaggggggtccctaggacgtacctccgtccgtaggtcgccacgttcccgtgtacggtactccgttaaaccgtttaggttacgtttagttagtaacgttccgtaaccggttcggggcccgtaccgaggttccgtaccggaaggggacgggttccggnggggtaaggttcggggaccgacccgtaaaccgaaacgtaaaccgaaggtagtaacggggtaaagtaggtaaacggtaaaacttaccgttaaggtcgggttaacgtaaccggtttggtaacgggtaacgggttaaaccggggaccctttaacgtaacccggtaccctaaacgttcccgttaacgaacggaaacccgggttaaccaaaccccggttaaggaaacgtcgtacccggttactaccgggttactacccgttaacgtacaacggtttaaanaccggttaacaccgggtaccttagggaaaccggtaccggtaaccggaggttaacccggcggttacgttagggtttagaaccgttttaacggcggtaaccggttaaggaaccggttaaaccccggtaacggggtttacccggggtttaaccccgggtttaaaacgtccggggtttaaaaggggcccgttaacgggggttacccggttaaaccgggggg

SEQ ID NO: 85412 - DNA, 863 bp, Homo sapiens
  misc_feature: GYAE6OF01DLFCT.43.22.B11.1.454.CMB.1.raw
  modified_base (114)..(114): a, c, t, g, unknown or other
  misc_feature (114)..(114): n is a, c, g, or t
  modified_base (191)..(191): a, c, t, g, unknown or other
  misc_feature (191)..(191): n is a, c, g, or t
  modified_base (197)..(197): a, c, t, g, unknown or other
  misc_feature (197)..(197): n is a, c, g, or t
  modified_base (220)..(220): a, c, t, g, unknown or other
  misc_feature (220)..(220): n is a, c, g, or t
  modified_base (257)..(257): a, c, t, g, unknown or other
  misc_feature (257)..(257): n is a, c, g, or t
  modified_base (274)..(274): a, c, t, g, unknown or other
  misc_feature (274)..(274): n is a, c, g, or t
  modified_base (334)..(334): a, c, t, g, unknown or other
  misc_feature (334)..(334): n is a, c, g, or t
tcagtgtgagtagtcacgaccggtgctcgatttagacgacagctcgaggggggtctcagagaggagccttagccctggactccaaggcctttccacttggtgatcagcactgancacagagactcacatggtaagttgggctgagtcgttgggttttccttgttgtcttattttagaaggtgtcagtgtgnggtgcngcgtggtggagtcggtggggacnccgtgggtccaggtccgggttggggggtccctggacnccttccgtcgtgtcgcncgtcctcgtggaccttacttacgtttagttagtttagtggtactcgaccgtcgggtcccnccgacggccgtacggaggggacggtcggtaggggtcggtaggggtaccggtaaaccaaacgtaaaccgttaaaaaccgaaggtaaggttaagggggtaaaaacgtaggggtaaaacgtaaaactttaaccgtaaggtttacgggttacggttaacgttcgggtttacggtacggggtaaacggtaccccggttattaccccaaccgttaccgtcccgtaaacacgggaaacgaccccgtaaacccgaacggaacgaccgttacgttaccctagttccttccgttaacgaaccgaaattaaacgacggtaacgtccctaacgggtaccgagggtaacccgtaacgggaaacgggttcccgaaccggttgggtttaacccgttggttaaacttacccggttaggcccggggtaattaccgggaaacccgttttaacccgggggttaacccgggttttaaacccggtttaaccggttaaaccggggttaaccggtaacggggtttcggggtaccccgggttaacccgggggg

SEQ ID NO: 85413 - DNA, 826 bp, Homo sapiens
  misc_feature: GYAE6OF01CZ78C.43.22.B11.1.454.CMB.1.raw
  modified_base (618)..(618): a, c, t, g, unknown or other
  misc_feature (618)..(618): n is a, c, g, or t
tcagtgtgagtagtcacgaccggtgctcgatttagacgacagctcaggggggtctcagagaggagccttagccctggactccaaggcctttccacttggtgatcagcactgagcacagaggactcaccatggaagttggggctgagcgttgggttttccttgttgcttattttagaggtgtccagtgtgaggtgcagtcgtgggtggacgtcggtgggggagccgtggggtccgacggtcccgggttcggggggtcccctggacggtaccttccgtccgtggtcgccgacgtcccttcgtacggtaccttccttaaccgttttaaggtttagtttaagttgggtaacttcgggtacccggttaccgggggtcccgacccggacggtaccgtacccgggaaggggggtaacggggtcgtaggggtagggttcggggtaacggaaccctaaaacgtaaacgtaaaaccggaaggtacggtaagggtaaggtaaggaaaacgttaaaagtacgttaagtacggtaggtaccttaggtcgggtaacggaacgggtccttactaccctactaactaccacggtaagaacgaacccgaacaccgaagacgtccctactacgttnttaccctatagaacaaacgttacgaaccgtacgtaccggtaggtacggtacggtacgggaacgaccggtaccggtcgtttaggtttacgttaccgttgtacgggtcggaccgttaaggtaacccggttacccggtttaaacgggtttacccgggtttaaacctacgggttaacgggttaacgcggggtttaacgggtaccccgggggg

SEQ ID NO: 85414 - DNA, 927 bp, Homo sapiens
  misc_feature: GYAE6OF01BL2Z5.43.22.B11.1.454.CMB.1.raw
tcagtgtgagtagtcacgaccggtgctcgatttagacgacagctcgagggggtctcagagaggagccttagccctggactccaacggcctttccacttggtgatcagcactgagcacagaggactcaccatggaagttggggctgagtcgttgggtttttccttggttgcttagttttagaggttgtccgagtgtggaggtgcgagcgtggtggaggtcggtagggggacgtcccggttggggtcccacggtcccgggttcggggggtcccctaggaacgtacccgttccgttccgtaggttcggaccgtacgtccccgttcgtacgggtacctttacccgttaacccgtttttaaggttaagtttttagttcggggtaacttcgggtaaccccggttcggggtaccccgaccggtaacgggtcccgttaccccggggaagggggtaacgggggtccgttacgggggaagggtttcgggggtacccggtaccgaaaacgtaaaccgttaaaaccgaaggtaacgtaggggaaacgttagaaagtaaaacttacgtagtacggtacggtacttggtaggtacgggaacgggtacctacgttacccaaccgttacgttacccgtaacccgaagaacccggaaaccaaaccggacccgtaaagggcctaccttaacgtccgttccgtttacgtaaccgtgtaaacctaaacgttacgaaacccggtccggttaactacgggaaggtaacccggttagggaacggttaccgaaccgggttcgttagggtttacttaccgggttaacggttcgttagggaaccctaagggttaacccgtttaaccccggggttaaacggggtttttaccccgtttaaaccgtttaaccgggaacgggtttaaacggttccgggtaaccccggggttacgggg

SEQ ID NO: 85415 - DNA, 735 bp, Homo sapiens
  misc_feature: GYAE6OF01EZIFT.43.22.B11.1.454.CMB.1.raw
  modified_base (241)..(241): a, c, t, g, unknown or other
  misc_feature (241)..(241): n is a, c, g, or t
  modified_base (297)..(297): a, c, t, g, unknown or other
  misc_feature (297)..(297): n is a, c, g, or t
tcagtgtgagtagtcacgaccggtgctcgatttagacgacagctcagggggtctcagagaggagccttagccctggactccaaggcctttccacttggtgatcagcactgagcacagaggactcaccatggaattggggctgagcttgggttttccttgttgcttattttagaggtgtccagtgtgaggtgcagctgggtggagtcgtgggggagccgtgggtccagccgtgggggtcccngagactctccgtgtcgcgctcctgtacgtctccgttacttagttagttacgtagtntacgtcggttaccggcccgtcggacgtccgtacgggacggggtaggcggtgggtacgggtgggccggaacccaaagaaacgtaaaccgaagtaggaacggtaagagtaaacgtaatactagtgtacggctgtaggacggtacggatactacctactactacctacgaacgacgaaccgtaccgaaccgtaagacgtacctaccgtacgttcgtccttacgtaagaacctaacgtaacgaacgtaccgtacggtacggacggtacgggaacggaacgggtaccgtaccggtaggttaggttaacggtttaaacttcgggttaaggtcgtaggtaaccgtacccggttaaaccgggttaaacccggggttttaacccggttaaccggtttaaaccgggtaaaggttcggggtaaaccccggtccgggggttaaccggggg

SEQ ID NO: 85416 - DNA, 906 bp, Homo sapiens
  misc_feature: GYAE6OF01AUT51.43.22.B11.1.454.CMB.1.raw
  modified_base (707)..(707): a, c, t, g, unknown or other
  misc_feature (707)..(707): n is a, c, g, or t
tcagtgtgagtagtcacgaccggtgctcgatttagacgacagctcagggggtctcagagaggagccttagccctggactccaaggcctttccacttggtgatcagcactgagcacagaggactcaccatggaagttgggctgagtcgttggtttttccttgttgcttagtttttagaaggtgtaccgtagttgtgaggttgctagcgttggtggtagtcggtgggggatccgtgggtccgaggtccggttcgggggtccctaggtacgtccgttccgttaccgtcggttacgacgtccgtaccttcggttaccggtaacctttcccgttaaacccgtttttagggtttaacgtttagttttacggtaacgtccggttacccggttccggggtaccccggtacccgtaggggtacccccgttacggggaaaccggggggtaaggggttcccggttaggggtacgggttaccggggggtaccgtaaaccccgtaaacgttaaaaccgttaaaaaccggaagtaacgggttaacggtaaaggttaaacggaacgtaaaacgttacgttaaggtcgggttaacgacgtttacggtcgggtaaagggtaccgggtacttaccgtttaaccgacctcgttaccaccgtaagacgaaaccgaccgaacgaagtaccgtactacgtacgttccggtacctagtaccaacgtaaanaccgtaacgtctaaccgggttgaacggtacggtaccgaacggtacggtacgtacgtttagtaaggtttacgttaccgtgggtaccgaaagggttacccgtaaacccgggtttaccggttaaaccggggtttttaaccgtaaaccggttacccgggttaaacgggtcgggttttacccggtaaccgggttacccgggggg

SEQ ID NO: 85417 - DNA, 695 bp, Homo sapiens
  misc_feature: GYAE6OF01APMZO.43.22.B11.1.454.CMB.1.raw
  modified_base (218)..(218): a, c, t, g, unknown or other
  misc_feature (218)..(218): n is a, c, g, or t
  modified_base (331)..(331): a, c, t, g, unknown or other
  misc_feature (331)..(331): n is a, c, g, or t
tcagtgtgagtagtcacgaccggtgctcgatttagacgacagctcaggggggtctcagagaggagccttagccctggactccaaggcctttccacttggtgatcagcactgagcacagaggactcaccatggaagttggggctgagcttgggttttccttggttgctattttagaaggtgtccagtgtgaggtgcagcgtggtggagtcgtggggganccgtgggtccaggccgtcggggggtccctggacgtactctccgtgtcgcacgcctcgtggacctctacctttaggttagttatggtatcgtaccgtcggtccgccgaggtccnccggaagggaggggtccgtaggggaggttcggggacgacccaaacgaaactaaaccaaggataggggtaaacgtagtaaagtaaacgttacgtaagttcggtaacggtacttaccggtaggtagggtaaacgggtcccgtaactttacccgaacctacgtccctaacggacgaaccgtaaccgaaacctaccggaaacgtcgactaccgtcgtcgtacttccgtgaacctaaacgttcgaaactcgaccgtaggaaccggtcgtacggacggtaaccgacggttgtacgtacgttatcgttcgcgtacgaggtcgtaccgtacgggttccgttaacacggtaaggtagtcggtacgtaccgggg

SEQ ID NO: 85418 - DNA, 745 bp, Homo sapiens
  misc_feature: GYAE6OF01DPLJ0.43.22.B11.1.454.CMB.1.raw
  modified_base (186)..(186): a, c, t, g, unknown or other
  misc_feature (186)..(186): n is a, c, g, or t
  modified_base (604)..(604): a, c, t, g, unknown or other
  misc_feature (604)..(604): n is a, c, g, or t
tcagtgtgagtagtcacgaccggtgctcgatttagacgacagctcgagggggtctcagagaggagccttagccctggactccaaggtccctttccacgttggtgatcagcactgagcacagagctcacagtggagtgggctgagtcgttggtttctgtgcttatttagagtcgtcagtgtcgagtncgagtcgtggtaggcgtcggtagggggcgtccgtgggtccgtacggtcccggtcgggggtcctagaacgtccttccgccgttggcgccgacgtcccgttcgtaggtacctttacgttaaacgttttacggtttagttaagttaagggtctaccggtccggttccgggccgtaccggacggttccgtaaccggagggggaacggtcgtaggggtaggtgggtaacgaacaaacgtaaacgtaaaacgaggtagtaacggaggtaaagtaaagtaaataacgttaggttacggtacggtaacttcggagggtaacggaaccggtacgtaagttaaccactaacgtccgtaacaacggacgtaaaccgaacggttaacaacggaacggtcctactcgttcccgactctaacgaaacgtaanaaccggtaataccggtacgtaaggaccgggtagtaccgggaatacggtcgtccggttattacgttagtacggtgtacggaactgtaaacccggtacgttaccggttaaccgtttacaacgtaacggacgtggtcggacggg

SEQ ID NO: 85419 - DNA, 807 bp, Homo sapiens
  misc_feature: GYAE6OF01D3ZI8.43.22.B11.1.454.CMB.1.raw
  modified_base (200)..(200): a, c, t, g, unknown or other
  misc_feature (200)..(200): n is a, c, g, or t
  modified_base (277)..(277): a, c, t, g, unknown or other
  misc_feature (277)..(277): n is a, c, g, or t
  modified_base (612)..(612): a, c, t, g, unknown or other
  misc_feature (612)..(612): n is a, c, g, or t
  modified_base (691)..(691): a, c, t, g, unknown or other
  misc_feature (691)..(691): n is a, c, g, or t
tcagtgtgagtagtcacgaccggtgctcgatttagacgacagctcaggggggtctcagagaggagccttagccctggactccaaggcctttccacttggtgatcagcactgagcacagaggactcaccatggaattgggctgagcggtgtttcgtgttaggcgtattagaaggtgtcagtgtgaggtgcgagcgttgggnggtggtggtagggggacgtccgttcggggaccgtcggtccggttcggggggtccctggacgtctctcgtgtgaccgngtcctgtcgtaccttcctaagttttagttagttagttcggtacgttacgtcggttaccgggccgccaacgggtcccgtaaccgggtaggggaacggggtcgtagggcgggtgggtaccgaaccaaaacgaaacttaaaaaccgaggtaaagtgggtaaaggtaacaaagttaaaagacttaagggtacggttcggtaagttggtaggtaggtaaccggggtccctaacggtttaaccacccttaagttcccgaaccggaacgtaacggaaaccaaccgtaacggacgaaccgtactacctcggtttaacctcgttcttaactaactaaacggtanaacccgaaggtccgtaaacgaggttaccggaacgaggaaacccgtcgggtaccttgttaaacggttcgttttaacgggngttaacccggtagggtaaccggtttaaccgggttaaaccggttaccgggttttaacccgggttaaacgttaaaccgggttaaggtaacccggtacgggttacggggttacccgggg

SEQ ID NO: 85420 - DNA, 735 bp, Homo sapiens
  misc_feature: GYAE6OF01EF7TR.43.22.B11.1.454.CMB.1.raw
  modified_base (551)..(551): a, c, t, g, unknown or other
  misc_feature (551)..(551): n is a, c, g, or t
tcagtgtgagtagtcacgaccggtgctcgatttagacgacagctcgaggggggtctcagagaggagccttagccctggactccaaggcctttccacttggtgatcagcactgagcacagaggactcaccatggaagttggggctgagtcgttgggtttttccttgttgcttattttagaaggtgtccagtgtgaggtgcgagcgtggtggagtcggtgggggacgccgtcggggtccacggtccggtcggggggtccctgacgacctcgttccgtgtcgcgacgtccttcgtacggtaccttaccgttaaccgttttaagttagtttaaggttggtaacttcggtaccgtcgggtcccgccgacggccgtaccgggagggggacggggtcgtggggtagggtcgggtacggaaccaaactaacgtaaaaccgaaggagtacgggaaaggtaagtaaaggtaaacttacgtagttggtacgtacgtcgtaggtacgggaacggtacgtacttaccgactactccgtacgaagtagaaacccacgacaagacnccttacacgtctctacgtagaaactaacgtcaagctaccgtagacggtacggttacggagtaaccgacggttgtagtaacgtttacgtccggtaggtcgaagacggttaccgtaaacccgggttagggtttacccggttaactaaacgggttaacggtaagttcccggggtcgttacccggggg

SEQ ID NO: 85421 - DNA, 297 bp, Homo sapiens
  misc_feature: GYAE6OF01BU8YE.43.22.B11.1.454.CMB.1.raw
  modified_base (290)..(297): a, c, t, g, unknown or other
  misc_feature (290)..(297): n is a, c, g, or t
tcagtgtgagtagtcacgaccggtgctcgatttagacgacagctcagggattcctgaccgattctctggctccaagtctggcacgtcagccaccctgggcatcaccggactccagactggggacgaggccgattattactgcggaacatgggacagcagcctgaatacgttgggtgttcggcggagggaccaggctgaccgtcctaagtcacgccaaggctcgcccctcggtcactctcgtccccacctcctcactactcacactgacgcggctggcaaggcgacatagnnnnnnnn

SEQ ID NO: 85422 - DNA, 902 bp, Homo sapiens
  misc_feature: GYAE6OF01DHH8T.43.22.B11.1.454.CMB.1.raw
  modified_base (177)..(177): a, c, t, g, unknown or other
  misc_feature (177)..(177): n is a, c, g, or t
tcagtgtgagtagtcacgaccggtgctcgatttagacgacagctcgagggggtctcagagaggagccttagccctggacctccaaggcctttccacttggtgatcagcactgagcacagagctcacatggaagttgggctgagtcgttggttttcttgttgtcttagtttagaggtntcgagtgtgaggtgcgagcgtggcggagtcggtggggactccgtggtccgacggtccggtcggggtcccagacgtaccttcgttcgtcggtcgaccgtacgttcccgtacgttaccggtaacccttacggtttaaacccgtttttaaaggttacggtttttaggttacgggtacttaaccggttccgggttccccggggtacccggtacccggtaaccgggtaccgtaaccggggaaacggggggtacgggttaccggttggggtaccgggttacggggtaccgtaaaaccctaaacgaaaaccgttaaaaccggaggtaaacgttagggtaacgtaaggaaaactaaaacgttacgttaggttaacggtcggtaccgttaagttgggtaaaccgggaacggtaccctttaacgtacccgtaacgtaccgttaccgtaaccggaaacggtaacgaaaccccgaaacgtaaccggaaacggtacgttacccgtaccgttaaccgttcgttaccgtacaacgttaaacaacggtactaacgtaacgtcgtaacggaacggtacgtaacgggtaaccggtaccgtacgggttacctttaggtaaccgtttacgtttaagggcgttacgggaaccggttaactaccggtttaacccgggttaaccggttttaacccggtaaagtttaaacccgggaggtttaccggaccggttcgggttaacccggggg

SEQ ID NO: 85423 - DNA, 824 bp, Homo sapiens
  misc_feature: GYAE6OF01ACF5P.43.22.B11.1.454.CMB.1.raw
tcagtgtgagtagtcacgaccggtgctcgatttagacgacagctcagggggtctcagagaggagccttagccctggactccaaggcctttccacttggtgatcagcactgagcacagaggactcaccatggaattggggctgagctgggtttccttgttgctattttagaaggtgtccagtgtgaggtgcagctggtggagtcgtgggggacgccgtgggtccagccgtggggggtccctgagactctcctgtgcagcctcgtggacctcactttagtagttattggatcgaccgttgggtcccgccgacgggcctacccggagggggaacgggggtcgtggggagggttcgggggtcgggaccctaaaactaacgtaaaaccgaaaggagttacggggaaaggtacgtaaagaaaacttacgtaagttggtacggtaacttcgtaggttagggaaacggggtcccgtaagttaccaaccctaccgttccgtaaccgaacggaacgaacccctaaaacccgggacccgaaaggtagtaccccttacccgtaaacgtttcggttaccccttacggttaccgaaacccgtaaaaagttccgggaaaaacctacccgggtacccttaaggggtaaacgggtaaccgggttaccggggaaacggtaaccccgggtacgggtacccgttagggttacgttttaaacgttacgttggggtttacgaccggttaacggtacgttaaccccggttaaacggggttttaaccccgggttttaacctaacgggttaaacgggaacgtttccgggggtaaccggtttcccggggg

SEQ ID NO: 85424 - DNA, 366 bp, Homo sapiens
  misc_feature: GYAE6OF01DEFXF.43.22.B11.1.454.CMB.1.raw
  modified_base (143)..(143): a, c, t, g, unknown or other
  misc_feature (143)..(143): n is a, c, g, or t
  modified_base (161)..(161): a, c, t, g, unknown or other
  misc_feature (161)..(161): n is a, c, g, or t
  modified_base (252)..(252): a, c, t, g, unknown or other
  misc_feature (252)..(252): n is a, c, g, or t
  modified_base (272)..(272): a, c, t, g, unknown or other
  misc_feature (272)..(272): n is a, c, g, or t
  modified_base (294)..(294): a, c, t, g, unknown or other
  misc_feature (294)..(294): n is a, c, g, or t
  modified_base (298)..(302): a, c, t, g, unknown or other
  misc_feature (298)..(302): n is a, c, g, or t
  modified_base (304)..(366): a, c, t, g, unknown or other
  misc_feature (304)..(366): n is a, c, g, or t
tcagtgtgagtagtcacgaccggtgctcgatttagacgacagctcagggattcctagaccgattctctggctccaagtctggcacgtcagccaccctgggcatcaccggactccagactggggacgaggccgattattaacgngcggaacatggggacagnagcctagaattacttgggtagttcggcggacgggacagggctgaccgtctaagtcaggcccaaggctcgcccctggtccactcgtcgtccnccctctcactactcaactgngacgcggctaggacgaggctanatannnnncnnnnnnnnnnnnnnnnnnnnnnnnnnnnnnnnnnnnnnnnnnnnnnnnnnnnnnnnnnnnnnn

SEQ ID NO: 85425 - DNA, 767 bp, Homo sapiens
  misc_feature: GYAE6OF01DCXW6.43.22.B11.1.454.CMB.1.raw
  modified_base (194)..(194): a, c, t, g, unknown or other
  misc_feature (194)..(194): n is a, c, g, or t
  modified_base (201)..(201): a, c, t, g, unknown or other
  misc_feature (201)..(201): n is a, c, g, or t
  modified_base (216)..(216): a, c, t, g, unknown or other
  misc_feature (216)..(216): n is a, c, g, or t
  modified_base (260)..(260): a, c, t, g, unknown or other
  misc_feature (260)..(260): n is a, c, g, or t
  modified_base (578)..(578): a, c, t, g, unknown or other
  misc_feature (578)..(578): n is a, c, g, or t
tcagtgtgagtagtcacgaccggtgctcgatttagacgacagctcagggggggtctcagagaggagccttagccctggactccaaggcctttccacttggtgatcagcactgacgcacagaggactcacagtaggagttgggctggagtcgttggttttctgtgtctatttaggaggtgtcgagtgtgagtgcngtgtggnggagtcggaggggcnccgtgggccacggtcggtcgggggtcctggactctcgtctggtncacgtcctgtacgtcctacttacgtttagttaagttagtgagttaccgaccggtcggtcccgaccggaggtccgtaccggggagggggacggggtcgtggggtacggtcggggaactacccaaagaacgtaaaacaggaggtaaggaacgtagaaataaacttagtacggtggtcgtacgttcggagggtaacggtacgggtaaccttactacccgacgttacctaccaacgtaacggaacaaaccgaaccgtaacgaaggtaccctcggttactaaccgttcggtaccctagtacccgaaataaccggtgtaaaccncggttaccggaaggaacggttaacggaaccgggtaaacgtccgggaacgtcgttttaaggttacgttaccttacggggtgttacggaacggtaacggtttacccgtaaaccggggttgggtttttaaaccccgtaaacggtttaaccggggataaccgggggtttacggtaacccgggggtaccggggg

SEQ ID NO: 85426 - DNA, 287 bp, Homo sapiens
  misc_feature: GYAE6OF02HTM7F.43.22.B11.1.454.CMB.1.raw
  modified_base (283)..(287): a, c, t, g, unknown or other
  misc_feature (283)..(287): n is a, c, g, or t
tcagtgtgagtagtcacgaccggtgctcgatttagacgacagctcagggattcctgaccgattctctggctccaagtctggcacgtcagccaccctgggcatcaccggactccagactgggacgaggccgattattactgcggaacatgggacagcagcctgaatacttgggtgttcggcggagggaccaggctgaccgtcctaagtcagcccaaggctgcccctcggtcactctgttcccacctcctcactactcacactgagcggctggcaaggcgcatgnnnnn

SEQ ID NO: 85427 - DNA, 292 bp, Homo sapiens
  misc_feature: GYAE6OF02GNUKA.43.22.B11.1.454.CMB.1.raw
  modified_base (288)..(292): a, c, t, g, unknown or other
  misc_feature (288)..(292): n is a, c, g, or t
tcagtgtgagtagtcacgaccggtgctcgatttagacgacagctcagggattcctgaccgattctctggctccaagtctggcacgtcagccaccctgggcatcaccggactccagactggggacgaggccgattattactgcggaacatgggacagcagcctgaatacttgggtgttcggcggagggaccaggctgaccgtcctaagtcagcccaaggctgccccctcggtcactctgttcccaccctcctcactactcacactgagcgggctggcaaggcgcatagnnnnn

SEQ ID NO: 85428 - DNA, 624 bp, Homo sapiens
  misc_feature: GYAE6OF02JEMRB.43.22.B11.1.454.CMB.1.raw
  modified_base (208)..(208): a, c, t, g, unknown or other
  misc_feature (208)..(208): n is a, c, g, or t
tcagtgtgagtagtcacgaccggtgctcgatttagacgacagctcagggggtcgtcagagaggagccttagccctggactccaaggcctttccacttggtgatcagcactgagcacagaggactcaccatggaattgggctgagcggtggtttcgtgtaggcgtatttagaaggtgcagtgtgaggtgcgagcgtgtggagtgtgggngcgtcggtcgcgcggtcgggtccgtcgacgacgtcgtcgtcgtcgcgcgcgtcgtcgtacgtcgtacgttacgttagttagttgtagtacgtacgtcggtccgtccgacgtcgtaccggacggagggacggtggtggtggtacggacgaacgaacgtaacgaagagtaggaggtagaagtaagtagtagtagtagtacgtagtagtagacggacgtacgtacgtacgtacgtactacgtacgacgacgacgacgacgacgactactacgtcgtcgtcgtacgtacgtaacgacgtaacgacgtacgtacgacgacggtacgacgacgacgacgtagtacgttacgttacgtacgtcgtacgtacgtacgtacgtacggtacggttacgtacgtacggtacggtacggtacggtcgg

SEQ ID NO: 85429 - DNA, 540 bp, Homo sapiens
  misc_feature: GYAE6OF02GO5D5.43.22.B11.1.454.CMB.1.raw
  modified_base (417)..(417): a, c, t, g, unknown or other
  misc_feature (417)..(417): n is a, c, g, or t
  modified_base (449)..(449): a, c, t, g, unknown or other
  misc_feature (449)..(449): n is a, c, g, or t
  modified_base (463)..(463): a, c, t, g, unknown or other
  misc_feature (463)..(463): n is a, c, g, or t
tcagtgtgagtagtcacgaccggtgctcgatttagacgacagctcagggggtctcagagaggagccttagccctggactccaaggcctttccacttggtgatcagcactgagcacagaggactcaccatggaattggggctgagcgtggtttcgtgtaggctatttagaaggtgtcagtgtgaggtgcagctggtggagtctgggggagcctgggtccagcctggggggtccctgagactctcctgtgcagcctctggactcacctttagtagttaattggatgacctgggtccgccaggctccagggaaggggctggagtgggtggccaacataaaaccaagatggaagtgagaaaatactaatgtggactctgtgaaagggccgattcgaccatctccagagacaacgccaaganctcactgtctctgcaaatgaacagcctgaagngtcgaggacacggntcgtgtattacgtgtgcgaagtactaccgaaaggttcccgggtttaacttacgtaccggaagttcggacgttacggg

SEQ ID NO: 85430 - DNA, 748 bp, Homo sapiens
  misc_feature: GYAE6OF02HEVHV.43.22.B11.1.454.CMB.1.raw
tcagtgtgagtagtcacgaccggtgctcgatttagacgacagctcaggggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggagcctgggtccaggccgtggggggtccctgagactctcctgtgcagcctctggactcacctttagtagttattggatgaccgtgggtccgccgaggcctccgaggggaaggggctgggaggtggggtggaccaacactaaaaccaagagtaggaaagtgaagaaatactagtggtaggactcgtaggtaggaacggggccgtaatttccgaacctattccctaccgaaggaacgaaccgaaaccgaccgaaaggacgtacctaccaaccgttcggttaccttaccgttagaacctaaaagtacggaaaacctacggtacccgttagggaacggtaacggtccgggaaacggggtaacccgaaccggggtcttagggttacgtttaacgtttaaccgttacgggttacgggaaccggtaacggtaaacgtttaccccgggtaaaacgggggttttaccccgggggttttttaaaccctaaaccgggtttaaacccggggtaaaggtttaccggggggtaaacccgtttcccggggggg

SEQ ID NO: 85431 - DNA, 297 bp, Homo sapiens
  misc_feature: GYAE6OF02H0XJN.43.22.B11.1.454.CMB.1.raw
  modified_base (280)..(280): a, c, t, g, unknown or other
  misc_feature (280)..(280): n is a, c, g, or t
  modified_base (286)..(297): a, c, t, g, unknown or other
  misc_feature (286)..(297): n is a, c, g, or t
tcagtgtgagtagtcacgaccggtgctcgatttagacgacagctcagggattcctgaccgattctctggctccaagtctggcacgtcagccaccctgggcatcaccggactccagactggggacgaggccgattattactgcggaacatgggacagcagcctgaatacttgggtgttcggcggagggaccaggctgaccgtctaagtcagcccaaggctgccccctggtcactctgttccccacctcctcactactcaacactgagcggctggcaaggcncatagnnnnnnnnnnnn

SEQ ID NO: 85432 - DNA, 331 bp, Homo sapiens
  misc_feature: GYAE6OF02IP60R.43.22.B11.1.454.CMB.1.raw
  modified_base (176)..(176): a, c, t, g, unknown or other
  misc_feature (176)..(176): n is a, c, g, or t
  modified_base (285)..(290): a, c, t, g, unknown or other
  misc_feature (285)..(290): n is a, c, g, or t
  modified_base (292)..(331): a, c, t, g, unknown or other
  misc_feature (292)..(331): n is a, c, g, or t
tcagtgtgagtagtcacgaccggtgctcgatttagacgacagctcagggattcctgaccggattctctggctccaagtctggcacgtcagccaccctgggcatcacccggactcccagactggggacaggccgattattactgcggaacatgggacagcagcctgaatacttgggnttcggcgagggaccaggctgaccgtcctaagtcagcccaaggctgcccccctggtcactctgttcccgcctctcactactcacactgagcggctggcaaggcgcatagnnnnnnannnnnnnnnnnnnnnnnnnnnnnnnnnnnnnnnnnnnnnn

SEQ ID NO: 85433 - DNA, 682 bp, Homo sapiens
  misc_feature: GYAE6OF02J0813.43.22.B11.1.454.CMB.1.raw
  modified_base (410)..(410): a, c, t, g, unknown or other
  misc_feature (410)..(410): n is a, c, g, or t
  modified_base (520)..(520): a, c, t, g, unknown or other
  misc_feature (520)..(520): n is a, c, g, or t
tcagtgtgagtagtcacgaccggtgctcgatttagacgacagctcaggggggtctcagagaggagccttagccctggactccaaggcctttccacttggtgatcagcactgagcacagaggactcaccatggaattggggctgagctgggttttccttgttgctattttagaaggtgtccagtgtgaggtgcagctgggtggagtcgtgggggagcctggggtccaggccgtggggggtccctgagactctcctggtgcagcctcgtggacctctacctttagtagttattgggatgaccgtgggtcccgccgaggcctccgaggggaggggctgggaggtggggtcgacccaaacgtaactaaaaccgaagacgtggaaaggtgaagaaactactagtaggtaggactntggtaggaaggggtcctaatttccacctagtcctaccaggaacggacaaaccggaccaaaggacgtcctaccaacgttcgttccgtactggaaacctaaatacggaaacnccggtaccctagggaagacgggtaccgaacgggtaccaacggtcgttagttacgttacttcgttacggtacggaccgaagtacccgttaccggtaacgggggtttacccggggttttaaccaaaccggtaccggggtaattccggggtaaccgttccggggg

SEQ ID NO: 85434 - DNA, 534 bp, Homo sapiens
  misc_feature: GYAE6OF02IWHN9.43.22.B11.1.454.CMB.1.raw
  modified_base (425)..(425): a, c, t, g, unknown or other
  misc_feature (425)..(425): n is a, c, g, or t
  modified_base (490)..(490): a, c, t, g, unknown or other
  misc_feature (490)..(490): n is a, c, g, or t
tcagtgtgagtagtcacgaccggtgctcgatttagacgacagctcaggggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggagcctgggtccagcctggggggtccctgagactctcctgtgcagcctctggactcacctttagtagttattggatgaccgtgggtccgccaggctccgagggaaggggctggaggtgggtggccaacgataaaccgaagatggaagtgaagaaatactatagtggactcgtgtagaagggccgattcacctatctccagagacaacgccaaganctacactgtctactgacaaatcgaacagacctgagagtcgagacgacggctgtgtattacgtggngcgagactccgaaggttccgttatacgtacggatcggactcggg

SEQ ID NO: 85435 - DNA, 558 bp, Homo sapiens
  misc_feature: GYAE6OF02FNN6O.43.22.B11.1.454.CMB.1.raw
  modified_base (455)..(455): a, c, t, g, unknown or other
  misc_feature (455)..(455): n is a, c, g, or t
tcagtgtgagtagtcacgaccggtgctcgatttagacgacagctcagggggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcctgggtccagccgtggggggtccctgagactctcctgtgcagcctctggactcacctttagtagttattggatgaccgtgggtccgccaggctccgaggggaaggggctgggaggtggggtggccaacataaaccaagataggaagtgaagaaatactatgtgactgtgtagaagggccgattcaccatcctccagacaccaacgccaagcgctacacttgtctctgacaaatcgaacngcctgagagtcgacggacacgggctgtagttattacgtggtgcgagacttaccggaacgggttcccgggtttaactacggtaacggtaagtcgggacgtcggg

SEQ ID NO: 85436 - DNA, 790 bp, Homo sapiens
  misc_feature: GYAE6OF02IN4UL.43.22.B11.1.454.CMB.1.raw
tcagtgtgagtagtcacgaccggtgctcgatttagacgacagctcagggggggtctcagagaggagccttagccctggactccaaggcctttccacttggtgatcagcactgagcacagaggactcaccatggaattggggctgagcttgggttttccttgttgctattttagaaggtgtccagtgtgaggtgcagctggtggagtcgtgggggagccgtgggtccaggccgtggggggtccctggacgactctcctgtgcagcctctggacctctacctttagtagttattggatcgaccgtgggtcccgccgaggcctaccggagggggaacggggcgtgggagggtggggtacggacccaaacgaactaaaaccgaaggtagtagggaaacggtaggaaagtaaaattaacgtaagttacggtacggtacgttcgttagggtagggaaacggggtcccgtaacgtttacccaaccgtaagttcccgtaacccgaaagggtaaaccgaaacccgtaaaacccggacccgaaaaagggtaccgtacccgttaccgaaacgttttccggttacccttaccgtaacggtaaacctaaaaacgttaccggaaaacctccgggtacccttaagggaaacgtaacgggtacccgggaacgggtaacccgacgggtacttacgggttagttactttacggtgggtacgacggtaagtaaccgtttcccgggtaaaggggttttcccggtttaaacgaccggttaacgggtaaggttccgggtaccggttacgggg

SEQ ID NO: 85437 - DNA, 528 bp, Homo sapiens
  misc_feature: GYAE6OF02FXV18.43.22.B11.1.454.CMB.1.raw
  modified_base (373)..(373): a, c, t, g, unknown or other
  misc_feature (373)..(373): n is a, c, g, or t
  modified_base (439)..(439): a, c, t, g, unknown or other
  misc_feature (439)..(439): n is a, c, g, or t
  modified_base (456)..(456): a, c, t, g, unknown or other
  misc_feature (456)..(456): n is a, c, g, or t
  modified_base (460)..(460): a, c, t, g, unknown or other
  misc_feature (460)..(460): n is a, c, g, or t
tcagtgtgagtagtcacgaccggtgctcgatttagacgacagctcaggggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggagcctgggtccagcctggggggtccctgagactctcctgtgcagcctctggactcacctttagtagttattggatgacctgggtccgccaggctccagggaaggggctggagtgggtggccaacataaaccaagatggaagtgagaaatactatgtggactntgtgaagggccgattcaccatctccagagacaacgccaagacgctcactgtctctgcaaatgaacngcctgagagtcgagacncggntgtgtattcgtgtgcgtagacttccgaagggttccgggtttaactacggtacggaatgggacgtcggg

SEQ ID NO: 85438 - DNA, 710 bp, Homo sapiens
  misc_feature: GYAE6OF02IBX3M.43.22.B11.1.454.CMB.1.raw
tcagtgtgagtagtcacgaccggtgctcgatttagacgacagctcaggggggtctcagagaggagccttagccctggactccaaggcctttccacttggtgatcagcactgagcacagaggactcaccatggattgggctgagctggttttccttgttgctattttagaaggtgtccagtgtgaggtgcagctggtggagtcgtgggggagcctgggtccagccgtggggggtccctgagacctctcctgtcgcacgcctcgtggactctaccttttagtagttagttggatgaccgttgggtccgccgaggctaccggagggggaacgggcgtgggaggtggggtcggaccgaaacgaacgtaaaaccgaaggaacgtagggaaagtagaaagtaaaagtaactaagtggtaggaacgttcgtagtacgggaacggggcccgtaatttccgaaccctaattcccgttacccaaagggtaaccgaaacccaaacggaccccgaaaaggaccgccgttacaaccgtttcgttaccttcgtacggaacctaaaaagtacggaaaaccgtcggacccttagaacggtacgggtacggaagggaccctacgggctttaggtgtaacgtttcgtgggtgaccggtaagcccgtttaacccggaagggtttcccggtttaactaacggtaacggtaagttcgggaacgttccgggg

SEQ ID NO: 85439 - DNA, 679 bp, Homo sapiens
  misc_feature: GYAE6OF02JXKI6.43.22.B11.1.454.CMB.1.raw
  modified_base (563)..(563): a, c, t, g, unknown or other
  misc_feature (563)..(563): n is a, c, g, or t
  modified_base (618)..(618): a, c, t, g, unknown or other
  misc_feature (618)..(618): n is a, c, g, or t
tcagtgtgagtagtcacgaccggtgctcgatttagacgacagctcagggggtcgtcagagaggagccttagccctggactccaaggcctttccacttggtgatcagcactgagcacagaggactcaccatggaattgggctgagctgggttttccttgttgctattttagaaggtgtccagtgtgaggtgcagctggtggagtcgtgggggagccgtgggtccagccgtggggggtcccctggacgactctcctgtgcagcctctggacctctaccctttagtacgttattggatggacctgggtcccgacccgaggtcctccgaggggaaggggcctggggaggttggggtggccctaaacgactaaaacccgaaggtacgtagggtaagtggaacggaaattacctaaagtcggtaggaaccgttcgttaggttaggaaacggggtccgaatttcccgaaccgattcccgtacccaggtaacggaacccaacggtacccaagggagccctactaaccgtcgtacctcgtaccgacctaaagtgaaaccgtgtcccgtaagngtaagtacgaacggactacgggcttaggtcgttacgttagttcggtggacccganaacgttcccgaagggttttcccgggtaactaccggaacggtagtcggggtaacccttgggg

SEQ ID NO: 85440 - DNA, 674 bp, Homo sapiens
  misc_feature: GYAE6OF02J2B3Y.43.22.B11.1.454.CMB.1.raw
  modified_base (268)..(268): a, c, t, g, unknown or other
  misc_feature (268)..(268): n is a, c, g, or t
  modified_base (562)..(562): a, c, t, g, unknown or other
  misc_feature (562)..(562): n is a, c, g, or t
  modified_base (595)..(595): a, c, t, g, unknown or other
  misc_feature (595)..(595): n is a, c, g, or t
tcagtgtgagtagtcacgaccggtgctcgatttagacgacagctcaggggggtctcagagaggagccttagccctggactccaaggcctttccacttggtgatcagcactgagcacagaggactcaccatggaattggggctgagctgggtttccttgttgctattttagaaggtgtccagtgtgaggtgcagctggtggagtcgtggggggagccgtgggtccaggccgtgggggggtccctggagactcctcctgtgcagcctcgnggactctaccgtttagtacgttattggattcgaccgtgggtcccgcacggctccggaggggaacgggctgggaggtggggtcgaccaacgtaacgtaaaaccgaagagtagggaaggtacgaaaggaaactacgttaagtggtaggtaacctgttagggtagggaaacgggtcccggtaattttcccgaacccgtaattacccgttacccgaaaggaaccgtaaccgaaaccggaccctaaaggacgaccctaccgtaccgtcgttacctacttagaaccgtaaatcggaaacncgtaccgtgacgacggtacgacgtaccgacggntaggtattagttacgtcggagtcgatacgtaccggtaaggtaccggtttacaacggtacggtaacgtgggtacctcggg

SEQ ID NO: 85441 - DNA, 778 bp, Homo sapiens
  misc_feature: GYAE6OF02H1RGT.43.22.B11.1.454.CMB.1.raw
tcagtgtgagtagtcacgaccggtgctcgatttagacgacagctcaggggggtctcagagaggagccttagccctggactccaaggcctttccacttggtgatcagcactgagcacagaggactcaccatggaattgggctgagctggttttctgttgctatttagagtgtcagtgtgaggtgcagctggtggagtcgtgggggagccgtgggtccaggccggtgggggtccctggacgactctcctgtgcagcctcgtggacctctaccgtttagtacgttattggatcggtacccgttgggtcccgaccgacggtccgtaccggaagggggtaacgggggtccttggggacggttcgggggtacggacccgtaaaacgtaaacgtaaaaacccgaaggtaagtaacggggaaaggtacggaaacgtaaaattaaccgttagtaggtacggtaaccttcgttaggtaacgggaaacgggtccgtaagtttacccgaacctaacgtttcccgtaaccgaaacggaaccgaaacccggtaaaccggaaccgaaaagggaccgtccttaccgtaaactttcggtaccctttcggaacgtaactaaaagtaccggaaactacggaccgttaaggaaccgggttacggtaacggaacgggtacccggtaacggtcgtttacggttaagttacgtttaacgtgggtacggacgtacgtacgttaccgtaacggggtttaccgtttaacaacccggtaagggtacgttcggaccggttacgggg

SEQ ID NO: 85442 - DNA, 308 bp, Homo sapiens
  misc_feature: GYAE6OF02IF7FM.43.22.B11.1.454.CMB.1.raw
  modified_base (282)..(282): a, c, t, g, unknown or other
  misc_feature (282)..(282): n is a, c, g, or t
  modified_base (287)..(308): a, c, t, g, unknown or other
  misc_feature (287)..(308): n is a, c, g, or t
tcagtgtgagtagtcacgaccggtgctcgatttagacgacagctcagggattcctgaccgattctctggctccaagtctggcacgtcagccacctgggcatcaccggactccagactggggacgaggccgattattactgcggaacatgggacagcagcctgaatacttgggtgttcggcggagggaccaggctgaccgtccgtaagtcagcccaaggctgccccctggtcactctcgttcccaccctcctcactactcacactgagcggctggcaaggccnatagnnnnnnnnnnnnnnnnnnnnnn

SEQ ID NO: 85443 - DNA, 678 bp, Homo sapiens
  misc_feature: GYAE6OF02G9YCG.43.22.B11.1.454.CMB.1.raw
tcagtgtgagtagtcacgaccggtgctcgatttagacgacagctcaggggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggagcctggggtccagccgtggggggtccctggagactctcctgtgcagcctctggactcacctttagtagttattggatgacctgggtcccgccaggcctccgagggaaggggctggaggtggggtggaccaacataaaaccaagagtaggaagtgaagaaatactatgtcggactcgtgtaggaagggccgatttccgacctatcctaccaaggacgaccaaacggtccaaaggcgcctacacttgttacctctgactaaaatcggaaacacggtaccctaggaacggtaacggtccggaaacgggaccgaaccgggtcgttggtaacgtttaacgtttaccggttagggtcgaaccgggttaaggtaacccgtttacccggttaaacggggggttttcccccgggtttttaaactaaaccgggttaaaccggggtaagttaccggggaacccggtttacccggggg

SEQ ID NO: 85444 - DNA, 298 bp, Homo sapiens
  misc_feature: GYAE6OF02I3ZUV.43.22.B11.1.454.CMB.1.raw
  modified_base (286)..(298): a, c, t, g, unknown or other
  misc_feature (286)..(298): n is a, c, g, or t
tcagtgtgagtagtcacgaccggtgctcgatttagacgacagctcagggattcctgaccgattctctggctccaagtctggcacgtcagccaccctgggcatcaccggactccagactggggacgaggccgattattactgcggaacatgggacagcagcctgaatacttgggtgttcggcggagggaccaggctgaccgtcctaagtcagcccaaggctgcccctggtcactctcgttcccgccctcctcactactcacactgagcggctggcaaggcgcatagnnnnnnnnnnnnn

SEQ ID NO: 85445 - DNA, 659 bp, Homo sapiens
  misc_feature: GYAE6OF02GXL0N.43.22.B11.1.454.CMB.1.raw
  modified_base (348)..(348): a, c, t, g, unknown or other
  misc_feature (348)..(348): n is a, c, g, or t
tcagtgtgagtagtcacgaccggtgctcgatttagacgacagctcagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtggggggagccgtggggtccagccgtggggggtccctggagactctcctgtgcagcctcgtggactctacctttagtagttattggatcgaccgtgggtcccgcaggctccgaggggaagggctggagtgggtcggaccaaanactaaaaccgaagtacgtaggaagtgaagtaaatactagtgtaggactcgtagtaggaacgggccgtaatttccaacccgtatacctccgaagaacgtacaaccgaccaaggacgcctacgacttcgtactctagaactaaagtcgaaacagtcccgtaggaacgtacggtaaccggacgggaaccaccgggtacgttggtaacgtttatttaaccgtgggtacgaccggtaagtaaccgttaccggttaaacgggttccgggtttttaacaacgggttacgggaaacgtttcggggaccgttaccggggg

SEQ ID NO: 85446 - DNA, 645 bp, Homo sapiens
  misc_feature: GYAE6OF02ITKBW.43.22.B11.1.454.CMB.1.raw
  modified_base (261)..(261): a, c, t, g, unknown or other
  misc_feature (261)..(261): n is a, c, g, or t
  modified_base (302)..(302): a, c, t, g, unknown or other
  misc_feature (302)..(302): n is a, c, g, or t
tcagtgtgagtagtcacgaccggtgctcgatttagacgacagctcaggggggtctcagagaggagccttagccctggactccaaggcctttccacttggtgatcagcactgagcacagaggactcaccatggaattgggctgagctgggttttcctgttgctatttagaaggtgtccagtgtgaggtgcagctggtggagtcgtgggggagccgtgggtccaggccgtggggggtccctggacgctctcctgtgcagcctntggactctacctttagtagttattggatgaccgtgggtccncgaggcctcgagggagggctaggaggtgggtgaccaacgagtaaaccgagagtaggaagtgaagaaatcgtatggtacgactcgtagtaggaacgggtccgtatttaccgaacctagttccgtaaccgaaggtaacgaaccgtaaccgccgaaaagccgaactccaacgttgtaccttacgtacgaactaaagtcgaaacctacggcccttaaggaacgacgggtaccgaacggtaaccacgggtcttaggttagtacttacggtcgaggtaccggaagtacctaccgggttaagggttacccggtttaagaacgtacgggaagtttcgggacgttaccgggg

SEQ ID NO: 85447 - DNA, 729 bp, Homo sapiens
  misc_feature: GYAE6OF02IYVF2.43.22.B11.1.454.CMB.1.raw
  modified_base (260)..(260): a, c, t, g, unknown or other
  misc_feature (260)..(260): n is a, c, g, or t
  modified_base (359)..(359): a, c, t, g, unknown or other
  misc_feature (359)..(359): n is a, c, g, or t
tcagtgtgagtagtcacgaccggtgctcgatttagacgacagctcaggggggtctcagagaggagccttagccctggactccaaggcctttccacttggtgatcagtactgagcacagaggactcaccatggaattggggctgagctgggttttccttgttgcttattttagaaggtgtccagtgtgaggtgcagctggtggagtcgtgggggagccgtgggtccaggccgttcggggggtccctggacgactctcctgngcacgcctctggactcctaccttttagtagttattggatcgacctgggcccgccaggcctaccgaggggacggggcgtgggaggtgggtcggaccaaanaactaaaccgaagaagtagggaagtagaaagaaattacgtataggtaggacttcgtagtaggaacgggccgtaattccgactacgtccgtacgaaggacgaaccgaacccgacgaaagtacgaactccgtaacttggtacccttcgtacgtaaccgtaaaacttacggaaaccgacgtcccgttaagggaaccgtcgggtaaccggaacgaaccggtaacggtcgttacggttaagtttacgtttaccgttggtaccgggtacgtaacgttaacggtaccccgggtttaaacgggttttacccgggtttaaaccttacggggttaaccggtaagggttcccgggtaccgggttacggggtaaccgggggg

SEQ ID NO: 85448 - DNA, 665 bp, Homo sapiens
  misc_feature: GYAE6OF02G284H.43.22.B11.1.454.CMB.1.raw
  modified_base (358)..(358): a, c, t, g, unknown or other
  misc_feature (358)..(358): n is a, c, g, or t
  modified_base (538)..(538): a, c, t, g, unknown or other
  misc_feature (538)..(538): n is a, c, g, or t
  modified_base (546)..(546): a, c, t, g, unknown or other
  misc_feature (546)..(546): n is a, c, g, or t
tcagtgtgagtagtcacgaccggtgctcgatttagacgacagctcaggggggtctcagagaggagccttagccctggactccaaggcctttccacttggtgatcagcactgagcacagaggactcaccatggaattggggctgagctgggttttccttgttgctattttagaggtgtccagtgtgaggtgcagctggtggagtcgtgggggagccgtgggtccagccgtgggggggtccctggagactctcctgtgcagcctctggactctaccttttagtagttattggatcggacctggggtcccgccgaggcctccggaggggaacggggcgtagggaggtggggtcggaccaanaacgtaaaaccgaaggacgtagggaaagtggaaagaaaacttaacgtaagttggtacggtacttacgttaggtacgggtaaacggggccgtaactttaccgaacctatcccgtacgaaagaacgaaccaaccgaccgaaaggcgactcaacgttcgtactctagaacctaaatcgaaccnggtacccnggagacggtacgacgggaacctacgggtatgtaacgttatacggtggtacggacgagtaacctaccggtaaggttcccgggtttaactacggtaacgggtagttcgggaccgttcgggg

SEQ ID NO: 85449 - DNA, 1018 bp, Homo sapiens
  misc_feature: GYAE6OF02H1LUQ.43.22.B11.1.454.CMB.1.raw
tcagtgtgagtagtcacgaccggtgctcgatttagacgacagctcagggggtctcagagaggagccttagccctggactccaaggcctttccacttggtgatcagcactgagcacagaggactcacatggaattgggctgagctgggttttcctgttgcttattttagaaggtgtccagtgtgaggtgcagcgtggtggagtcgtgggggagtccgtgggtcctaggccggtggggggtccctggacggtacctccgtccgtaggtcgacgagtccctccgttcgggaccttccgtaaccgttttaggtacgtttacgttggtacttggtaccgttcggggtcccgacccggtaggtccgttaccgggaagggggtaacgggggtcctacgggggtaggttcgggggttacggaccccgaaaagtaacgttaaaaaccccgaaggtaacgtacggggtaaacgttacggaaacgttaaaaattaccggttaagtttacgggtagggttaaaccttccgggttaggggttaacggggaaccgggggttacccgtaaacgtttttacccgaaacccgttaacgttaccccttaacccgggtaaacgggtaacccggtaaaacccgtaaccccgggaacccttaaaaaacggggtacccgttacccgtttaaccgtaaacccggtttccggttttaacccgttccggttaaccggttaaaccgtaaaacggtaccggtaaaaccgaaacccgggttccgtaaacggggaaacgggttaaccgggttacccgggtaaaaggggtaccccgtaaacccgggggttctttaacgggggtttaaccgttttaccgggtttaaacccgttcggggttaacgggtaacccgggttaaaggttaaccccggttaacccgggtttaaaccggggggtttttccccccggggtttttaaaacgtaaaccccggggtttaaccggggtttaaaccggtttacggggacccccgggttttaacccggggggg

SEQ ID NO: 85450 - DNA, 779 bp, Homo sapiens
  misc_feature: GYAE6OF02JCRNK.43.22.B11.1.454.CMB.1.raw
  modified_base (261)..(261): a, c, t, g, unknown or other
  misc_feature (261)..(261): n is a, c, g, or t
  modified_base (280)..(280): a, c, t, g, unknown or other
  misc_feature (280)..(280): n is a, c, g, or t
  modified_base (640)..(640): a, c, t, g, unknown or other
  misc_feature (640)..(640): n is a, c, g, or t
tcagtgtgagtagtcacgaccggtgctcgatttagacgacagctcaggggggtctcagagaggagccttagccctggactccaaggcctttccacttggtgatcagcactgagcacagaggactcaccatggaattggggctgagctgggttttcctgttgctattttagaaggtgtccagtgtgaggtgcagctggtggagtcgtgggggagcctgggtccagccgtggggggtccctggagactctcctgtgcagcctntggctcaccttagtagttntggatgaccgtggtccgcgaggctccgagggagggcgtggagtggggtcgaccaacaacgtaaaaccaaggtataggggaaagttacggaagtaaaagtaccgtaagttaggtagggtaaccttcggtaggttaggaaacggggtccgtaactttaccgaaccgtaacgttcccttaacccgaaggaaacgtaacccgaaaacccggacccgaaaagggtaacccggtcccttaaccgaccgtttacgggttacccttaccggttacgaaacgtttaaaacgtcggtaaaaccacgggttacccctaagggtaaacggtaaccgggttccgggaaaacgggacccgtaaacccggggttnttagggtttaaccgttagttaccgttagggtaccggtaacggtaacggtaaccgttacccggggttaaaccgggttttaccccgggtttaagtaacccggttaaaggggtaacgttaccggggttaccgggttacgggg

SEQ ID NO: 85451 - DNA, 778 bp, Homo sapiens
  misc_feature: GYAE6OF02I9GRE.43.22.B11.1.454.CMB.1.raw
  modified_base (529)..(529): a, c, t, g, unknown or other
  misc_feature (529)..(529): n is a, c, g, or t
tcagtgtgagtagtcacgaccggtgctcgatttagacgacagctcaggggggtcgtcagagaggagccttagccctggactccaaggcctttccacttggtgatcagcactgagcacagaggactcaccatggaattgggctgagcttgggttttccttgttgcttattttagaaggtgtccagtgtgaggtgcagctggtggagtcgtgggggagccgtgggtccaggccgtcggggggtcccctggacgtaccttcgtccgtggtcgcacggcccttcgtggacctccgtaaccttttaggtagtttagttggtaacttcggtaccgttggggttccccgacgtacgggtcctacccggaagggggaacggggtctggggtacggttcgggggtcggtacccgaaacgtaactaaaaaccgaaggtaacgtagggaaagtaggaaaacgtaaaacgtaccttaaagttggtacggtaaccttcggtaacggttaggggaaacgggtcccgtaatttccaaacccgtnttacccgtaccggaaggtaaacgaccgaaaccggtccaaaacggggtctacctaaccgtaccgttcggttacttaccgtacgggtaaacaaaacggttaccggaaactacgtccgttaacggagttaaccggggtcaaacggggtccaaaccgggtgtagtttacgtaatttcgacggttagcgtaaactcgttaaccgtacgggtttacgttaaacctcgtaaggtaaccgtaggtacccgttacggg

SEQ ID NO: 85452 - DNA, 670 bp, Homo sapiens
  misc_feature: GYAE6OF02HN6LF.43.22.B11.1.454.CMB.1.raw
  modified_base (435)..(435): a, c, t, g, unknown or other
  misc_feature (435)..(435): n is a, c, g, or t
  modified_base (506)..(506): a, c, t, g, unknown or other
  misc_feature (506)..(506): n is a, c, g, or t
tcagtgtgagtagtcacgaccggtgctcgatttagacgacagctcaggggggtctcagagaggagccttagccctggactccaaggcctttccacttggtgatcagcactgagcacagaggactcaccatggaattggggctgagctgggttttccttgttgctattttagaaggtgtccagtgtgaggtgcagctgggtggagtcgtggggggagccgtggggtccaggccgtgggggggtcccctggacgactctcctgtgcagcctcgtggactcaccttttagtagtttagttggatcgaccgtgggtccgccgaggcctaccgaggggaacggggctgggagtggggtcgaccaacgataaaaccaagagtagggaagtggaagtaaatactagtggtagactatggtggaacgggcctaatccgacctntcctacgaagtacgacaaacgctaaaggcgtacctcaagttccgtctcgtacgaactaaacgtacgaaacncggaccttagggaacgtacgggtcggaaacgggacctaacgggtctttcggtagttacgtttacgtaggttcggaaccgtacggtaaccgtacccggtaaaggggtttccccggtttaaacgtaccggttaaccgggtaacgttggggaccccggttacggggg

SEQ ID NO: 85453 - DNA, 730 bp, Homo sapiens
  misc_feature: GYAE6OF02F7WZE.43.22.B11.1.454.CMB.1.raw
tcagtgtgagtagtcacgaccggtgctcgatttagacgacagctcaggggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtggggggagccgtgggtccagccgtggggggtcccctgagactctcctgtgcagcctctggactcacctttagtagttatggatgacctgggtccgccgaggctccgaggggaaggggcgtgggaggtggggtcggccaaacaactaaaaccaagtatagggaagtagaagtaaataactagtaggttgactcgtaggtacgggaaggggccgtaatttccgaaccctattccctacccgaagtaacggaacccaaacgacccgaaaggcgacctactaccgtgttaccctctacgaactaaaatcggaaacctcgaaccgttaggaagggtaaccggtacggaacgggtaaaccgtacgggtacgtttacggtaggtttaaccgtttacgttacgggttcggaaccgggttaaacggttaacgggtttaaccccgtaaaacggggggtttttccccgggttttaaaaccttaaccgggtttaaacggggtaaacggtttccggggtaaccggtttccgggggg

SEQ ID NO: 85454 - DNA, 761 bp, Homo sapiens
  misc_feature: GYAE6OF02GOBH8.43.22.B11.1.454.CMB.1.raw
  modified_base (540)..(540): a, c, t, g, unknown or other
  misc_feature (540)..(540): n is a, c, g, or t
tcagtgtgagtagtcacgaccggtgctcgatttagacgacagctcaggggggtctcagagaggagccttagccctggactccaaggcctttccacttggtgatcagcactgagcacagaggactcaccatggaattggggctgagcttgggttttccttgttgctattttagaaggtgtccagtgtgaggtgcagctggtggagtcgtgggggagccgtgggtccagccggtgggggtccctgagctctcgtgtcgcacgcctcgtcggacttcctaccgttttagtagtttagtggtatcgtaccgtcgggtcccgcgacggcctaccggaggggacgggcgtgggaggttcggggacggtacccaaacgaacgtaaaaccgaaggtagtagggaaagtacgaaagtaaactacgtagtacggtggtacttgtaggtaggaacggggacccttagttaccgacctacgtccctaaccgagaaacgaacccgaaccggaaccaaagcgtaccctaccgtaacgttcgtaccttacggtanaaacctaaacgtacgaaacgtccgtaccgtagggaaacggttacggtaacgggaaccgtaccggaaaccggttcgttacggtaacgttttacgttaccggtggtccgggaaacgtaaccggtaccggtttaaccccggttaaccgggggtttttacccggtttaaaccgtaccggggtttaaaccgggtaacggttacggggtaacccggtaccggggggg

SEQ ID NO: 85455 - DNA, 580 bp, Homo sapiens
  misc_feature: GYAE6OF02F11TR.43.22.B11.1.454.CMB.1.raw
  modified_base (320)..(320): a, c, t, g, unknown or other
  misc_feature (320)..(320): n is a, c, g, or t
  modified_base (329)..(329): a, c, t, g, unknown or other
  misc_feature (329)..(329): n is a, c, g, or t
  modified_base (334)..(334): a, c, t, g, unknown or other
  misc_feature (334)..(334): n is a, c, g, or t
  modified_base (421)..(421): a, c, t, g, unknown or other
  misc_feature (421)..(421): n is a, c, g, or t
  modified_base (482)..(482): a, c, t, g, unknown or other
  misc_feature (482)..(482): n is a, c, g, or t
tcagtgtgagtagtcacgaccggtgctcgatttagacgacagctcaggggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcctgggtccagccgtggggggtccctggagactctcctgtgcagcctctggactcacctttagtagttattggatgacctggtccgccaggctccgagggagggcnggagtgggngcaanataaaccagatggaatgaagaaatactatgtggactcgtgtagaagggccgtattcacctatcctccagacgacaaacgccaaagcnctacacttgtcctcgtcgacaaagtcgaaacacgcctaggacgagtcggaagaccacgggntaggttacttagttactggttcgacggtaacgtacttacccggtaaagggtttcccggttaacttaacggtaacggtagttcgggaacccgttcgggg

SEQ ID NO: 85456 - DNA, 679 bp, Homo sapiens
  misc_feature: GYAE6OF02F0ZGD.43.22.B11.1.454.CMB.1.raw
  modified_base (215)..(215): a, c, t, g, unknown or other
  misc_feature (215)..(215): n is a, c, g, or t
tcagtgtgagtagtcacgaccggtgctcgatttagacgacagctcaggggggtctcagagaggagccttagccctggactccaaggcctttccacttggtgatcagcactgagcacagaggactcaccatggaattggggctgagcggtggtttcgtgtagcgtatttagaggtgtccagtgtgaggtgcagtctggtaggagttcgtggggganccgtgggtccaggtcccgtggggggtccctggagacgttcctccgtgtgctacgtccgtctggacttctaaccgtttagttacgttattcggatcggtaccttggggtccaccgagccgtcgaacggggtagggcgtggaggtgggtcgacccgaagaactaaacgagaacgtggaaagtgaaagtaaatacgtatcgtagcctagtgtacggaagggtctaatcccgaaccgtatccgtaaccaggtacgaaccgtaacgacgtaaagacgttccgactaacgttcgtaccgttacgacgaactaacgtaggaaacctcgaccgttgaaacgtacggtaccggaacggtaacgtacggccgttagacgtttactggttacgtgtaccggagtaaccgttacgtaacgggtttcccggtttactaagggtaaccggtacggttaccgggtacgttaaccggggg

SEQ ID NO: 85457 - DNA, 802 bp, Homo sapiens
  misc_feature: GYAE6OF02FTXM0.43.22.B11.1.454.CMB.1.raw
  modified_base (214)..(214): a, c, t, g, unknown or other
  misc_feature (214)..(214): n is a, c, g, or t
tcagtgtgagtagtcacgaccggtgctcgatttagacgacagctcaggggggtctaagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtggggganccgtgggtccagccgtcggggggtcccctggacgactctcctggtgcacgtcctcgtggacctctacctttagtagttattggatcggaccgtcgggtcccgaccgaggccgtaccggaaggggaacggggcgtaggggaggttcggggtcggacccaaacaacgttaaaaccgaaaggtagtacgggaaagtaggaaacgaaaagtacgtagtaggtacggtacttcgtaggtacgggaacgggtaccgtacgttaccaacccgtacttccgtaaccgaaggaacgaacccgtaaaccggacccgtaaagaccggtacccttacgtaaccgttcggttccctaccgtttacggaaaccctaaaacgtttaccggaaaactacccggccgtaaacgggtaacggtaaccgggttaaccgggaacggtaacccgggaacccggttacgtttacgggttaacgtttaacgtttaacggtggttaaccgggtacgtaacggtaaccgttaacccggtaaacgggttttacccggtttaaaccgtacggttaaaccggtacggttacgggtacccgttgggtaacccggggg

SEQ ID NO: 85458 - DNA, 1019 bp, Homo sapiens
  misc_feature: GYAE6OF02I7O55.43.22.B11.1.454.CMB.1.raw
  modified_base (216)..(216): a, c, t, g, unknown or other
  misc_feature (216)..(216): n is a, c, g, or t
tcagtgtgagtagtcacgaccggtgctcgatttagacgacagctcaggggggtctcagagaggagccttagccctggactccaaggcctttccacttggtgatcagcactgagcacagaggactcaccatggaattggggctgagctgggttttccttgttgcttattttagaggtgtcagtgtgaggtgcagcgtggtggagtcggtgggggacnccgtgggtcaggtccgggtcgggggtaccctggacgtacctctccgttggtcgcgacgccttcgtcggaccttccgtaaccgttttaaggtacgtttagtaggtacgttacgacccggttcggggttacccgacccgtaacgggtccgtaaccgggaagggggtaaaccggggtccgtacgggggtaacgggttccgggggtaccggaaacccgtaaaacgtaaaaccgttaaaaaacccggtaaggtaaacgggttaaggtaaaagggttaacggggtaaaaattaaaaaccgttaacggtttaaggttaacgggttaaccgggaaacctttaacggtacggggttaaacggggaaccgggggttacccttaaacgttaacccggtaaaccttacggttacccgttaaccgaaacggaaccggaaacccgtaaaccgaaccgaaagtacccggtactacgtaaccgtttcgtaacgttaccgtacggtaaacgtaaagtacccggtaaacgtaccggtacccggttaagtaaaccggggacggttaaccgggaaaacgggttaaccgggtaaacccggttcgggtttaacggtttaaaccggttttacggttaaccgggtttaccggggttaacgggtacccgggtaaaacgggtttaacccccggttaaaacccggggggttttaacccccgggggttttttaaaacccggggtttaccccgttaaaaacggggttttaaaccccgggggtttaaccgggtttaaaacggggggtttcccccccggggttaaacggggggg

SEQ ID NO: 85459 - DNA, 712 bp, Homo sapiens
  misc_feature: GYAE6OF02GADGO.43.22.B11.1.454.CMB.1.raw
  modified_base (175)..(175): a, c, t, g, unknown or other
  misc_feature (175)..(175): n is a, c, g, or t
  modified_base (212)..(212): a, c, t, g, unknown or other
  misc_feature (212)..(212): n is a, c, g, or t
tcagtgtgagtagtcacgaccggtgctcgatttagacgacagctcaggggggtctcagagaggagccttagccctggactccaaggcctttccacttggtgatcagcactgagcacagaggactcaccatggaattggggctgagcgtggttttcgtgtaggctatttagaggtntccagtgtgaggtgcagctggtggagtcgtggggganccgtgggtccagcccgtcggggggtccctggagctctcctgtgacagtccctctggacctctacctttagtagttagttggatcgtaccgtgggtcccgcgtacggcctaccggaggggtagggcgtaggggaggttcggggacggaacctaaagaactaaaaccgaagtaagtagggaagtaaggtaaagtaaacttagtaagtggttacggacttacgtaggtaagggtaacggggtaccgtactttaccgaaccgtactttccgaaccgaaggaaccgtaacccaaccggacccgtaaagtaccgcttaactacgttcgtctacgttaacgaagtaaacgtacgaacgtaaccgttcgaggtacgtacggacggagaccctggtcttaggttacgttacgttacgtggtcggtacgtacgtaccgttaccgggtaacggttttaccccgggtttaactaacgggttaaccgagggtttaccgggacgttaccggggg

SEQ ID NO: 85460 - DNA, 788 bp, Homo sapiens
  misc_feature: GYAE6OF02JX3KY.43.22.B11.1.454.CMB.1.raw
  modified_base (174)..(174): a, c, t, g, unknown or other
  misc_feature (174)..(174): n is a, c, g, or t
  modified_base (186)..(186): a, c, t, g, unknown or other
  misc_feature (186)..(186): n is a, c, g, or t
tcagtgtgagtagtcacgaccggtgctcgatttagacgacagctcaggggggtctcagagaggagccttagccctggactccaaggcctttccacttggtgatcagcactgagcacagaggactcaccatggaattggggctgagcgtggttttccttgtgctatttagaggtntcagtgtgagtncagcgtggtggaggtcgtggggggacgtccgtggggtccacggtccgggtcgggggggtccctgaacggtaccttccttccgtggttgaccgacggtcccttcggttggacccttaccgtaaccgtttttaaggttagtttacgttgggtaactcgggtaccccgttggggtccccggcgaagggtccctaccgggtaggggaacggggttcgtagggtacgggtggggtacgaccctaaacgtaacgtaaaaccggaaaggtagtaagggtaaacggagtaaaggtaaaatcgttaaggtcggttaaggaccgtttgtaggacggggtaaccgggaccgtactttacccgtaaccgtattaccgacccgaaggtaaccgtaaacccgaaacgaccgtaaaacgggctaccgtaaccgtacgttcgttccgtacgttaacgaaactaaaggtccgaaaacgtccgtaccgtaaggacgtaaggaccggtacgaccgtcgtcgtgttacgtactggtacggtgaacgacggttaaccgttaccgggttaaaccggtttggttaacccgaggtaacggtacggttccgggtaccgttacggggg

SEQ ID NO: 85461 - DNA, 749 bp, Homo sapiens
  misc_feature: GYAE6OF02JJITD.43.22.B11.1.454.CMB.1.raw
  modified_base (210)..(210): a, c, t, g, unknown or other
  misc_feature (210)..(210): n is a, c, g, or t
  modified_base (494)..(494): a, c, t, g, unknown or other
  misc_feature (494)..(494): n is a, c, g, or t
tcagtgtgagtagtcacgaccggtgctcgatttagacgacagctcaggggggtctcagagaggagccttagccctggactccaaggcctttccacttggtgatcagcactgagcacagaggactcaccatggaattggggctgagctgggtttcctgttgctattttagagtgtccagtgtgaggtgcagctggtggagtcgtgggggancgtgggtccagccgtgggggtccctgagctctcctgtgcagcctcgtggacctctacctttagtagttattgggattgaccgtgggtcccgcgaggtcctccgaggggaaggggtcctgggtaggtggggtcggaccaaactacgtaaaaccgaagacgttgggaaagttgaaaggtaaactacgtacgttggtaaggtcctagttaggtacggaaacggggcccttatttaccgacctagttaccctaccgaaggaacggtaccaaaccgggcccaaaaggcncccgttaacgtaaccgtggttacccttcggtacgaactaaaactcggaaactacggcccttaagggagttaaacccgggacgaaacgggtcccgtaaagggtccgttaggttagtttaaaccttcggttcggttaaccgggtacggtaaggtacccgtttaacccgggttaaaccgggggttttaccccgggttttaacaaaccgggtttaaaccggggtaacggtttaccgggtaacgggtttaacccgggggg

SEQ ID NO: 85462 - DNA, 813 bp, Homo sapiens
  misc_feature: GYAE6OF02GZICY.43.22.B11.1.454.CMB.1.raw
  modified_base (684)..(684): a, c, t, g, unknown or other
  misc_feature (684)..(684): n is a, c, g, or t
tcagtgtgagtagtcacgaccggtgctcgatttagacgacagctcagggggggtctcagagaggagccttagccctggactccaaggcctttccacttggtgatcagcactgagcacagaggactcaccatggaatggggctgagctgggttttccttgttgctattttagaggtgtccagtgtgaggtgcagctggtggagtcgtgggggagccgtgggtccagccgtggggggtccctgagactctcctgtgcacgcctctggactctaccgtttagttacgttagttggatcgaccgtcgggtcccgaccgacgggcctaccggaagggggaacgggggtcgtaggggacgggttcgggggtacggtacccgaaaactaaaccgttaaaaacccgaaaggtaacgtagggtaaacggtaggtaaacgtaaaaacttacgttaaagttcggtaacggtaccttacgttacgggtaacgggaaacgggggtaccccttaacgtttaccccgaacctaccgtttacccgtaccgaacggtaaacgaaccccgaaaaccggcctaaaaagggcgttacccctaaccgtacgtttacggtcccttcgtaaccggtaactaaaagtccgaaaaccgtcggacccttagggaacgttaacgggaccggaaacgggaccgtaccgggtnttaacgggttctttacgttacggtggttacggaacccgtaaggtaacccgttacccgggtttaagggtttacccgggttttaacaaccggttaacccgggtaaggttccgggtaccggttaccgggggg

SEQ ID NO: 85463 - DNA, 713 bp, Homo sapiens
  misc_feature: GYAE6OF02GUHU2.43.22.B11.1.454.CMB.1.raw
  modified_base (263)..(263): a, c, t, g, unknown or other
  misc_feature (263)..(263): n is a, c, g, or t
tcagtgtgagtagtcacgaccggtgctcgatttagacgacagctcagggggggtctcagagaggagccttagccctggactccaaggcctttccacttggtgatcagcactgagcacagaggactcaccatggaattggggctgagctgggttttccttgttgcttattttagaaggtgtccagtgtgaggtgcagctggtggagtcgtgggggagcctgggtccagccgtgggggtccctgagactctcctgtgcagtcctntggactctacctttagtagttatggatcgaccgtcgggtcccgcgacggcctaccggaggggaacggggctgggaggtggggtcgaccaacgtaacgtaaaaccaaggagtacgggaaagtaggaaagtaaattactagtaggtggtaactcgttaggtacggaacgggtccgtacttaccacctattcccgaccgtaaaggactaacccgaaacgcctaaaaggcgtcctacgacttcggtccttcggtacaactaaaggacgtaaaccgcgtacccgttagggtaacggacggttaccggaacgggttaaccgcgggtaattcgggttaaacgtttagtttaacggtcggtaaccggagttaaacggaaccctttaaccccggggtaagggttttccccggtttaaataacccgggttaaggtacgttacggggtacccgtacggggg

SEQ ID NO: 85464 - DNA, 772 bp, Homo sapiens
  misc_feature: GYAE6OF02I0B77.43.22.B11.1.454.CMB.1.raw
  modified_base (174)..(174): a, c, t, g, unknown or other
  misc_feature (174)..(174): n is a, c, g, or t
tcagtgtgagtagtcacgaccggtgctcgatttagacgacagctcaggggggtctcagagaggagccttagccctggactccaaggcctttccacttggtgatcagcactgagcacagaggactcaccatggaattggggctgagctgggttttcctgttgctatttagaggtntccagtgtgaggtgcagctgggtggagtcgtgggggagccgtgggtccagccggtgggggtccctgacgactctcctgtgcacgcctcgtggacctctacctttagtagttatggatgaccgtgggtccgcgaggctaccggaggggacgggcgtggaggtggggtacggaccaaactaacgtaaaaccaaggacgtaggaacgtaggaagtaaatactagtggtagtacttcgtaggtacggaacggggtacctacgttacccactacgtacccgtaccaaggtaacaacccgaaacgaccaaaggacgtacctcctaccgttgttcccttactacggtaactaaagtaccgaaacgtaccgtacccgttaaggaacgtaaccggtaccggggaaacggtaaccgtacccgggtagttagggtttaccggttttaacgttacggtacggggtacggttacccgggtaaagttacccgggttttaaaacccggggtacccggggggttttttaaacccccgggttttaaccgtaaaaccggggttaacccgggtttaaacgggttaccgggggttaacccgggtttaacccggggggg

SEQ ID NO: 85465 - DNA, 818 bp, Homo sapiens
  misc_feature: GYAE6OF02JWJRO.43.22.B11.1.454.CMB.1.raw
  modified_base (193)..(193): a, c, t, g, unknown or other
  misc_feature (193)..(193): n is a, c, g, or t
  modified_base (200)..(200): a, c, t, g, unknown or other
  misc_feature (200)..(200): n is a, c, g, or t
  modified_base (231)..(231): a, c, t, g, unknown or other
  misc_feature (231)..(231): n is a, c, g, or t
  modified_base (329)..(329): a, c, t, g, unknown or other
  misc_feature (329)..(329): n is a, c, g, or t
  modified_base (357)..(357): a, c, t, g, unknown or other
  misc_feature (357)..(357): n is a, c, g, or t
tcagtgtgagtagtcacgaccggtgctcgatttagacgacagctcaggggggtctcagagaggagccttagccctggactccaaggcctttccacttggtgatcagcactgagcacagaggactcaccatggaattggggctgagcgttgggttttccttcgttgtcttattttagaaggtgtccagtgtagnggtgacngctggtggagtcgtggggacgcgtcggaccncgtccggtcgggggtcctggacgacctcctcgtgtcgacgctcctcgtacgactccgtacttaggtagttagtggtagtcgaccggtcggcctaccgngccgtacggaagggacggtcggtacggnggtcgggtacgaccgaacgtaaaccgtaaacggagtaggtaacggtagtaacgggtaataaacggttaacgttacggacggttacggtaacgttcgtacgggaaacgggtaccgggtaccttaacgttaacccgtacgtaacgttacccgtacgtaaacgggtaaccgtaaaccccggaaacccggtaaccgtaaaccggacccgttaacccgtacgttacccggttacgttaaccgttaccgtaaccggttaagttaaacgaaccggtaaaccgtacgtaccccgttagaaaccggacgggtaaccggacggaaccgggtacggtagttacgttaaccgttacgttacggtacggtaccggtaacgaccggttaaccggttaacccggttaacgggtttaacccgttaacggttaacccggtaagggttaacccggttacgggttacccgggtacggggg

SEQ ID NO: 85466 - DNA, 1013 bp, Homo sapiens
  misc_feature: GYAE6OF02IZ4PJ.43.22.B11.1.454.CMB.1.raw
tcagtgtgagtagtcacgaccggtgctcgatttagacgacagctcaggggggtctcagagaggagccttagccctggactccaaggcctttccacttggtgatcagcactgagcacagaggactcaccatggaattggggctgagcttgggttttccttgttgctattttagaaggtgtccagtgtgaggtgcagcgtggtggtagtcggtggggggagccgtgggtaccacggccggtcgggggggtccctggacgtacctccgtaccgtgtcgccgacgccttcgtacggtaccttaccgttaaccctttttaaggttaagtttaagtttacggacgttcggtaccgttcggggtccccgccggtaccgggccgttaccgggaaggggggaaccggggtcggtaggggggtaagggttcggggggtaccgggaacccgtaaaaccgtaaacgttaaaaaacccggaaaggtaaggttaagggggtaaaacgttaacgggaaaacgggttaaaaaacttaaccgtttaaaggtttacgggtttaacgggtacccgtttaacgggttaacggggttaacggggtaaacggggggttaccccgtttaaacgtttaacccctaaacccgttaaccgtttaccccgttaccgggaaaaacggggtaaaaccccgggaaccgtaaaaaccccgggtaacccgaaaaacgggttaaacccgggccctttaaacccggtaacgtttacggttttaccccttaaccgggtttacccaaaaccgtaaaaccggttaacggaaaacccgtcgttaaccgggttaggaaagggtacccgggttagggaaacggggaccctacggggttaccttagggtttatttaaacctttcgggtcggacggggttaaccggaaaaggtttaaacccgtaccccggggttttaaaaccgggttttcccggggtttaaacgtttaacccgggaacggggtaacgttttaccgggggacccgttaccgggggg

SEQ ID NO: 85467 - DNA, 744 bp, Homo sapiens
  misc_feature: GYAE6OF02IJ275.43.22.B11.1.454.CMB.1.raw
  modified_base (364)..(364): a, c, t, g, unknown or other
  misc_feature (364)..(364): n is a, c, g, or t
tcagtgtgagtagtcacgaccggtgctcgatttagacgacagctcagggggtctcagagaggagccttagccctggactccaaggccttttccacttggtgatcagcactgagcacagaggactcaccatggaattggggctgagcttgggtttttccttgttgcttatttttagaaggttgtccagtgtgaggtgcagctggtggagtcggtagggggagccgtgggtccaggccggtcggggggtccctggagaccttcgtccgtgtcgcacgccttcgtggtacctactaccgttttagttagtttattgggtatcgtaccgtcgggtcccgcacggcctccggaggggaacgggctgggnggtggggtcgacctaactaacgtaaaaccgaagtagtagggaagtacgaaagtaaacgttactaggtcgggtttagaccgttacgttagggtacggtaacggggtcccggttaatacccgtaaccacgttccctaacggaacgtaacgaaccaaccggaccaaaggtcaccgttcacggttactcgttactcgaaactaaggtacccgaaataccggtccgtagtaacggacggttaaccgacggtaaccggcggtacttaggttacgttattttaccgtgggtaccgtaccggaacgttaaccgttaacccgggtttaacgggtttacccggtttaaacgtacccggttaagggtaacttcggggtaaccgttcggggg

SEQ ID NO: 85468 - DNA, 913 bp, Homo sapiens
  misc_feature: GYAE6OF02HLG0W.43.22.B11.1.454.CMB.1.raw
tcagtgtgagtagtcacgaccggtgctcgatttagacgacagctcaggggggtctcagagaggagccttagccctggactccaaggcctttccacgttggtgatcagcactgagcacagaggactcaccagtggaagttggggctgagcgttgggttttccttgtgcttattttagaggtgtctagtgtgaggtgcgagtacgtgggtggagtcggtgggggacgtccgtacgggtccgacggtccgggttcgggggtacccctggacgtaccgttccttaccgttggtcgtaccgacggtccccgttacgttcgggtacccttaccttacccggttttaagttaacggtttaagtttcgggtaacgttcggtacccggttcgggggttacccgaccccgtaacgggcccgttaccgggaaaggggggacgggggtcggtaacgggggtacggggttacgggggtaccggaacccgtaaacgaaaccgtaaaaccggtaacgggtaaaggtaggggttaaacggaagggtaaaaggtaaacgtttaagtacggttagggtaccgtacgtttacggtcgggtaaacgggacgggtacccgttaacgtaacccaacctttcgtacccgtaaaccgaaagaccgtaaaccggaaacccggtaacgtaaaacgggtctacccgttaactaccggtttccgttcgtaacctaacggtaaacttaaaccggaaacgtaggtacccggtaaccgtaggtaaccgggtaacggtccggaaacgttaccgggaccgtgtttaaccgttagttaccgttaacggtttggaccggtacgaacggtacccgtttaaccgggtaccgggtttaccgttaaacgtaccgggtaaacgggttacggtaccgggttaacggttccgggg

SEQ ID NO: 85469 - DNA, 389 bp, Homo sapiens
  misc_feature: GYAE6OF01C3HIP.51.55.E11.1.454.CMB.1.raw
  modified_base (358)..(358): a, c, t, g, unknown or other
  misc_feature (358)..(358): n is a, c, g, or t
  modified_base (382)..(389): a, c, t, g, unknown or other
  misc_feature (382)..(389): n is a, c, g, or t
tcagcgatcgtatacacgaccggtgctcgatttagcactcgcacgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaaccgggacaaccgtcgcccggcaacatacgccttctccgtcccccttcgcagtaacaccaagtacagaatattaacctgttcccatcgactacgccttcggcctcgcttaggggtcactcaccctgcccgattaacgtggacaggaacccttggtcttccggngagcgggctggcaaggcgcatagnnnnnnnn

SEQ ID NO: 85470 - DNA, 434 bp, Homo sapiens
  misc_feature: GYAE6OF01BAI59.51.55.E11.1.454.CMB.1.raw
  modified_base (187)..(187): a, c, t, g, unknown or other
  misc_feature (187)..(187): n is a, c, g, or t
  modified_base (416)..(434): a, c, t, g, unknown or other
  misc_feature (416)..(434): n is a, c, g, or t
tcagcgatcgtatacacgaccggtgctcgatttagcactcgcacgttgggtttggggtacgatttgatgttacctgatgcttagaggtcttttcctggaagcagggcatttgttgcttcagcaccgtagtgcctcgtcatcacgcctcagtccttgtattttccggattttcgcctaggaaaaaccngcctacacgaccttaaaccgggaccaaccgtccgcccggaccaaacatacgcccttcctccccgtccccccttgcagtaacaccaagtacaggaatacttaacctgtttcccatcgactacgtcctttcggcctcgtccgttaggggtcactccaccctcgccccgtaattaacgtgacacggtaccttggtccttccggcgaggcgggctggaccaaggcacagtagnnnnnnnnnnnnnnnnnnn

SEQ ID NO: 85471 - DNA, 660 bp, Homo sapiens
  misc_feature: GYAE6OF01EO8EO.51.55.E11.1.454.CMB.1.raw
  modified_base (94)..(94): a, c, t, g, unknown or other
  misc_feature (94)..(94): n is a, c, g, or t
  modified_base (191)..(191): a, c, t, g, unknown or other
  misc_feature (191)..(191): n is a, c, g, or t
  modified_base (543)..(543): a, c, t, g, unknown or other
  misc_feature (543)..(543): n is a, c, g, or t
  modified_base (562)..(562): a, c, t, g, unknown or other
  misc_feature (562)..(562): n is a, c, g, or t
  modified_base (573)..(573): a, c, t, g, unknown or other
  misc_feature (573)..(573): n is a, c, g, or t
  modified_base (581)..(582): a, c, t, g, unknown or other
  misc_feature (581)..(582): n is a, c, g, or t
  modified_base (584)..(584): a, c, t, g, unknown or other
  misc_feature (584)..(584): n is a, c, g, or t
  modified_base (586)..(586): a, c, t, g, unknown or other
  misc_feature (586)..(586): n is a, c, g, or t
  modified_base (595)..(595): a, c, t, g, unknown or other
  misc_feature (595)..(595): n is a, c, g, or t
  modified_base (597)..(598): a, c, t, g, unknown or other
  misc_feature (597)..(598): n is a, c, g, or t
  modified_base (600)..(601): a, c, t, g, unknown or other
  misc_feature (600)..(601): n is a, c, g, or t
  modified_base (603)..(603): a, c, t, g, unknown or other
  misc_feature (603)..(603): n is a, c, g, or t
  modified_base (611)..(611): a, c, t, g, unknown or other
  misc_feature (611)..(611): n is a, c, g, or t
  modified_base (613)..(613): a, c, t, g, unknown or other
  misc_feature (613)..(613): n is a, c, g, or t
  modified_base (615)..(615): a, c, t, g, unknown or other
  misc_feature (615)..(615): n is a, c, g, or t
  modified_base (617)..(617): a, c, t, g, unknown or other
  misc_feature (617)..(617): n is a, c, g, or t
  modified_base (619)..(619): a, c, t, g, unknown or other
  misc_feature (619)..(619): n is a, c, g, or t
  modified_base (621)..(621): a, c, t, g, unknown or other
  misc_feature (621)..(621): n is a, c, g, or t
  modified_base (623)..(623): a, c, t, g, unknown or other
  misc_feature (623)..(623): n is a, c, g, or t
  modified_base (625)..(625): a, c, t, g, unknown or other
  misc_feature (625)..(625): n is a, c, g, or t
  modified_base (627)..(627): a, c, t, g, unknown or other
  misc_feature (627)..(627): n is a, c, g, or t
  modified_base (629)..(629): a, c, t, g, unknown or other
  misc_feature (629)..(629): n is a, c, g, or t
  modified_base (631)..(631): a, c, t, g, unknown or other
  misc_feature (631)..(631): n is a, c, g, or t
  modified_base (633)..(633): a, c, t, g, unknown or other
  misc_feature (633)..(633): n is a, c, g, or t
  modified_base (635)..(635): a, c, t, g, unknown or other
  misc_feature (635)..(635): n is a, c, g, or t
  modified_base (637)..(637): a, c, t, g, unknown or other
  misc_feature (637)..(637): n is a, c, g, or t
  modified_base (639)..(639): a, c, t, g, unknown or other
  misc_feature (639)..(639): n is a, c, g, or t
  modified_base (643)..(646): a, c, t, g, unknown or other
  misc_feature (643)..(646): n is a, c, g, or t
  modified_base (648)..(649): a, c, t, g, unknown or other
  misc_feature (648)..(649): n is a, c, g, or t
  modified_base (651)..(651): a, c, t, g, unknown or other
  misc_feature (651)..(651): n is a, c, g, or t
  modified_base (653)..(653): a, c, t, g, unknown or other
  misc_feature (653)..(653): n is a, c, g, or t
  modified_base (656)..(656): a, c, t, g, unknown or other
  misc_feature (656)..(656): n is a, c, g, or t
  modified_base (658)..(660): a, c, t, g, unknown or other
  misc_feature (658)..(660): n is a, c, g, or t
tcagcgatcgtatacacgaccggtgctcgatttagcactcgcacgttgggtttggggtacatttgatgttacctgatgcttagaggcttttccnggaagcagggcatttgttgcttcagcaccgtgtcgcctcgtcactcacgcctcagtcctttgtactttttccggattttcgacctacggaaaaaccngccttacaccgtaccttaaaaccgggactaaaccggtcgcccggacaaacgactacgtccctttccgtcccgttcccccttgacctaacgttaaaccaacctaaagtaccaggtaacttaactttaaaccgttcgttttacccaagttccgtaacttaccgtccgttttcggcccttcggtaccgtttacgggggtcctaaccgttccaaccccgttcggtacccccgttaaagtttaaaccgggttcgggaaaccgtaaccggggtaaccccgtttttcgggttaccgtttcccgggggcggtaacggccggggtcttacgggaccgaaacgggtccgaactaagttcgcncacgctcgagcaacgtcgntcgatcgagtncgattccnnancnacacacacncnncnncnctctctcncncncncncncncncncncncncncncncgcnnnncnncncncancnnn

SEQ ID NO: 85472 - DNA, 396 bp, Homo sapiens
  misc_feature: GYAE6OF02FUODY.51.55.E11.1.454.CMB.1.raw
  modified_base (385)..(396): a, c, t, g, unknown or other
  misc_feature (385)..(396): n is a, c, g, or t
tcagcgatcgtatacacgaccggtgctcgatttagcactcgcacgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttgcagtaacaccaagtacaggaatattaacctgtttcccatcgactacgcctttcggcctcgccttaggggtcgactcaccctgccccgattaacgttggacaggacccttggcttccggcgagcggctggcaaggcgcatagnnnnnnnnnnnn

SEQ ID NO: 85473 - DNA, 392 bp, Homo sapiens
  misc_feature: GYAE6OF02I8VXI.51.55.E11.1.454.CMB.1.raw
  modified_base (358)..(358): a, c, t, g, unknown or other
  misc_feature (358)..(358): n is a, c, g, or t
  modified_base (383)..(392): a, c, t, g, unknown or other
  misc_feature (383)..(392): n is a, c, g, or t
tcagcgatcgtatacacgaccggtgctcgatttagcactcgcacgttgggtttgggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaactattaacctgtttcccatcgactacgccttcggcctcgccttagggcactcacctgccccgattaacgttggacaggacccttggtcttccggngacgcgggctggcaaggcgcatagnnnnnnnnnn

SEQ ID NO: 85474 - DNA, 630 bp, Homo sapiens
  misc_feature: GYAE6OF02F6B2J.51.55.E11.1.454.CMB.1.raw
  modified_base (436)..(436): a, c, t, g, unknown or other
  misc_feature (436)..(436): n is a, c, g, or t
  modified_base (453)..(453): a, c, t, g, unknown or other
  misc_feature (453)..(453): n is a, c, g, or t
  modified_base (458)..(458): a, c, t, g, unknown or other
  misc_feature (458)..(458): n is a, c, g, or t
  modified_base (538)..(538): a, c, t, g, unknown or other
  misc_feature (538)..(538): n is a, c, g, or t
  modified_base (543)..(543): a, c, t, g, unknown or other
  misc_feature (543)..(543): n is a, c, g, or t
  modified_base (559)..(559): a, c, t, g, unknown or other
  misc_feature (559)..(559): n is a, c, g, or t
  modified_base (569)..(569): a, c, t, g, unknown or other
  misc_feature (569)..(569): n is a, c, g, or t
  modified_base (573)..(573): a, c, t, g, unknown or other
  misc_feature (573)..(573): n is a, c, g, or t
  modified_base (612)..(612): a, c, t, g, unknown or other
  misc_feature (612)..(612): n is a, c, g, or t
  modified_base (624)..(624): a, c, t, g, unknown or other
  misc_feature (624)..(624): n is a, c, g, or t
tcagcgatcgtatacacgaccggtgctcgatttagcactcgcacgttgggtttggggtacgattgatgttacctgatgcttagaggctttcctcgaagcagggcatttgttgcttcagcaccgtagtgcctcgtcatcacgtcctcagccttgtattttccggatttcgcccgtggaaaaccagccctacaccgtaccgttaaacccgggactaacccggtccgccccgggaccaaccatagtcccttcctcccgtccccccttgccacgtaacacccgaagtacaggaactagttaacctgttcccatcgactacgccttcggcctcgtccgtagggtcgactcaccctcgacccgtacgttaacgtgacgtacgtacccttggtctccggacgacggtcggacgtcggacgaacgggtccgacgtactaggtanccgtgtcgtagcgtacncgtcnggactcgactgcactcgatcaactggccgtcgaacctaggtaccctggcttaaactgggaaccctggttcaacgccgttntaacnccgttaagtcaaccgnggttcgtaancggngtccgtagtgcgtgacgtcacgtcgcgacgttcgcgtanaccgtaggtccncgtacg

SEQ ID NO: 85475 - DNA, 251 bp, Homo sapiens
  misc_feature: GYAE6OF01CI3W5.3.28.C06.1.454.CMB.1.raw
  modified_base (247)..(251): a, c, t, g, unknown or other
  misc_feature (247)..(251): n is a, c, g, or t
tcagagacgcactccacgaccggtgctcgatttagagctcacgtattgggtttggggtttggtggtctccactcccgccttgacgaggctgattattactgcagctcatatacaagcagcagcactggggtcttcggaactgggaccaaggtcaccgtcgtcccacgtcagcccaaggccaacccactgtcactctgttcccgccctcctcgagtgcgtctctgagcgggctggcaaggcgcatagnnnnn

SEQ ID NO: 85476 - DNA, 251 bp, Homo sapiens
  misc_feature: GYAE6OF01DNFBI.3.28.C06.1.454.CMB.1.raw
  modified_base (249)..(251): a, c, t, g, unknown or other
  misc_feature (249)..(251): n is a, c, g, or t
tcagagacgcactccacgaccggtgctcgatttagagctcacgtattgggtttgggggtttggtggtctccactcccgccttgacgaggctgattattactgcagctcatatacaagcagcagcactggggtcttcggaactgggaccaaggtcaccgtcgtcccacgtcagcccaaggccaaccccactgtcactctgttcccgccctcctcgagtgcgtctctgagcgggctggcaaggcgcatagnnn

SEQ ID NO: 85477 - DNA, 517 bp, Homo sapiens
  misc_feature: GYAE6OF01A0NVP.3.28.C06.1.454.CMB.1.raw
  modified_base (430)..(430): a, c, t, g, unknown or other
  misc_feature (430)..(430): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaaagcccccaaactcataatttatgatgtcagtaatcggccctcagggtttctaatcgcttctctggttacaagtctggcaacacggcctccctgaccatctctgggctccaggctgaggacgaggctgattattactgcagctnatatacaagtcagcagcacgtgggtcttcggacgtgggaccaaggtcaccgtcgcccacgtcacgacccaacggcccaacccgtacg

SEQ ID NO: 85478 - DNA, 543 bp, Homo sapiens
  misc_feature: GYAE6OF01BB9D4.3.28.C06.1.454.CMB.1.raw
  modified_base (245)..(245): a, c, t, g, unknown or other
  misc_feature (245)..(245): n is a, c, g, or t
tcagagacgcactccacgaccggtgctcgatttagagctcacgtattgggtttggggggtctcaggaggcagcggctctcgggacgtctccaccatggcctggctctgctattcctcaccctcctcactcagggccacagggtcctgggcccagtctgccctgactcagcctgcctccgtgtctgggtctcctggacagtcgatcgactcgccatctcctgcactggaaccagcagtgacgttgnggttataactatgtctcctaggtatcaacagcacccaggcaaacgcccccaaaactccataatttatgactgtacagtaatcggccctcgaggggtttctaatcgcttctctggttacaagtctggcaacacggcctcctgaccatctctggctccgagctagaggacgaggctgagttacttacgtgactacgctcaagttactacaagtcgagcagcacgtgggtcttcggaacgttgggacctaaggggtccaacggtccgtccacgtcacgacccaaggccccaaaccctaccg

SEQ ID NO: 85479 - DNA, 252 bp, Homo sapiens
  misc_feature: GYAE6OF01CJNFN.3.28.C06.1.454.CMB.1.raw
  modified_base (248)..(252): a, c, t, g, unknown or other
  misc_feature (248)..(252): n is a, c, g, or t
tcagagacgcactccacgaccggtgctcgatttagagctcacgtattgggtttgggggttggtggtctccactcccgccttgacgaggctgattattactgcagctcatatacaagcagcagcactggggtcttcggaactgggaccaaggtcaccgtcgtcccacgtcagcccaaggccaaccccactgtcactctgttcccaccctcctcgagtgcgtctctgagcgggctggcaaggcgcatagnnnnn

SEQ ID NO: 85480 - DNA, 253 bp, Homo sapiens
  misc_feature: GYAE6OF01C7GYG.3.28.C06.1.454.CMB.1.raw
  modified_base (249)..(253): a, c, t, g, unknown or other
  misc_feature (249)..(253): n is a, c, g, or t
tcagagacgcactccacgaccggtgctcgatttagagctcacgtattgggtttgggggtttggtggtctccactcccgccttgacgaggctgattattactgcagctcatatacaagcagcagcactggggtcttcggaactgggaccaaggtcaccgtcgtcccacgtcagcccaaggccaaccccactgtcactctgttcccaccctcctcgagtgcgtctctgagcgggctggcaaggcgcatagnnnnn

SEQ ID NO: 85481 - DNA, 251 bp, Homo sapiens
  misc_feature: GYAE6OF01CQMBE.3.28.C06.1.454.CMB.1.raw
  modified_base (247)..(251): a, c, t, g, unknown or other
  misc_feature (247)..(251): n is a, c, g, or t
tcagagacgcactccacgaccggtgctcgatttagagctcacgtattgggtttgggggtttggtggtctccactcccgccttgacgaggctgattattactgcagctcatatacaagcagcagcactggggtcttcggaactgggaccaaggtcaccgtcgtcccacgtcagcccaaggccaacccactgtcactctgttcccacctcctcgagtgcgtctctgagcgggctggcaaggcgcatagnnnnn

SEQ ID NO: 85482 - DNA, 499 bp, Homo sapiens
  misc_feature: GYAE6OF01DNFCU.3.28.C06.1.454.CMB.1.raw
  modified_base (306)..(306): a, c, t, g, unknown or other
  misc_feature (306)..(306): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctctggtatcaacagcaccaggcaaagcccccaaactcataatttangatgtcagtaatcggcctcagggtttctaatcgcttctctggttacaagtctggcacacggcctcctgaccatctctgggctcaggctgaggacgaggctgtaattatactgcagctcatatacaagcagcagcagtgggtctcggactgggaccaagtcacgtcgccacgtcacgccaacggcccaacctcg

SEQ ID NO: 85483 - DNA, 532 bp, Homo sapiens
  misc_feature: GYAE6OF01CR5KO.3.28.C06.1.454.CMB.1.raw
  modified_base (443)..(443): a, c, t, g, unknown or other
  misc_feature (443)..(443): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctctggtatcaacatcaccaggcaaaacgcccccaaaactcataaatttatgatgtcagtaatccggccctcgtaggggtttctaatcgtcttctcttggttacaagtctggcaacgacggcctccctgaccatctctgggctcgaggctggacggacgaggctagtattattactgcagtctnaatatacaagcagcagcacgtgggtctacggacgtcgggaccaggtcaccgtccgtcccacgtccacgcccaaacggcccaacccctcg

SEQ ID NO: 85484 - DNA, 521 bp, Homo sapiens
  misc_feature: GYAE6OF01EWMCL.3.28.C06.1.454.CMB.1.raw
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaagcccccaaactcataatttatgatgtcagtaatcggccctcagggtttctaatcgcttctctggttacaagtctggcaacacggcctccctgaccatctctgggctccgaggctggaggacgaggctgatttattactgcagctcatatacaagcagcagcacgtgggtaccttggaacgtgggaccaaggtcaccgtcgtcccacgtcacgccccaaggcccaaccccgtacg

SEQ ID NO: 85485 - DNA, 509 bp, Homo sapiens
  misc_feature: GYAE6OF01CIM08.3.28.C06.1.454.CMB.1.raw
  modified_base (475)..(475): a, c, t, g, unknown or other
  misc_feature (475)..(475): n is a, c, g, or t
tcagagacgcactccacgaccggtgctcgatttagagctcacgtattgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctctggtatcaacagcacccaggcaaacgccccaaatcataatttatgatgtcagtaatcggcctcgagggtttctaatcgcttctctggttacaagtctggcaacacggcctcctgaccatctctgggcctccgaggctgaggacgagctagatttagtactgacagctacaatatacaagcagcagcacgtgggtctcggaactgggacaggtcnccgtcgtccacgtcagacccaagcccaaccctcg

SEQ ID NO: 85486 - DNA, 517 bp, Homo sapiens
  misc_feature: GYAE6OF01DDGNB.3.28.C06.1.454.CMB.1.raw
  modified_base (231)..(231): a, c, t, g, unknown or other
  misc_feature (231)..(231): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacgttggtggttataactatgtctcctggtatcaacagcacccaggcaaaacgcccccaaactcataattatgatgtcagtaatcggccctcagggtttctaatcgcttctctgttacaagtctggcaacacggcctccctgaccatctctgggctcagctgagacgagctgattatactgcagctcatatacaagcagcagcacgtgggtctcgggaactcggggaccaagggtcacccgttcgtccccacgtcaacgaccgaacgacccacccgtacg

SEQ ID NO: 85487 - DNA, 554 bp, Homo sapiens
  misc_feature: GYAE6OF01ENZBO.3.28.C06.1.454.CMB.1.raw
tcagagacgcactccacgaccggtgctcgatttagagctcacgtattggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcatcgccatctcctgcactggaaccagcagtgacgttggtgttataactatgtctcctggtatcaacagcaccaggcaaacgccccaaactcaataattatgatgtcagtaatcggccctcgagggtttctaatcgcttctctggttacaagtctggcaacgacggcctccctgaccatctctcgggctccgaggtctggacggacgaggctaggtatttattacgtgctagtctacatactacaagcagcagcacgtcggggtcttacgggaacgtcggggaacctaaggtccgacccgtccgtccccaacggtccacggaccccaaacggcccctaaccccgtaccg

SEQ ID NO: 85488 - DNA, 507 bp, Homo sapiens
  misc_feature: GYAE6OF01A7J1V.3.28.C06.1.454.CMB.1.raw
  modified_base (435)..(435): a, c, t, g, unknown or other
  misc_feature (435)..(435): n is a, c, g, or t
  modified_base (507)..(507): a, c, t, g, unknown or other
  misc_feature (507)..(507): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctcctggtatcaacagcacccaggcaaacgcccccaaactcataatttatgatgtacagtaatcggccctcgtagggtttctaatcgtcttctctggttacaagtctggcaacacggcctcctgaccatctcgtgggctccgaggctggaggacgaggctgattatactgcagctanatatacaagcagcagcacgtgggtctacggactgggaccaggtcaccgtcgccagtcacgccagcccacccn

SEQ ID NO: 85489 - DNA, 510 bp, Homo sapiens
  misc_feature: GYAE6OF01CFI8R.3.28.C06.1.454.CMB.1.raw
  modified_base (379)..(379): a, c, t, g, unknown or other
  misc_feature (379)..(379): n is a, c, g, or t
  modified_base (475)..(475): a, c, t, g, unknown or other
  misc_feature (475)..(475): n is a, c, g, or t
  modified_base (485)..(485): a, c, t, g, unknown or other
  misc_feature (485)..(485): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaagcccccaaactcataatttatgatgtcagtaatcggccctcaggggtttctaatcgcttctctggttacaagtctggcaacacggcctcccngaccatctctgggctccaggctgaggacgaggctgattatactgcagctcatatacagcagcagcacgtgggtcttcggaactgggaccaggtccnccgtcgaccncgtcacgcccaaggcccaaccctcg

SEQ ID NO: 85490 - DNA, 511 bp, Homo sapiens
  misc_feature: GYAE6OF01BQ0BE.3.28.C06.1.454.CMB.1.raw
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctcctggtatcaacagcaccaggcaaagcccccaaactcataattatgatgtcagtaatcggcctcagggttctaatcgcttctctggttacaagtctggcacacggcctcctgaccatctctgggctcaggctgaggacgaggctgtattattactgcagctacataatacaagcagcagcacgtggggtcttcggaacgtgggaacctaggtcaccgtcgtccacgtcacgacccaacgcccaaccctacg

SEQ ID NO: 85491 - DNA, 516 bp, Homo sapiens
  misc_feature: GYAE6OF01ARHBG.3.28.C06.1.454.CMB.1.raw
tcagagacgcactccacgaccggtgctcgatttagagctcacgtattgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaagcccccaaactcataatttatgatgtcagtaatcggccctcaggggtttctaatcgcttctctggttacaagtctggcaacacggcctccctgaccatctctgggctccaggctgaggacgaggctgattattactgcagctcatatacaagcagcagcacgtggggtcttcgggaactgggaccaaggtcaccgtcgcccacgtcacgacccaaggcccaacccctacg

SEQ ID NO: 85492 - DNA, 514 bp, Homo sapiens
  misc_feature: GYAE6OF01EULCK.3.28.C06.1.454.CMB.1.raw
  modified_base (369)..(369): a, c, t, g, unknown or other
  misc_feature (369)..(369): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctcctggtatcaacagcacccaggcaaacgcccccaaactcataatttatgatgtcagtaatcggccctcgaggggtttctaatcgcttctctggttacagtctggcaacncggcctccctgaccatctctgggctccgaggctggaggacgaggctgatttattacgtgcagctcatatacaagcagcagcacgtgggtcttggaactgggacaggtcaccgtcgtcccacgtcacgcccaacggccaaccctcg

SEQ ID NO: 85493 - DNA, 511 bp, Homo sapiens
  misc_feature: GYAE6OF01BZLYD.3.28.C06.1.454.CMB.1.raw
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcaccaggcaaagcccccaaactcataattatgatgtcagtaatcggccctcaggggtttctaatcgcttctctggttacaagtctgcacacggcctccctgaccatctctgggctccgaggctgaggacggagctgtattatactgcagctcatatacaagcagcagcacgtgggtctcggaacgtgggaccaaggtcaccgtcgtcccacgtcacgacccacgcccaaccctacg

SEQ ID NO: 85494 - DNA, 507 bp, Homo sapiens
  misc_feature: GYAE6OF01B9G2Q.3.28.C06.1.454.CMB.1.raw
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaagcccccaaactcataattatgatgtcagtaatcggccctcagggtttctaatcgcttctctggttacaagtctggcacacggcctcctgaccatctctgggctcaggctgagacgagctgattatactgcagctcatatacaagcagcagcacgtgggtacttcggacgtgggaccaaggtcaccgtcgcccacgtcacgacccaaggcccaaccctacg

SEQ ID NO: 85495 - DNA, 510 bp, Homo sapiens
  misc_feature: GYAE6OF01BE29F.3.28.C06.1.454.CMB.1.raw
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgtttggtggttataactatgtctcctggtatcaacagcacccaggcaaagcccccaaactcataatttatgatgtcagtaatcggcctcagggtttcaatcgcttctctggttacaagtctggcaacacggcctcctgaccatctctggctcgagctgaggacgaggctgattatactgcagctcatatacaagtcagcagcacgtgggtcttcggaacgtgggacctaggtcaccgtcgtcccacgtcacgacccaggcccaacccgtcg

SEQ ID NO: 85496 - DNA, 586 bp, Homo sapiens
  misc_feature: GYAE6OF01DHTQS.3.28.C06.1.454.CMB.1.raw
  modified_base (380)..(380): a, c, t, g, unknown or other
  misc_feature (380)..(380): n is a, c, g, or t
  modified_base (466)..(466): a, c, t, g, unknown or other
  misc_feature (466)..(466): n is a, c, g, or t
tcagagacgcactccacgaccggtgctcgatttagagctcacgtattggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtaggttataactatgtctctggtatcaacagcaccaggcaaacgccccaaactcattaacttatgatgtacaagtaactcggccctgtaggggtttactaacgtcgtcttctctggttaacaagtctagacaacncggcctcctcgaccatcctacgtgggtcctccgaggtccgtaggaacgggacgaggtctaggtattaagttactcgacagtcctanataactacgaacgcaacgcaggcacggtgggtctaccgggtaacgtacgggtaaccgaacggtcctacccggtccgtacccgacgttaccgaacgacccgaaacggccccaacccgtacg

SEQ ID NO: 85497 - DNA, 526 bp, Homo sapiens
  misc_feature: GYAE6OF01CG53Z.3.28.C06.1.454.CMB.1.raw
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctctggtatcaacagcacccaggcaaagcccccaaactcataatttatgatgtcagtaatcggccctcagggtttctaatcgcttctctggttacaagtctggcaacacggcctccctgaccatctctgggctccgaggctgaggacgaggctgtattattactgcagctcatatacaagcagcagcacgtgggtcttcggaacgtcgggaaccaaggtccacccgtcgtccccacgtccacggacccaacggcccaaccccgtacg

SEQ ID NO: 85498 - DNA, 528 bp, Homo sapiens
  misc_feature: GYAE6OF01EMYXK.3.28.C06.1.454.CMB.1.raw
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctcctggtatcaacagcacccaggcaaacgcccccaaactcataattatgatgtcagtaatcggcctcgtagggttctaatcgcttctctgtacagtctggcacgacgcctcctgaccatctctggctccgaggctggacggacgaggctagtattattactgcagctcataatacaagcgagcagacgacgttggggtccttacggaacgtgggacctaaggtcacccgtccgtcccacgtccacgacccaacggcccaacccgtaccg

SEQ ID NO: 85499 - DNA, 544 bp, Homo sapiens
  misc_feature: GYAE6OF01DE44R.3.28.C06.1.454.CMB.1.raw
  modified_base (441)..(441): a, c, t, g, unknown or other
  misc_feature (441)..(441): n is a, c, g, or t
  modified_base (538)..(538): a, c, t, g, unknown or other
  misc_feature (538)..(538): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctctggtatcaacagcaccaggcaaacgcccccaaactcataatttatgatgttagtaatcggcctcgagggtttctaatcgtcttctctgttacaagtctggacaacacggtcctcctgaccatctcgttggcctcgagcgtgaggacgaggctagtattactacgtgcagtctctaatanaacaagctagcagcacgtgggtacttacggaccgtgggaaccgtaaggtccaccggtccgtacccgagtccgacgacccgaacggacccaaccccgnttcccg

SEQ ID NO: 85500 - DNA, 579 bp, Homo sapiens
  misc_feature: GYAE6OF01C47OX.3.28.C06.1.454.CMB.1.raw
  modified_base (475)..(475): a, c, t, g, unknown or other
  misc_feature (475)..(475): n is a, c, g, or t
tcagagacgcactccacgaccggtgctcgatttagagctcacgtattggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttgttgtaataactatgtctcctggtatcaacagcaccaggcaaacgcccccaaactcataaattatgatgtacagtaaatcgggcctacgtaggggtttctaatcgtacttcgttactggttacaaagtctacggacaacgaaccggtcctccctacgaccaactctccgtgggacctccaacgggctagagggaacgacggtctagtaagttatacttgcacgctcaataanactaagcagctagctacgtggggttacttcgggaactgggaacctaaggtcacccgttccgtacccgacgtcaaccgtcccgaaacggaccctaaccccgtacg

SEQ ID NO: 85501 - DNA, 574 bp, Homo sapiens
  misc_feature: GYAE6OF01D1GP6.3.28.C06.1.454.CMB.1.raw
  modified_base (380)..(380): a, c, t, g, unknown or other
  misc_feature (380)..(380): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctcctggtatcaacagcaccaggcaaacgcccccaaactcaattaatttatgatgtacaagtaactccggccctacgtacgggtttctaatcgtcttctctggttacaagtctggacaaccncggccctcctcgacctatctcgtcgggcctcgagggctggacggacgaggctagtattattacgtgcagctacaataatacaagcagcagcctacggtgggtccttacgggaacgtcgggaaccgtaagggtccacccggttccgtaccccgacggttaccgaaccgaccccgaacggccccaaccccgtaccg

SEQ ID NO: 85502 - DNA, 254 bp, Homo sapiens
  misc_feature: GYAE6OF01A8GYJ.3.28.C06.1.454.CMB.1.raw
  modified_base (248)..(254): a, c, t, g, unknown or other
  misc_feature (248)..(254): n is a, c, g, or t
tcagagacgcactccacgaccggtgctcgatttagagctcacgtattgggtttgggggtttggtggtctccactcccgccttgacgaggctgattattactgcagctcatatacaagcagcagcactggggtcttcggaactgggaccaaggtcaccgtcgtcccacgtcagcccaaggccaacccactgtcactctgttcccgccctcctcgagtgcgtctctgagcgggctggcaaggcgcatagnnnnnnn

SEQ ID NO: 85503 - DNA, 533 bp, Homo sapiens
  misc_feature: GYAE6OF01EYU0Q.3.28.C06.1.454.CMB.1.raw
  modified_base (437)..(437): a, c, t, g, unknown or other
  misc_feature (437)..(437): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttgtgttataactatgtctctggtatcaacagcacccaggcaaacgcccccaaactcaataatttatgatgtactagtaatcggccctcgtaggggtttctaatcgctttctctgttacaagtctggacaacacggcctcctgaccatctctggcctcaggctgaggacgagctgattattactgcagctacgatanacaagcaagcagcgacgtggggtaccttcgggaacgtcgggaaccaaggtccaccgtccgtccccacgtccacgaccccaacggcccaaccctacg

SEQ ID NO: 85504 - DNA, 516 bp, Homo sapiens
  misc_feature: GYAE6OF01DNAQH.3.28.C06.1.454.CMB.1.raw
  modified_base (232)..(232): a, c, t, g, unknown or other
  misc_feature (232)..(232): n is a, c, g, or t
  modified_base (434)..(434): a, c, t, g, unknown or other
  misc_feature (434)..(434): n is a, c, g, or t
  modified_base (480)..(480): a, c, t, g, unknown or other
  misc_feature (480)..(480): n is a, c, g, or t
tcagagacgcactccacgaccggtgctcgatttagagctcacgtattggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacgttggtgttataactatgtctctggtatcaacagcaccaggcaaacgcccccaaactcataatttatgatgtacagtaatcggcctcgtagggtttctaatcgtcttctctggttacaagtctggcacacggcctcctgaccatctcgtggcctcgaggctggaggacgaggctgtattattacgtgcagtctnatatacagcagcagcagtgggtctacggaacgtgggaccaggtccnccgtcgtccacgtcacgacccacgcccaaccctacg

SEQ ID NO: 85505 - DNA, 518 bp, Homo sapiens
  misc_feature: GYAE6OF01CEJGQ.3.28.C06.1.454.CMB.1.raw
  modified_base (231)..(231): a, c, t, g, unknown or other
  misc_feature (231)..(231): n is a, c, g, or t
  modified_base (308)..(308): a, c, t, g, unknown or other
  misc_feature (308)..(308): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacgttggtgttaataactatgtctcctggtatcaacagcaccaggcaaacgcccccaaactcataatttangatgtcagtaatcggccctcgagggtttctaatcgcttctctgttacaagtctggcacacggcctccctgaccatctcgtggcctcgaggctggaggacgaggctgattatactgcagctcaatatacagtcagcagcacgtgggtctacggacgtgggaccaggtcgaccgtccgtacccacgtcacgacccaacggcccaacccgtac

SEQ ID NO: 85506 - DNA, 711 bp, Homo sapiens
  misc_feature: GYAE6OF01BZG55.3.28.C06.1.454.CMB.1.raw
  modified_base (702)..(702): a, c, t, g, unknown or other
  misc_feature (702)..(702): n is a, c, g, or t
tcagagacgcactccacgaccggtgctcgatttagagctcacgtattgggtttggggggggtcctcaggaggcagcgctctcgggacgtctccaccatggcctgggctctgctattccgtcaccctcctcactcagggcacagggtcctgggcccagtctggccctgactcagcccgtcctccgtgtctgggtctcctggacagtcgatcatcgccatcctcctgcactggaaccagcagtgacgttggtgtatactatgtctctgtatcaacagcaccacgcaaacgacccccaaactcaatttaagtttactagtattacggtacctaagtaaacgtccggccccttacgtacggggttttactaagttccggtacctttactccgttagggttaaccgtaacgttccggttacggaccgaaaccgtaaccgggtccccttacccgtacgtaaccctacgttccgttccggttacgggcccgttccgacgggtacgtacggtaacggggtaccggaagggtcttagtaagttttacttacgttcgtacgacgtacgtaccaacttaacaaccgaagcccaaggacacgtcctacggtccgggttacgttacggaaaccgttcgggaaccctaacggtcccgaacccgttcccgacccgtaccctaccgaaccgaccccgaaccggacccttaacccccgngttacccgg

SEQ ID NO: 85507 - DNA, 256 bp, Homo sapiens
  misc_feature: GYAE6OF01AZE48.3.28.C06.1.454.CMB.1.raw
  modified_base (248)..(256): a, c, t, g, unknown or other
  misc_feature (248)..(256): n is a, c, g, or t
tcagagacgcactccacgaccggtgctcgatttagagctcacgtattgggtttggggggtttggtggtctccactcccgccttgacgaggctgattattactgcagctcatatacaagcagcagcactggggtcttcggaactgggaccaaggtcaccgtcgtcccacgtcagcccaaggccaaccccatgtcactctgttcccaccctctcgagtgcgtctctgagcgggctggcaaggcgcatagnnnnnnnnn

SEQ ID NO: 85508 - DNA, 539 bp, Homo sapiens
  misc_feature: GYAE6OF01AN36H.3.28.C06.1.454.CMB.1.raw
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtcctcctggacagtcgatcatccgccatcctcctgcacgtggaaccagcagtgacgttggtgttataactatgtctcctggtatcaacagcacccaggacaaacgacccccaaactcaataatttatgatgtacagtaatccggccctcgtagggtttctaatcgtcttctctgtacaagtctgcacacgcctcctgaccatctcgtcggcctccgaggctggacggacgaggctgtattatacgtgcagctcatactacagcagcagcacggtgggtctacggacgtcgggaccgtaaggtccgtaccgtccgtcccgacgtcacgacccgacggccccaacccgtaccg

SEQ ID NO: 85509 - DNA, 517 bp, Homo sapiens
  misc_feature: GYAE6OF01DSOAP.3.28.C06.1.454.CMB.1.raw
  modified_base (231)..(231): a, c, t, g, unknown or other
  misc_feature (231)..(231): n is a, c, g, or t
  modified_base (370)..(370): a, c, t, g, unknown or other
  misc_feature (370)..(370): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacgttggtgttataactatgtctcctggtatcaacagcaccaggcaaacgcccccaaactcataatttatgatgtcagtaatcggccctcgaggggtttctaatcgcttctctggttacaagtctggacaacncggcctccctgaccatctctgggctccgaggctgaggacgaggctgtattatactgcagctacatatacaagtcagcagcacgttgggtctcggatgggaccaggtccaccggtccgccacgtcacgacccaacgcccaaccctacg

SEQ ID NO: 85510 - DNA, 529 bp, Homo sapiens
  misc_feature: GYAE6OF01ACFYP.3.28.C06.1.454.CMB.1.raw
  modified_base (231)..(231): a, c, t, g, unknown or other
  misc_feature (231)..(231): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacgttggtgttataactatgtctcctggtatcaacagcacccaggcaaacgcccccaaactcataatttatgatgtcagtaatccggccctcgtagggtttctaagtcgtcttctctggttacagtctggcacacggcctcctgaccactctcgtcgggctccgaggctggacggacgaggctgtattacttactgcagctacatatacgagcagcagcacgtgggtctacggacgtcgggaccaggtccaccgtccgtcccgacgtcacgacccaacggcccaacccgtcg

SEQ ID NO: 85511 - DNA, 555 bp, Homo sapiens
  misc_feature: GYAE6OF01BS32W.3.28.C06.1.454.CMB.1.raw
  modified_base (328)..(328): a, c, t, g, unknown or other
  misc_feature (328)..(328): n is a, c, g, or t
  modified_base (377)..(377): a, c, t, g, unknown or other
  misc_feature (377)..(377): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctcctggtatcaacagcacccaggcaaacgcccccaaactcataatttatgatgtcagtaatcggccctnagggtttctaatcgcttctctggttacaagtctggcaacacggcctccngaccatctctggctccgaggctgaggacgaggctgattattactgcagctcataatacaagcagcagctacgtcggggttcttaccggaacgtcgggaaccgtaaagggtccgtacccggttcccgtaccccaacggttccgaacggacccccgaaacggccccaaacccccgtaacg

SEQ ID NO: 85512 - DNA, 592 bp, Homo sapiens
  misc_feature: GYAE6OF01C4P9X.3.28.C06.1.454.CMB.1.raw
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctcctggtatcaacagcacccaggccaaacgcccccaaactcataatttatgatgtcagtaatcggccctcgagggtttctaatcgtcttctcgtaggttacaagtctggacaacgacggcctcccgtgacctatcctcgtcgggcctccgaggtctggaacggacgaggtctagtaatttattacgtgaccagtcctacaataataacaagtcagcaacgtctaacggttcggggttaccttacgggaacgtcggggaacccaagggttcctaccccggttccgtacccccacgttccgaaccggcccaaaccgggccccaaaccccgtaccg

SEQ ID NO: 85513 - DNA, 554 bp, Homo sapiens
  misc_feature: GYAE6OF01AUB8W.3.28.C06.1.454.CMB.1.raw
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctcctggtatcaacagcacccaggaccaaaacggcccccaaactcaataatttatgatgtcagtaactcggccctcgtagggtttactaatcgtcttctctggttacaagtctggcaacgacggtcctcctgaccatcctcgtcgggcctcgaggctaggacggacgaggtctagtatttacttactgcagtctacatactacgaagcagcagcaggtgggtactacgggaacgtcgggaacctaggtccacccggtcgtcccgacgtccacgacccgacggacccaacccgtacg

SEQ ID NO: 85514 - DNA, 583 bp, Homo sapiens
  misc_feature: GYAE6OF01AF17Y.3.28.C06.1.454.CMB.1.raw
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctcctggtatcaacagcacccaggcaaacgcccccaaactcataatttatgatgtcagtaatcggcctgtagggtttctaatcgcttctctgttacagtctggcacacggcctcctgaccatctcgtcgggctccgaggctggaggacgaggctagtattactactgacacgtctactaataactaacgaagtcagcagccgtacggttcggggtccttaccgggtaacgtacggggtaacccgtaagggtacccgtacccggttcccgtaccccgtaacggtccaaccggaccccgaaaccggtacccccaaaccccgtaccgg

SEQ ID NO: 85515 - DNA, 573 bp, Homo sapiens
  misc_feature: GYAE6OF01CZI1B.3.28.C06.1.454.CMB.1.raw
  modified_base (233)..(233): a, c, t, g, unknown or other
  misc_feature (233)..(233): n is a, c, g, or t
tcagagacgcactccacgaccggtgctcgatttagagctcacgtattgggtttgggggggggtctcaggaggcagcgctctcgggacgtctccaccatggcctgggctctgctattccctcaccctcctcactcagggcacagggtcctgggcccagtctgccctgactcagcctgcctccgtgtctgggtctcctggacagtcgatcatcgccatctcctgcactggaaccngcagtgacgttggtgtataactatgtctcctggtatcaacagcaccaggcaaacgcccccaaactcaattaattatgatgtcagtaatcggccctgtacgggtttctaactcgtcttctcgtggttacaagttctggacaacgacggccctccctgacctactctcgtcgggctccgaggtctggacggacgaggcctagtatttactactgacacgctacattaacacaagcagcagctacgttcggggtctacgggtaacgtcggggaacctagggtacctacccggtcccgtaccccgacgtaccgaccgacccgaaccggacccaaccccctacgg

SEQ ID NO: 85516 - DNA, 532 bp, Homo sapiens
  misc_feature: GYAE6OF01D4LJI.3.28.C06.1.454.CMB.1.raw
  modified_base (370)..(370): a, c, t, g, unknown or other
  misc_feature (370)..(370): n is a, c, g, or t
tcagagacgcactccacgaccggtgctcgatttagagctcacgtattggggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctcctggtatcaacagcaccaggcaaacgcccccaaactcaataatttatgatgtcagtaatcggccctcgagggtttctaatcgcttctctgttacaagtctggcaacncggcctcctgaccatctcgtgggcctccgaggctgaggacgaggctgtattattactgcagctacatatacaagcagcagctacgtggggtcttcgggaacgtcgggacctaaggtccaccgtccgtcccacgtcacgaccccaacggcccaaccccgtacg

SEQ ID NO: 85517 - DNA, 548 bp, Homo sapiens
  misc_feature: GYAE6OF01DOKJX.3.28.C06.1.454.CMB.1.raw
tcagagacgcactccacgaccggtgctcgatttagagctcacgtattggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcaccaggccaaacgcccccaaactcattaatttatgatgtcagtatcggccctcgagggtttctaatcgcttctctgttacagtctgcacgacgcctcctgacctatctcgtcgggctccgaggctgacggacgaggctgtaattatactgctagctacaatactaacaagtcagcagcgacgttcggggtccttacgggacgtacgggtaaccaaggtccgacccggtccgtcccgaccgtcaccgacccgaacggccccaacccgtaccg

SEQ ID NO: 85518 - DNA, 647 bp, Homo sapiens
  misc_feature: GYAE6OF01C31P9.3.28.C06.1.454.CMB.1.raw
  modified_base (230)..(230): a, c, t, g, unknown or other
  misc_feature (230)..(230): n is a, c, g, or t
  modified_base (308)..(308): a, c, t, g, unknown or other
  misc_feature (308)..(308): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcatcgccatctcctgcactggaaccngcagtgacgttggtgttataactatgtctcgtgtatcaacagcaccgagacaaaccgaccccaaactcaattaattangtatgtactaagtaactccggacctgtacgggttactaatcgtcttctcgtagtactacgtctaggacaacgaccggtccctcctacgacctactccgtcgtcgggtcctaccgaggtcgtacggacgggaaccggtaggaccgtagttaacttaacgttaccgtacggaccgtagtaccttacgtaaacttaacgtaaccgaaacggcctaacggacctacggaccgtaaccggttcgggggtaccttaccgggtaacgtacgggaaaccgtaacgggtaccgtacccggtcccgtacccgacgtaccgacgacccgaaccggaccccaacccgtacg

SEQ ID NO: 85519 - DNA, 539 bp, Homo sapiens
  misc_feature: GYAE6OF01BM2H9.3.28.C06.1.454.CMB.1.raw
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcatcgccatctcctgcactggaaccagcagtgacgttggtgttataactatgtctcctggtatcaacagcacccaggccaaacgcccccaaactcataatttatgatgtcagtaatcggccctcgagggtttctaatcgcttctctgttacaagtctggcaacacggcctccctgaccatcctagtcggctccaggctaggacggacgaggctgtattattacgtgcagctcaatataacaagacagcagctaacgtgggtcttcgggaactacgggacctaaggtccgacccggtccgtccgaccgtcgacgacccgaacgacccaccctaccg

SEQ ID NO: 85520 - DNA, 547 bp, Homo sapiens
  misc_feature: GYAE6OF01EIHTQ.3.28.C06.1.454.CMB.1.raw
  modified_base (231)..(231): a, c, t, g, unknown or other
  misc_feature (231)..(231): n is a, c, g, or t
  modified_base (448)..(448): a, c, t, g, unknown or other
  misc_feature (448)..(448): n is a, c, g, or t
tcagagacgcactccacgaccggtgctcgatttagagctcacgtattggggtttgggggggggtctcaggaggcagcgctctcgggacgtctccaccatggcctgggctctgctattcctcaccctcctcactcagggcacagggtcctgggcccagtctgccctgactcagcctgcctcgtgtctgggtctctggacagtcgatcatcgccatctcctgcactggaaccngcagtgacgttggtgttataactatgtctcctggtatcaacagcaccaggacaaacgcccccaaactcattaatttatgatgtacagtaatcggccctacgtagggtttctaatcgtcttctctggttacagtcgtggacacgaccggtccctcctcgacctactcgtcgtcgggctccgagggctaggaggacgaggctgtattatactgcagctnataatacaagcagcagcgacgtgggtctacggacgtacgggaacctaggtaccgccgtccgtaccgacgtccacgaccccgacggccccaacccgtacg

SEQ ID NO: 85521 - DNA, 580 bp, Homo sapiens
  misc_feature: GYAE6OF01D0YVD.3.28.C06.1.454.CMB.1.raw
  modified_base (439)..(439): a, c, t, g, unknown or other
  misc_feature (439)..(439): n is a, c, g, or t
tcagagacgcactccacgaccggtgctcgatttagagctcacgtattggggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcatcgcatctcctgcactggaaccagcagtgacgttggtggttataactatgtctcctgtatcaacagcaccaggacaaacgcccccaaaactcaattaatttatgatgtactagtaatcggccctagtaggggtttactaatcgtcttctcttaggttaactagtctggactaacgaccgcctcctgactatctcgtgcctcgagctgacggacgaggctgtaattacttacncgacagctacataactaacgagctagcagaccgacgttaggggtccttaacgggacgttacgggaacccgtaaggttcccgacccggttccgtacccgtaccgttacgacgtaccccgaaccggaccctaaccccgtaccg

SEQ ID NO: 85522 - DNA, 601 bp, Homo sapiens
  misc_feature: GYAE6OF01DR094.3.28.C06.1.454.CMB.1.raw
  modified_base (233)..(233): a, c, t, g, unknown or other
  misc_feature (233)..(233): n is a, c, g, or t
tcagagacgcactccacgaccggtgctcgatttagagctcacgtattggggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacggttggtgttaatactatgtctctggtatcaacagcaccaggacaaacgacccccaaactctaataatttatgatgtacaagtaactccggtccctacgtagggtttctaatcgcttctctgttacaagtctgacacgcggtcctcctagacctatcgtcgtggcctaccgaggtctaggacggacgagtctagtacttaattcgtgacgacgtctactaataactaacgaacgtacgacgacgacgtacgtacggttcggggttaccgttaccgggaaacgtcgggaacccgtagggtacccgtaccggtcccgtacccgacgtccgaccgacccgaaccggacccaaccccgttaccg

SEQ ID NO: 85523 - DNA, 550 bp, Homo sapiens
  misc_feature: GYAE6OF01AQ4JJ.3.28.C06.1.454.CMB.1.raw
  modified_base (307)..(307): a, c, t, g, unknown or other
  misc_feature (307)..(307): n is a, c, g, or t
  modified_base (372)..(372): a, c, t, g, unknown or other
  misc_feature (372)..(372): n is a, c, g, or t
  modified_base (448)..(448): a, c, t, g, unknown or other
  misc_feature (448)..(448): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctcctggtatcaacagcacccaggacaaacgcccccaaatcataattangatgtcagtactcggccctcgtagggtttactaatcgtcttctctggttacaagtctggacaacncggtcctcctgacctatctcgtcggcctccgaggtctggaggacgaggctagtattactactgcacgtctacatanaacgagcacgcacgctacggtcgggttcttacgggaacgtcgggaaccgaaggtcctaccgtccgtcccgacgtaccgacgacccaacgcccaacccgtacg

SEQ ID NO: 85524 - DNA, 525 bp, Homo sapiens
  misc_feature: GYAE6OF01A41YW.3.28.C06.1.454.CMB.1.raw
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttgtggttatactatgtctctggtatcaacagcaccaggcaaacgcccccaaactcataattatgatgtacagtaatcggcctcgagggtttctaatcgctttctcgtgttacaagtctgacaacgacggcctccctgacctatctcgtcgggcctcgaggctgaggacgaggctagtattatactgactagcttcatatacgaagcagcagcacgtgggtctcggaacgtcgggactagggtccaccgtcgtcccacgtcacgacccacggcccaacccgtacg

SEQ ID NO: 85525 - DNA, 650 bp, Homo sapiens
  misc_feature: GYAE6OF01BYDN9.3.28.C06.1.454.CMB.1.raw
  modified_base (311)..(311): a, c, t, g, unknown or other
  misc_feature (311)..(311): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctctggtatcaacagcacccgaggacaaacgacccccaaactcataaatttanagtatgtacagtaatcggccctcgtacggggtttactaagtcgtcttctcgttaggttacaacgtcgtacggtacaaccgaccggtcctccctgacctactctcgtcgggtcctccgtaggtctaggacgggtacggaggtctaggtaactttaacttacgtgactagtaccttacgaacttaactaacgaagtacgacgactaacgccgtacggttacggggttccgttacgggaaacggttcgggaaccgtaacgggtccgtaaccccggttccgtaccccgaccggttaccgaacccggtacccccgaaaccggtccccctaaaccccggtaaccg

SEQ ID NO: 85526 - DNA, 512 bp, Homo sapiens
  misc_feature: GYAE6OF01BZY7Q.3.28.C06.1.454.CMB.1.raw
tcagagacgcactccacgaccggtgctcgatttagagctcacgtattggggtttggggggggtctcaggaggcagcgctctcgggacgtctccaccatggcctggctctgctattcctcaccctcctcactcagggcacagggtcctgggcccagtctgccctgactcagcctgcctccgtgtctgggtcctcctggacagtcgatcatcgccatctcctgcactggaaccagcagtgacgttggtgttataactatgtctcctggtatcaacagcacccaggcaaagcccccaaactcataatttatgatgtcagtaatcggcctcagggtttctaatcgcttctctggtacaagtctgcacacgctccctgaccatctctggctcaggctgaggacgaggctgattatactgcagctcatatacaagcagcagccagtgggtctacggaacgtgggaccaaggtccaccgtcgtacccacgtccacgacccaacggcccaaccccgtacg

SEQ ID NO: 85527 - DNA, 708 bp, Homo sapiens
  misc_feature: GYAE6OF01EGI0I.3.28.C06.1.454.CMB.1.raw
  modified_base (230)..(230): a, c, t, g, unknown or other
  misc_feature (230)..(230): n is a, c, g, or t
  modified_base (273)..(273): a, c, t, g, unknown or other
  misc_feature (273)..(273): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgcatctcctgcactggaaccngcagtgacgtttggtgttataactatgtctctggtatcaacancaccaggacaaacgccccaaactctaattaactttatgatgtactagtaactcgacccttcgtagggtttctaagtcgtcttctctggttaactagtctggactaacgaccggtcctcccgtacgacctacttcgtacgtcgggtcctacgacggtctacggacggtacggacggtctaggtaactttacgttacgtcggtacacgtccttaacgtaattaaccgtaaccgaaacggtcaaacggtcgtaacggaccgtaccggggttacggggttacccgtttaaccgggggaaacggttaccgggggtaaaacccgttaacggggttaccccgtacccccgggtttaccccggtaacccccgttaacccgggtacccgaaacccgggtaccccccgggaaaccgggttacccccccaaaccccggttaccccg

SEQ ID NO: 85528 - DNA, 768 bp, Homo sapiens
  misc_feature: GYAE6OF01D4NX5.3.28.C06.1.454.CMB.1.raw
  modified_base (272)..(272): a, c, t, g, unknown or other
  misc_feature (272)..(272): n is a, c, g, or t
tcagagacgcactccacgaccggtgctcgatttagagctcacgtattggggtttgggggggggtctcaggaggcagcgctctcgggacgtctccaccatggcctgggctctgctattcctcaccctcctcactcagggcacagggtcctgggcccagtctcgccctgactcagcctgcctcgtgtctgggtctccgtggacagtcgatcatcgcatcctcctgcactaggaaccagcagtgacgttggtagttataactatgtctctgtatnaacagccaccagacaaacgaccccaaatctaattaattatagactgtactaagtaactccggaccttgtacgggttttacaacgtcgtactttcgtacgttacgttaacgtacgtcgtacggaaccaaacgtcccggtacccttaccctaggtaaccctacgttaccgtaccggttccggggaccttaccgggaacggtccggttaacgggaacggggaaccggttacgggtacgtttaacggttaactttaaacggtttaccgtacggaacgtacgtaaccttaaccgtaaagttaaacgttaaaccgaaacgttaccggaaaccgggctaaccgggtaccggtaaccggggtttacgggggtttacccttaacggggaaacccgttaacggggaacccgttaaacggtcccccggttaacccgttacccggtaccccaacgggttaccaacccgggtaaccccaaacccgggacccccaaaccccggttaaccg

SEQ ID NO: 85529 - DNA, 609 bp, Homo sapiens
  misc_feature: GYAE6OF01CBK40.3.28.C06.1.454.CMB.1.raw
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgcctgggtctcctggacagtcgatcatcgccatctcctgcactggaaccagcagtgacgttggtggttataactatgtctcctggtatcaacagcacccaggcaaacgcccccaaatcattaatttatgtatgtacagtaactcggccctgtagggtttactaagtcgtcttctcgttagttacaagtctcggacaacaccggcctccctagacctatcctcgtcgggctccgaggcgtggacggacgaggtctagtattacgttacgtgacgtatcgtacaatactaacagtcgagacagcctaacggttcggggttacttacgggaaccgtacgggtaaccctaagggttaccctacccggttcccggtacccccgacggttccgaacccggtacccgaaaccggtacccccaacccccggtaccg

SEQ ID NO: 85530 - DNA, 872 bp, Homo sapiens
  misc_feature: GYAE6OF01BUHGL.3.28.C06.1.454.CMB.1.raw
  modified_base (234)..(234): a, c, t, g, unknown or other
  misc_feature (234)..(234): n is a, c, g, or t
tcagagacgcactccacgaccggtgctcgatttagagctcacgtattggggtttgggggggggtctcaggaggcagcgctctcgggacgtctccaccatggcctgggctctgctattcctcaccctcctcactcagggcacgagggtcctgggcccagtctgccctgactcagcctgcctccgtgtctgggtctcctggacagtcgatcatcgccatctcctgcactggaaccngcagtgacgttggtagttataactatgtctctggtatcaacacgacaccaggacaaaccgacccccaaactcaataatttatgtatgactagtaacgtcggtcctacggtagggtttactaacgttcgtctttcgtacgttacggttaactaacggttcgttacggacctaaaccgtacccggtacccttacccgtacgtaaccctaacgttccgttcgtaccgggtccttaccggtagggtccggttacggaacggggtaaccggacgggttaccgttaaggttaacgttttaacgtttaccgtacgggtaccgtaaggttaccttaccttaaacgttaaaccgttaaaccgaaaccgggtaacccgaaccggtaacccgtaaccgggaccggtttaaccgggggtttaacccgggggtttacccggtttaaaccgggggtaaaacccggttaacccggggggaaaaccccgggtttaaaacccgggggttaacccccgggttaaccccccggggtttaaccccgggtttaaccccccgggaaacccgggtttaccccgtaaaaccccccgggaaccccccgggtaaaaacccccggggttaaacccccccgtaaaacccccccggttaaacccggg

SEQ ID NO: 85531 - DNA, 568 bp, Homo sapiens
  misc_feature: GYAE6OF01DN0R1.3.28.C06.1.454.CMB.1.raw
  modified_base (233)..(233): a, c, t, g, unknown or other
  misc_feature (233)..(233): n is a, c, g, or t
tcagagacgcactccacgaccggtgctcgatttagagctcacgtattggggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacgttggtgtataactatgtctctggtatcaacagccaccaggcaaacgcccccaaactcaataatttatgatgtacagtaactcggccctcgtagggtttctaagtcgtcttctcgtaggttacaagtctggacaacgaccggtccctcccgtcgacctatcctacgtcgggcctccgagggctggaacggacgaggtctagtatttactactgcagctacaatactaacaagcagcagctacggtcgggtcttcgggaacgtacgggaacctaggtcctaccggtccgtacccacgtccgacgacccgaacggccccaacccgtacg

SEQ ID NO: 85532 - DNA, 696 bp, Homo sapiens
  misc_feature: GYAE6OF01D3PD8.3.28.C06.1.454.CMB.1.raw
  modified_base (235)..(235): a, c, t, g, unknown or other
  misc_feature (235)..(235): n is a, c, g, or t
tcagagacgcactccacgaccggtgctcgatttagagctcacgtattggggtttgggggggggtctcaggaggcagcgctctcgggacgtctccaccatggcctgggctctgctattcctcaccctcctcactcagggcacgagggtcctgggcccagtctgccctgactcagcctgcctccgtgtctgggtctcctggacagtcgatcatcgccatctcctgcactaggaaccngcagtgacgttggtagttaataactatgtctccgtagtatacaacagccaaccaggacaaaccgacccccaaactactaattaatttatagtatcgtactaagttaacgtccggtaccttacggtagggtttactaacgtccgtctttcgttcgttacggttaactaacggtcgttacggaaccaaccgtacccggtcccttaccccgtacgaccctaacgttccgtcggtcgggtcctaccggacggtcgtacgggacggtacggacggtcttagtaactttaacgttacgtacgactacgtacttacgtaattaactaacgaacgacgaacgacgacggtaccgtacgggttcggggttacgttaccgggaacggtacgggaaccgtaacgggtaccctacccggtacccgtaccccgacgtaccgacccgaacccgaaccgtaccccaaacccgtccg

SEQ ID NO: 85533 - DNA, 703 bp, Homo sapiens
  misc_feature: GYAE6OF01ENYO4.3.28.C06.1.454.CMB.1.raw
  modified_base (211)..(211): a, c, t, g, unknown or other
  misc_feature (211)..(211): n is a, c, g, or t
  modified_base (295)..(295): a, c, t, g, unknown or other
  misc_feature (295)..(295): n is a, c, g, or t
tcagagacgcactccacgaccggtgctcgatttagagctcacgtattggggtttggggggggggtctcgaggaggcacgcgctctcgggacgtctccaccagtggcctgggcgtcctgctattcctccacccgtcctcactcagggcacgagggtcctcgggccagtcctgccctgactcagcctgcctccgtgtctgggtctcctggacngtcgatcatcgcatctcctgcactggaaccagcaggtcggacgtttggtggttaataactatcgtacgtccgtggttatcaacncgacaccgaggacaaaccggaccccaaactactacttaattactagctgtactagtaactccgtcctacgtacgggtttacaagttccgcttactcgtacgttacaacggtcgtacggactaacgaccgtcctaccgacaacctacgttcttaccgtcggtcctaccgtaaggcttacgggaacggtacggacggtccttagttaacgtttacgtacggtacgacgtacgtcctaactaactttaacgtaacaagtacaacgtacaacgtacgtaccgggtagggttacccgttaaccgggaaccggtacgggggtaaacccgtaacggggttccaaacccgggttccccgtaacccaacggtacccgtaaccggaacccggaaccggtaccccctaaccgttacccg

SEQ ID NO: 85534 - DNA, 704 bp, Homo sapiens
  misc_feature: GYAE6OF01D1GPS.3.28.C06.1.454.CMB.1.raw
  modified_base (233)..(233): a, c, t, g, unknown or other
  misc_feature (233)..(233): n is a, c, g, or t
  modified_base (323)..(323): a, c, t, g, unknown or other
  misc_feature (323)..(323): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcatccgcatctcctgcactcggaaccngcaggtgtacggttggtaggttaataactatgtctcctggtatacaacacgccaaccgaggaccaaacgcccccaaatcaattaatttangatgtacaagtaactccggtcctacgtagggtttactaagtcgtctttcgtcgttaggttactaagtcgtcggacaaccgtacggccccttaccctcgaaccctattccgtaccgttcgggtccctccggaacgggtctagggaacgggacgtacgggtacttagtaactttatacgtgacgtacgtactactaaattactaacgaacgtaccaaggaccgtaacgccgttaaccggggttcgggggtttaacccgtaccgggtaaacggttacgggggaaacccgtaagggtaccccggtaacccggttcccgtaccccgaaccggttccgaaacccggtacccccggaaacccgggaccccctaaaccccgtaacccgg

SEQ ID NO: 85535 - DNA, 789 bp, Homo sapiens
  misc_feature: GYAE6OF01CP63S.3.28.C06.1.454.CMB.1.raw
tcagagacgcactccacgaccggtgctcgatttagagctcacgtattgggtttggggggggtctcaggaggcagcgctctcgggacgtctccaccatggcctggctctgctattcctcaccctcctcactcagggcacagggtcctgggtccagtctgccctgactcagcctgcctccgtgtcgtggtctctggacagtcgatcatcgcatctcctgccacgtggaaccagcagtgacggttggtagttaataactatgtctcctggtatcgaacagaccacccgaggaccaaaacgaccccccaaaactacctaattaaacttttatagtaattcgtactaagttaaaacgttcccgggccccgttacggtaacgggggtttttacctaaacgttcccggtaccttttccgttacggtttacgggttttaaaccgtaaaaccggtttccggttacgggaaccctaaaaccccggtaacccgggtaccccctttaccccgttacggaacccctacgtttaccgttccggtccggggtaccccttacccgggtacgggtcgttaacgggaacgggtaaccgggtagggtccgttaaggttaactttaacgtttacgtcggtactaacggtacctaacctaagtaacttaacaacggcaacgcagacctaacggttcggggttacgtaccgggaacgttcggggaaccgtaaccggtcctaaccccgggtccgtaccccgtaccggtacccaaccggaaccccgaacccggaccccaaccccgttaacccg

SEQ ID NO: 85536 - DNA, 670 bp, Homo sapiens
  misc_feature: GYAE6OF01ENXC2.3.28.C06.1.454.CMB.1.raw
  modified_base (337)..(337): a, c, t, g, unknown or other
  misc_feature (337)..(337): n is a, c, g, or t
tcagagacgcactccacgaccggtgctcgatttagagctcacgtattggggtttggggggggtctcaggaggcaggcgcttcgttcggggacgtctaccaccagtcggccctgggctctggctattcctcaccctctcactcgagggcacagggtcctgggcccagtcctgccctgactcagcctgcctcgtgtctggtctcctggacagtcgatcatcgccattcctcctgccacgtggaacccagcaggtgacgtttggtagttataactatgtctcctggtatcaacagcaccccaggcaaacgcccccaaaactcaattaatttatgatgtanagttaaactcggcccttcgtaggggttttctaaacgtcgtcttctcttggttactaagtcgtgacaacacggtcctcctgaccatctcgtgggctccgaggtctaggacggtacgaggctagtatttattacgtcgcgacgtctacgaattaacgtaacaacgtcgaacgcgaacggtacctaccgggttggggttaccggtttaccgggaaaccggttaccggggtaaacccgtaaggggtaccccgttaacccggttcccggttaacccccgaacggttccccgaaacggttaccccccgaaacggtacccccgtaaacccccgtaccccg

SEQ ID NO: 85537 - DNA, 611 bp, Homo sapiens
  misc_feature: GYAE6OF01DQ7DB.3.28.C06.1.454.CMB.1.raw
  modified_base (229)..(229): a, c, t, g, unknown or other
  misc_feature (229)..(229): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatccgcatctcctgcactgaccngcagtgacgttggtgtataactatgtctctgtatcaacagccaaccaggaccaaacgacccccaaactcaattaatttagtgatgtacaagtaacgtccgacctacgtacgggtttctaatcgtcttcgtctggttaacagtcgtgacaacgccgtcctccacgactatcctcgtcggtctccaggtctaggaacggacggacggtctagtaatttacttacgtcgactacgtctactaataactaacgaagtacagcagtaccgtacggttgggtaccgttacgggtaacggtaccgggtaaaccgtacgggttcccgtaacccggttcccgtacccaccggtacaacccggacccaaaccgggccccaaaccccgtaccg

SEQ ID NO: 85538 - DNA, 753 bp, Homo sapiens
  misc_feature: GYAE6OF01BTPCQ.3.28.C06.1.454.CMB.1.raw
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctggtctcctggacagtcgatcatcgcatctcctgcactggaaccagcagtgtacgttggtagttataactatgtctcctggtactcaacacgcaccgaggaccaaacgcccccaaatcaataatttatgatcgtacagtaactccggtaccctgtacgggtttactaagtccgtcttcgtctacggttaacaacgttcgtacggaccaaccgtacggtccctacccgtacgtaccctacttccgtaccggtcgggtcctaccgtacgggtccgttaaggacgggtaaccgtacgggtaccttaggtaactttacgttaacgtcgaccgtaacgtccgttaactaacgttaaccgttaccgaaacggccgtaacgggactaaccggaccgttaaccgggtttccgggggtttaacccgttaccggggtaaaacccggtttacggggaaacccgttaacccgggggttacctaacccccgggttacccggttacccccgtaaccgggttaccccaacccgggtaacccccgtaaaccccggggtaacccccgtaaacccccgttaaccggg

SEQ ID NO: 85539 - DNA, 566 bp, Homo sapiens
  misc_feature: GYAE6OF01EBS9M.3.28.C06.1.454.CMB.1.raw
  modified_base (232)..(232): a, c, t, g, unknown or other
  misc_feature (232)..(232): n is a, c, g, or t
  modified_base (378)..(378): a, c, t, g, unknown or other
  misc_feature (378)..(378): n is a, c, g, or t
  modified_base (386)..(386): a, c, t, g, unknown or other
  misc_feature (386)..(386): n is a, c, g, or t
tcagagacgcactccacgaccggtgctcgatttagagctcacgtattggggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgcatctcctgcactggaaccngcagtgacgttggtgttataactatgtctcctggtatcaacagcaccaggaccaaacgcccccaaactcaattaatttatgatgtcagtaacgtcggccctacgtagggtttactaagtcgtcttctctggttacagtctgacacncgcctccncacatctcgtcggctcgaggtctaggaggacgaggctagtatttatactgcagctacatatacaagcagcgagcgtacggtcggggtccttacggaacggtacggggaacctagggtaccgtacccgtccgtacccgacgtaccgaaccgtaccccgaaaccggccccgaaacccctacg

SEQ ID NO: 85540 - DNA, 564 bp, Homo sapiens
  misc_feature: GYAE6OF01CTD9R.3.28.C06.1.454.CMB.1.raw
  modified_base (233)..(233): a, c, t, g, unknown or other
  misc_feature (233)..(233): n is a, c, g, or t
  modified_base (276)..(276): a, c, t, g, unknown or other
  misc_feature (276)..(276): n is a, c, g, or t
  modified_base (299)..(299): a, c, t, g, unknown or other
  misc_feature (299)..(299): n is a, c, g, or t
  modified_base (310)..(310): a, c, t, g, unknown or other
  misc_feature (310)..(310): n is a, c, g, or t
  modified_base (383)..(383): a, c, t, g, unknown or other
  misc_feature (383)..(383): n is a, c, g, or t
  modified_base (389)..(389): a, c, t, g, unknown or other
  misc_feature (389)..(389): n is a, c, g, or t
  modified_base (450)..(450): a, c, t, g, unknown or other
  misc_feature (450)..(450): n is a, c, g, or t
  modified_base (457)..(457): a, c, t, g, unknown or other
  misc_feature (457)..(457): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctgggacagtcgatcgatcgccatctcctgcactggaaccngcagtgacggttggtggttataactatgtctctggtatcaacngcaccaggacaaacgccccaaanctataagttangatgtacagtaactcggccctgtacgggttctaactcgtcttctcgtagttacagtctgacacacggcctccncgactntcgtctaggcctacgagtctaggacggacgaggtctagtaattattacgtgactcgactanaactaanacgaagcacgacgagcaacggttcggtcgttaccgggaacgtacgggtaacaaggttccctaccggtctcccgacgtcaaccggcccaaacggccccaaacgtaccg

SEQ ID NO: 85541 - DNA, 665 bp, Homo sapiens
  misc_feature: GYAE6OF01DWKUK.3.28.C06.1.454.CMB.1.raw
  modified_base (192)..(192): a, c, t, g, unknown or other
  misc_feature (192)..(192): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacgagggtcctgggcccagtctgccctgactcagcctgcctcgtgtctggtctcnggacagtcatcatccgcattcctcctgccacgtaggaacccagtccaaggtgtaacggtttggtagttaataactatgtcctctgtactacaacagccaccgaggaccaaaccgacccccaaactctaattaacttatacgatgtactagtaacttccggacccttaggttacgggtttactaacgttccgtactttcgtacgttagttaactaaggtctaggacctaaccgaccggtcctccctagaccctataccgtcgtcgggtacctccgacggtcgtacggaacggacggtagtccgtagtaactttacgtacgtgactacgctacgtaactaacgtacaacgcctacgacacgtaccgtacggttcggggttaccttacgggtaaacgtcgggtaaaccgacgttcccgaacccggttcccgtaccgaccgtaccgaccggaaccccaacggtaccccaaccgtacc

SEQ ID NO: 85542 - DNA, 649 bp, Homo sapiens
  misc_feature: GYAE6OF01CRLFJ.3.28.C06.1.454.CMB.1.raw
  modified_base (282)..(282): a, c, t, g, unknown or other
  misc_feature (282)..(282): n is a, c, g, or t
  modified_base (317)..(317): a, c, t, g, unknown or other
  misc_feature (317)..(317): n is a, c, g, or t
tcagagacgcactccacgaccggtgctcgatttagagctcacgtattggggtttggggggggtctcaggaggcagcgctctcgggacgtctccaccatggcctgggctctgctattcctcaccctcctcactcagggcacgagggtcctgggcccagtctgccctgactcagcctgcctcgtgtcgtgggtcctccgtggacaggtcgatcatcgcctatctcctgcacgtaggaaccagctagtgacggttggtgttaatactatgtctctggtatcaacnacaccagacaaccgaccccaactactataacttanagtatgtacaagtaactcggaccctacggtacgggttctacgtcgtcttctcgtacgttacgtaagtcgtacggacaaccgccgtacctcctacgacctatccgttcgcggtccgtcgaggtcgtaggacggaccggacggtcttacgtaatttacgtacgtgacgtacgcctaacgtaataacgtaactaacgcacgtacgacgtacgtacgggttcgggtaccgttaccggggaaccggtacgggtaaaccgtaaccgggtcccgtaccccggttcccgtaccgacccggtactaacccggacccgaacccgtaccccgaacccctacgg

SEQ ID NO: 85543 - DNA, 559 bp, Homo sapiens
  misc_feature: GYAE6OF01B6UQX.3.28.C06.1.454.CMB.1.raw
  modified_base (222)..(222): a, c, t, g, unknown or other
  misc_feature (222)..(222): n is a, c, g, or t
  modified_base (235)..(235): a, c, t, g, unknown or other
  misc_feature (235)..(235): n is a, c, g, or t
  modified_base (318)..(318): a, c, t, g, unknown or other
  misc_feature (318)..(318): n is a, c, g, or t
  modified_base (326)..(326): a, c, t, g, unknown or other
  misc_feature (326)..(326): n is a, c, g, or t
  modified_base (377)..(377): a, c, t, g, unknown or other
  misc_feature (377)..(377): n is a, c, g, or t
  modified_base (386)..(386): a, c, t, g, unknown or other
  misc_feature (386)..(386): n is a, c, g, or t
  modified_base (400)..(400): a, c, t, g, unknown or other
  misc_feature (400)..(400): n is a, c, g, or t
  modified_base (404)..(404): a, c, t, g, unknown or other
  misc_feature (404)..(404): n is a, c, g, or t
  modified_base (410)..(410): a, c, t, g, unknown or other
  misc_feature (410)..(410): n is a, c, g, or t
  modified_base (412)..(412): a, c, t, g, unknown or other
  misc_feature (412)..(412): n is a, c, g, or t
  modified_base (417)..(417): a, c, t, g, unknown or other
  misc_feature (417)..(417): n is a, c, g, or t
  modified_base (425)..(425): a, c, t, g, unknown or other
  misc_feature (425)..(425): n is a, c, g, or t
  modified_base (429)..(429): a, c, t, g, unknown or other
  misc_feature (429)..(429): n is a, c, g, or t
  modified_base (450)..(450): a, c, t, g, unknown or other
  misc_feature (450)..(450): n is a, c, g, or t
  modified_base (469)..(469): a, c, t, g, unknown or other
  misc_feature (469)..(469): n is a, c, g, or t
  modified_base (490)..(490): a, c, t, g, unknown or other
  misc_feature (490)..(490): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcgagggcacgagggtcctgggcccagtctgccctgactcagcctgcctccgtgtcgtgggtctcctggacagtcgatcatcgcctatctcngcacgtggaaccngcagtgagttggtagttaataactgtgtctcgtgtactcaacagccaccaggaccaaaccgacccccaaatctaataatttangtatgtanagtaactcgtcctaggtagggttctaagtcgtcttctcgtagtacagttcnggaccaacncgtcctccgtgacntcgngcgtcncngtcgngacggagnggtntgtattactgtcgcgagtacnctaagtacacgaagcacgntacgcgtacggtcgggttacncggtaacgcggtaacctaggcccttccgcccgacccacgtacgacccgtacccacggaccccacgtacg

SEQ ID NO: 85544 - DNA, 781 bp, Homo sapiens
  misc_feature: GYAE6OF01DAKHL.3.28.C06.1.454.CMB.1.raw
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcatcgccatcctcctgcatggaaccagcagtgacgtttggtgttaataactatgtctctgtatcaacagaccaccaggaccaaaacgaccccccaaaatcaatttaatttacgtagattgtaccaagttaactccgggccccttacggtacggggttttactaacgttcgtcctttccgttcgttacggttaacaacgtttccgtcgggtaacctaaaccgtaccggtccccttaccccgtacggtaaccctaacttcccgttcgtcggggtacccttaccggacgggtaccgttagggaacgggtaccggtaagggtcccttaggtaactttacgttaaccgttcgtaccgacggtaccttacgtaacttaacgttaaaccgaacggtaccaacggacctaacggtacccgttaacgggttacggggtttacccgttaacccgggtaaacggtccgggggtaaacccgtaaccgggttacccgtaaccccgggtttacccggtaacccccgtaacggttacccgaacccggtaaccccggaaacccggtaccccccgtaaaccccggttacccg

SEQ ID NO: 85545 - DNA, 815 bp, Homo sapiens
  misc_feature: GYAE6OF01E1XVM.3.28.C06.1.454.CMB.1.raw
  modified_base (196)..(196): a, c, t, g, unknown or other
  misc_feature (196)..(196): n is a, c, g, or t
tcagagacgcactccacgaccggtgctcgatttagagctcacgtattgggtttgggggggtctcaggaggcagcgctctcgggacgtctccaccatggcctgggctctgctattcctcaccctcctcactcagggcacagggtcctgggcccagtctgccctgactcagcctgcctcgtgtctgggtctctggacngtcgatcatcgcatctctgcactggaaccagcagtgacgttggtgttaataactatgtctcctggtactacaacagacaccaggacaaacgaccccaaactctaataactttatacgtatcgtactaagttaacgtccggtacccgttacgtaacggggttttactaaacgttcgtacctttaccgttacgttacggtttaacctaaacggttccgttaggacctaaaccgtacccgggtacccttacccgtacggaccctaattcccgttcgtcgggtaccctccgacgggtcgttacgggaacggtacgacgggaccgttaggtaactttacgttacgtacggaccgtacgtaccgttaactacgttaaacgtaccgtaaacgtacccgtaacggacctaaccggtacgggttaacccggtttacggggggtttaaccccggtttaaaccggggaaacccgggtttaccggggggaaacccgttaaaccgggggttaaccccgttaccccgggttaaccccggttacccccgtaaacccgggttaccccgggtaaacccggtaaccccccgggtaaaccccgggtaacccccctaaaccccccggtttaaaccccgg

SEQ ID NO: 85546 - DNA, 602 bp, Homo sapiens
  misc_feature: GYAE6OF01B0Y7E.3.28.C06.1.454.CMB.1.raw
  modified_base (231)..(231): a, c, t, g, unknown or other
  misc_feature (231)..(231): n is a, c, g, or t
  modified_base (471)..(471): a, c, t, g, unknown or other
  misc_feature (471)..(471): n is a, c, g, or t
tcagagacgcactccacgaccggtgctcgatttagagctcacgtattggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcatggaaccngcagtgacgttggtgttataactatgtctcctggtatcaacagcaccaggacaaacgacccccaaatctaataatttatgatgtacaagtaactccggtccctacgtagggtttactaatcgtacttctcgtaggttaacaagttcctggacaacgacgccctaccgtacgacctatcctcgtcggccttccgaggtcgtgaacgggacgaggtctagtaattactacgtcgcagcctanatatacgaagtcagcacgctaacggttgggtacgtaccggaacgtacgggacctaagggcctacccggttcccgtaccccgtaacggtccaacccggaccccgtaaccggacccccgtaaaccccgtacgg

SEQ ID NO: 85547 - DNA, 679 bp, Homo sapiens
  misc_feature: GYAE6OF01A45RU.3.28.C06.1.454.CMB.1.raw
  modified_base (259)..(259): a, c, t, g, unknown or other
  misc_feature (259)..(259): n is a, c, g, or t
  modified_base (364)..(364): a, c, t, g, unknown or other
  misc_feature (364)..(364): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcatcatcgccatctctgcactggaaccagcagtgacgttggtgttatactatgtctccnggtatcaacagcaccaggcaaacgcccccaactcataatttatgatgtcagtaatcggcctgtagggtttctaatcgtcttactctggttacagttctgacaacnccggcctcctcgacctatccgtacgtgggacctccgaacgggtcgtacggacggaacggtaagggcttaggtaacttttacgttacgtcgaccgtacgtccttaccgtaattaacgttaaccgaaacgtcgaacggtaccgtacgtaccggtaaccggttcggggttaaccgtttacccggggaaaccggttacccgggggaaacccgtaacgggttacccggtaaccccgggttccccgttaaccccgtaaccggttacccgtaacccgggaaccccctaaaccgggacccccgtaaaccccccggttaaccgg

SEQ ID NO: 85548 - DNA, 578 bp, Homo sapiens
  misc_feature: GYAE6OF01CHFUX.3.28.C06.1.454.CMB.1.raw
  modified_base (310)..(310): a, c, t, g, unknown or other
  misc_feature (310)..(310): n is a, c, g, or t
  modified_base (448)..(448): a, c, t, g, unknown or other
  misc_feature (448)..(448): n is a, c, g, or t
tcagagacgcactccacgaccggtgctcgatttagagctcacgtattggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtagttataactatgtctcctggtatcaacagcaccaggacaaacgcccccaaatctataatttangatgtacagtaactccggcctgtagggtttactaagtcgtcttctcgtaggttacaagtctaggacacgacgtcctccctagacctactctacgtgggcctaccgaggtcctggacggacgaggctagtattattacngacagctatataactacgaagcagacagactacggtgggtaccttacggaaccgtcgggaacctaacggtccgtacccggttccgtaccccgtacgtaccgaccgaccccaacggaccccacccgtaccg

SEQ ID NO: 85549 - DNA, 703 bp, Homo sapiens
  misc_feature: GYAE6OF01EWN8K.3.28.C06.1.454.CMB.1.raw
  modified_base (480)..(480): a, c, t, g, unknown or other
  misc_feature (480)..(480): n is a, c, g, or t
tcagagacgcactccacgaccggtgctcgatttagagctcacgtattggggtttgggggggggtctcaggaggcagcgctctcgggacgtctccaccatggcctggctctgctattcctcaccctcctcactcagggcacgagggtcctgggcccagtctcgccctgactcacgcctgcctcgtgtctgggtctcctggacagtcgatcatcgccatcctcctgcacgtggaaccagcgagtgtacggtttggtagttaataatatcgtctcctaggtatcaacagaccaccgacggaaccaaaccgacccccaaaactactaacttaaatttatagtacttagtacagttaacgtcggtacccgttacggtaggggttttactacgttcgtctttcgtcgttacggtaacgtaagttcgtcggacctaaccgaccggtcctcccgtacgacctattctccgtcggtcctacgaggtcgnggaacgggacggtcggacttagtaattacttacgtcgacggtatacctataacgttacaaacgtacgacgaacgtcgaacggtaccgttacgggtaccgggggttacttaaccgggaaaccggtttacgggaaacccggtaacgggtccgtaaccccggtcccgttaccccgtaaccgaccggaacccggaacccgaaccgggtaacccccacccgtaacccg

SEQ ID NO: 85550 - DNA, 648 bp, Homo sapiens
  misc_feature: GYAE6OF01CYUY8.3.28.C06.1.454.CMB.1.raw
  modified_base (233)..(233): a, c, t, g, unknown or other
  misc_feature (233)..(233): n is a, c, g, or t
  modified_base (275)..(275): a, c, t, g, unknown or other
  misc_feature (275)..(275): n is a, c, g, or t
  modified_base (310)..(310): a, c, t, g, unknown or other
  misc_feature (310)..(310): n is a, c, g, or t
tcagagacgcactccacgaccggtgctcgatttagagctcacgtattggggtttggggggggtctcaggaggcagcgctctcgggacgtctccaccatggcctgggctctgctattcctcaccctcctcactcagggcacgagggtcctgggcccagtctgccctgactcagcctgcctccgtgtctggtctctggacagtcgatcatcgccatctcctgcacgtggaaaccngcagtgacgtttggtagttataactatgtctctggtatcaanagcaccagacaaacgccccaaatcaattaatttangatgtacagtaatcggaccctgacgggttctaatcgtcttctcgtcggttacaagtctaggacaacgacggtccctccgtcgaccctatccgtcgtgggcctccgaggtcgtaggacgggacggaggccgttaggtaatttaacttactcggctagtacctactaacttaagtaccgaagaccaagccgaagtccgtaacgggttcggggttaccgttaaccggggaacgtaccggggtaacccgtaacgggttcccgtaccccgggttaccgtacccccggaacgttacccggaacccgaacccccggaaccgggtaccccctaaaaccccggtccg

SEQ ID NO: 85551 - DNA, 608 bp, Homo sapiens
  misc_feature: GYAE6OF01E2XZ7.3.28.C06.1.454.CMB.1.raw
  modified_base (405)..(405): a, c, t, g, unknown or other
  misc_feature (405)..(405): n is a, c, g, or t
  modified_base (432)..(432): a, c, t, g, unknown or other
  misc_feature (432)..(432): n is a, c, g, or t
tcagagacgcactccacgaccggtgctcgatttagagctcacgtattggggtttggggggggtctcaggaggcagcgctctcgggacgtctccaccatggcctggctctgctattcctcaccctcctcactcagggcacagggtcctgggcccagtctgccctgactcagcctgcctccgtgtctgggtctccgtggacagtcgatcatcgccatctcctgcactggaaccagcagtgacgttggtggttataactatgtctcctggtatcaacacgcacccgaggaccaaacgcccccaaactcaataatttatgatgtacagtactcggccctgtagggtttctatcgtcttctctgttacaagtctgcaacgcgcctcctcgaccatctcgtcggctcgcgntcgaggacgaggctagtattattacgngtcagtcctactactaactaacgaagtacaacggaccacgtaccgtaacggttcggggttaccgttaaccgggaacgggtaccgggtaaccgtaacgggtacccgtaccccgggtccgtaccccgtaccggtacccgaaccggtaccccgaacccgggaccccaacccccgtaccg

SEQ ID NO: 85552 - DNA, 509 bp, Homo sapiens
  misc_feature: GYAE6OF01A3X68.3.28.C06.1.454.CMB.1.raw
  modified_base (375)..(375): a, c, t, g, unknown or other
  misc_feature (375)..(375): n is a, c, g, or t
  modified_base (424)..(424): a, c, t, g, unknown or other
  misc_feature (424)..(424): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaagcccccaaactcataatttatgatgtcagtaatcggccctcagggtttctaatcgcttctctgttacagtctggcacacggcctcccngaccatctcgtgggctccgaggctggacggacgaggctgtattattacngcagctcatatacagcagcagcacgtgggtctcggactgggaccaggtcaccgtcgccacgtcacgcccaaggcccaaccctacg

SEQ ID NO: 85553 - DNA, 702 bp, Homo sapiens
  misc_feature: GYAE6OF01EDHED.3.28.C06.1.454.CMB.1.raw
  modified_base (272)..(272): a, c, t, g, unknown or other
  misc_feature (272)..(272): n is a, c, g, or t
  modified_base (310)..(310): a, c, t, g, unknown or other
  misc_feature (310)..(310): n is a, c, g, or t
tcagagacgcactccacgaccggtgctcgatttagagctcacgtattggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctctgtatcaacngcaccgaggacaaaccgaccccaaatcaattaatttanagatgtactagtaactccggcctcgtagggtttactaacgtcgtcttcgtcgtagttaacagtcgtacggactaaccgaccggtcccttcccgtacgtaccctacttcccgttccggttcggggtaccttaccggagggtccgtagggaacgggtaacggtacggtacgttagttaactttaacgtttacgtcggactacggtaccttacgtaattaacgtacaacggtaccgaagtaccgtacgtaccggtacggttacggggttaccggttaccggtaaccgggtaacgggtaacccggtaacgggttaccccgtacccggttacccgtaccccggtaaccgttccgaaacccggtaccccgaaacccgggtaccccaccccgttaaccg

SEQ ID NO: 85554 - DNA, 810 bp, Homo sapiens
  misc_feature: GYAE6OF01AK7Q2.3.28.C06.1.454.CMB.1.raw
  modified_base (233)..(233): a, c, t, g, unknown or other
  misc_feature (233)..(233): n is a, c, g, or t
  modified_base (329)..(329): a, c, t, g, unknown or other
  misc_feature (329)..(329): n is a, c, g, or t
tcagagacgcactccacgaccggtgctcgatttagagctcacgtattggggtttgggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcatcgcctatctctgcacgtggaaccngcagtgacggttggtagttaataactagtcgtctccgtggtactacaacacgaccaccgaggaccaaaccgacccccaaactactaattaatttanagtatacgtactaacgtaacgtccggtacccttacggttaacggggtttacctaacgtccgtcctttaccgttacgtacggtttaacgaacgttcgtacggtacccaaccgtaccggtccccttacccgtacgacccttactccgttacggtcgggtccctacggacggtacgtacgggaacggaccggtacgggtacttaacggttaactttaacgttaccgacgtacgtacgttacctaacgtaacgttaaacgtaaccgaaacgtaccgtaaccggacgtaaccgtaccggttaaccggggttacggggtttacccggttaaaccggggtaaaccggttaaccggggtaaaccccggtaaaccgggttaccccggttacccccgggttaccccggtaacccccggttaaccggtaccccggtaacccggaaaccccccggtaaacccggaaacccccccgtaaaccccggttacccgg

SEQ ID NO: 85555 - DNA, 635 bp, Homo sapiens
  misc_feature: GYAE6OF01A3MCR.3.28.C06.1.454.CMB.1.raw
  modified_base (236)..(236): a, c, t, g, unknown or other
  misc_feature (236)..(236): n is a, c, g, or t
  modified_base (277)..(277): a, c, t, g, unknown or other
  misc_feature (277)..(277): n is a, c, g, or t
  modified_base (468)..(468): a, c, t, g, unknown or other
  misc_feature (468)..(468): n is a, c, g, or t
tcagagacgcactccacgaccggtgctcgatttagagctcacgtattgggtttggggggggtcgttcgaggaggcgagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaaccngcagtgacgttggtagttataactatgtctctggtatcaanacgcaccagacaaacgcccccaaatcaataactttatgatgtacagtaactcggccttgtagggtttctaagtcgtcttctcgttaggttacagttctgacctaaacgcgcctcctcgacactctcgtcggcctacgacggtctacggaggtacgacgggtctagttatttacttacgtgactagaccttntaaacgtacttaacgaacgtacgactacaccggacgtacgggtttcggggttaccttaccgggaaaccggttcggggaaaccgtacgggttaacccgtacccggttccgtaacccgtaccggtaccaaccggaaccccgaacccgtaaccccgtaaaccccctaacg

SEQ ID NO: 85556 - DNA, 612 bp, Homo sapiens
  misc_feature: GYAE6OF01CDBLO.3.28.C06.1.454.CMB.1.raw
  modified_base (231)..(231): a, c, t, g, unknown or other
  misc_feature (231)..(231): n is a, c, g, or t
  modified_base (351)..(351): a, c, t, g, unknown or other
  misc_feature (351)..(351): n is a, c, g, or t
  modified_base (478)..(478): a, c, t, g, unknown or other
  misc_feature (478)..(478): n is a, c, g, or t
  modified_base (485)..(485): a, c, t, g, unknown or other
  misc_feature (485)..(485): n is a, c, g, or t
tcagagacgcactccacgaccggtgctcgatttagagctcacgtattggggtttggggggggtctcaggaggcagcgctctcgggacgtctccaccatggcctgggctctgctattcctcaccctcctcactcagggcacagggtcctgggcccagtctgccctgactcagcctgcctccgtgtcctgggtctcctggacagtcgatcatcgccatctctgcactgaaccngcagtgacgttgtgtatactatgtctctgtatcgaacacgcaccagacaaacgcccaaactcataattactagtatagtacagtaactccgccctcgtacgggtttcaacgtcgtccttntacgtggttacaagttcacgcaacgaccggtcctcccgtgtacctacttcgtccgtagggcctaccgaacggtctacggaggacgtaggccttaggtactttacgtactgactagtcctatacgtanaacgtancgtacgcacgtacctaggtaccgggttctaacgggtaccgtagggtaacccgtaagggtcccctacggtccccgtaacctaacggtccgaaccgaccccggtaaaccggaccctaaccccgtaaccg

SEQ ID NO: 85557 - DNA, 542 bp, Homo sapiens
  misc_feature: GYAE6OF01APWJ8.3.28.C06.1.454.CMB.1.raw
  modified_base (232)..(232): a, c, t, g, unknown or other
  misc_feature (232)..(232): n is a, c, g, or t
  modified_base (307)..(307): a, c, t, g, unknown or other
  misc_feature (307)..(307): n is a, c, g, or t
  modified_base (458)..(458): a, c, t, g, unknown or other
  misc_feature (458)..(458): n is a, c, g, or t
  modified_base (503)..(503): a, c, t, g, unknown or other
  misc_feature (503)..(503): n is a, c, g, or t
tcagagacgcactccacgaccggtgctcgatttagagctcacgtattggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacgttggtgttatactatgtctcctggtatcaacagcacccaggcaaacgccccaaactcataatttangtatcgtacagtaactcggccctgtagggttactaatcgcttctcgtaggttacagtctaggcaacgaccggcctccctcgacccatcctcgtcgggtcctccgacggctaggacggacggaggcgttagattatactgcatctacataanacaagcagcagcgacgtgggtcttacggacgtgggaccaggttcnccgtccgcccacgtcaccgaccaccggccccaacccgtc

SEQ ID NO: 85558 - DNA, 721 bp, Homo sapiens
  misc_feature: GYAE6OF01AQDDB.3.28.C06.1.454.CMB.1.raw
tcagagacgcactccacgaccggtgctcgatttagagctcacgtattgggtttggggggggtctcaggaggcagcgctctcgggacgtctccaccatggcctggctctgctattcctcaccctcctcactcagggcacaggtcctgggcccagtctgccctgactcagcctgcctccgtgtctgggtctcctggacagtcatcatccgcattctcctgcaactggaaccagccagtgacgttggtgttataactatgtctcctgtatcaacagcaccagaccaaacgcccccaaactctaacttaaatttatagtatgtactaagtaacgtccggcctacgtagggttttactaactccgtcttacgtcgtacgttacagtctcgacaacgcgtcctcctgacctactctcgtggtcctacgacgtcgtacggacggacgtaggtccgttagttaactttatttaaccgtcggaccttacgtaccgtaccgttaaataacgttaaaccgaacgtacgtaaaccggcctaaacggtaccgtaacccgggtttaccggggtttaccggtttaaaacccgggtaaaccggggtaccggggtaaaacccggtaaacccggggttccccgtaaacccccgggtttcccgtaaccccccgtaccggttaacccgtacccgggtacccccggaaacccgggaaacccccttaaacccccgtaacccgg

SEQ ID NO: 85559 - DNA, 660 bp, Homo sapiens
  misc_feature: GYAE6OF01DK3BG.3.28.C06.1.454.CMB.1.raw
  modified_base (234)..(234): a, c, t, g, unknown or other
  misc_feature (234)..(234): n is a, c, g, or t
  modified_base (277)..(277): a, c, t, g, unknown or other
  misc_feature (277)..(277): n is a, c, g, or t
  modified_base (319)..(319): a, c, t, g, unknown or other
  misc_feature (319)..(319): n is a, c, g, or t
tcagagacgcactccacgaccggtgctcgatttagagctcacgtattggggtttgggggggggtctcaggaggcagcgctctcgggacgtctccaccatggcctgggctctgctattcctcaccctcctcactcagggcacgagggtcctgggcccagtctgccctgactcagcctgcctccgtgtctgggtctcctggacagtcgatcatcgccatcctctgcactggaaccngcagtgtacggttggtgttataactatcgtctctggtatcaangccaccaggaccaaacgtcccccaaatcattaaactttaganactgtacaagtaacgtccggccctacgtagggtttactaagtccgtacttcgtcgttaggttaacgtaagtcgtaggaccaaacgtcccggtccttacccgtcgtaactactctcggtgggacctccgaggctaggaggacgagtcagtattagtacgtgctagcacgtataacacgaacgacagaacgacggtactaacgggttcgggggtttaccaaccggggttaaacgtaccgggtaaacccgttaaaggggttcccgtaaaccccggttcccgtccccgtaaaaggtccccgaacccggtacccccaaacccggggtacccccaaacccctaccgg

SEQ ID NO: 85560 - DNA, 743 bp, Homo sapiens
  misc_feature: GYAE6OF01CA3KL.3.28.C06.1.454.CMB.1.raw
  modified_base (318)..(318): a, c, t, g, unknown or other
  misc_feature (318)..(318): n is a, c, g, or t
tcagagacgcactccacgaccggtgctcgatttagagctcacgtattggggtttggggggggtctcaggaggcagcgctctcgggacgtctccaccatggcctggctctgctattcctcaccctcctcactcagggcacgagggtcctgggcccagtctcgccctgactcagcctgcctcgtgtctgggtctctggacagtcgatcatccgccatcctcctgcacgtggaaccagcaggtgacgttggtagttaataactatgtctctgtatcaacagcaccaggacaaaccgaccccaaaactcaacttaatttaangtatgtacaagtaactccggtccctaggtacgggtttactaactcgtctttctcgttacggttactaacgtcgtacggtacaacgaaccggtccctacccgtcgaaccctacgttcgtcgtcgggccttcgaacggtcgtagggaacggtaacgacggtctagtaacgtttaattacgcgtacacggtactacgtaattaacgttaaccaaagggctaacggaccgaaggtaccttaacggggttcggggtttaacccgttaccggggaaaacccggttcgggggaaaacccgttaaaccgggggtaccccttaaacccccggggtacccggtttaaccccccgtaaacgggtttaccccgaaccccgggtaaacccccgtaaaccccgggtaaacccccccgtaaaacccccgttaaaccccgg

SEQ ID NO: 85561 - DNA, 875 bp, Homo sapiens
  misc_feature: GYAE6OF01DY1X1.3.28.C06.1.454.CMB.1.raw
tcagagacgcactccacgaccggtgctcgatttagagctcacgtattggggtttgggggggggtctcaggaggcagcgctctcgggacgtctccaccatggcctggctctgctattcctcaccctcctcactcagggcacgagggtcctcgggcccagtctcgccctgacctcacgcctcgccctccgtgtcgtcgggtctccgtggacagtcgatcactccgcctatcctcctgacctaacgtacggaaaccagcgtaggtcggtacggtttggttaggtttaactaactagttcgtccttccgttaggtactaccaacgacgaccacccgacggaccaaacccgacccccaaactactaaatttaaactttagtacgtagtacgtaccgtaagttaaccgtcccgggttacccttacgggttaacggggttttactaacgttccgttactttaccgttacgttaacggttaccgtaaaccggtcccggtaaccgtaacccggtaccccggtaccccttacccgtacgtaacccgtacgttcccgttccggttcccgggtacccttacccgggagggttaccggacgggtaaacggggtaccggtaggggttaccttaacggtttaattttaacccgttaccgtacggtaccgtaaccggttactaacgtaacttaacgtaaacgaacgcgtaaccggacgtaacgtaccggttaccggggtttacggggttccgttaaccggggtaaccgggtaaccgggtaacccggttaaccggtacccggttacccggtacccgtaccccggtaacgaccccgggtaaacccggaccccggtaaaccccgtaacccccgtaaccccgttacgtaccccgg

SEQ ID NO: 85562 - DNA, 677 bp, Homo sapiens
  misc_feature: GYAE6OF01AQTID.3.28.C06.1.454.CMB.1.raw
  modified_base (230)..(230): a, c, t, g, unknown or other
  misc_feature (230)..(230): n is a, c, g, or t
  modified_base (254)..(254): a, c, t, g, unknown or other
  misc_feature (254)..(254): n is a, c, g, or t
  modified_base (269)..(269): a, c, t, g, unknown or other
  misc_feature (269)..(269): n is a, c, g, or t
  modified_base (307)..(307): a, c, t, g, unknown or other
  misc_feature (307)..(307): n is a, c, g, or t
tcagagacgcactccacgaccggtgctcgatttagagctcacgtattggggtttggggggggtctcaggaggcagcgctctcgggacgtctccaccatggcctgggctctgctattcctcacctcctcactcagggcacagggtcctgggcccagtctgccctgactcagcctgcctcgtgtctgggtctcgtggacagtcgatcatcgcctatctctgcactggaaccngcagtgacgttggtagttatatangtctctgtatcaacncgcaccgaggacaaccgacccctaatcaattaatttancgagtcgtactagtaacgcggtcccttaggtacgggttactaagtccgtactttacgtcgttacggtactaagtcgtacggactaaccgaccggtcctcccgtacggtacctagttcccgtacggtcgggtacctccgtacgggtcttaacgggacggacggttaacgggtcttacggttaaagtttaccgttaacgtcggtactaacgtaccgtaactaacttaaccgtaccaaacgggcctacggtacgaacgggttacgacgtttacgggggtccttaaacgggaacggtcgggtaaaccttacgggtcgtacccggtaccgtcccgaacgtccgaaccggtacccgaaccgaccccgtcctaacgg

SEQ ID NO: 85563 - DNA, 672 bp, Homo sapiens
  misc_feature: GYAE6OF01BMZO2.3.28.C06.1.454.CMB.1.raw
  modified_base (230)..(230): a, c, t, g, unknown or other
  misc_feature (230)..(230): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgcatctcctgcactggaaccngcagtgacgttggtgttatactatgtctcctgtatcaacagcaccaggacaaacgcccccaaatctataatttatgatgtacagtaactccggccctcgtagggtttctaatcgtacttctcgttaggttactaacgttctacggaccaaaccgacccggtcccttacccgtacgtaccctacttccgtcgtcgggtcctaccgacggtcgtacggaacgggacggacgggtcctaggttaactttacgttacctgctacgtcttactaataactaacgaacgtacacgtactacggacgtacgggttcggggttaccgttaaccggggaaaccggttcgggaaacccggtaagggtccccgtacccggttccccggtaccccgtaaccggtaccgaccggtaaccccggaaaccggtaccccccgtaaaccccgtacccgg

SEQ ID NO: 85564 - DNA, 638 bp, Homo sapiens
  misc_feature: GYAE6OF01C50H5.3.28.C06.1.454.CMB.1.raw
tcagagacgcactccacgaccggtgctcgatttagagctcacgtattggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcatcgccatctcctgcactggaaccagcagtgacgttggtgttataactatgtctctggtatcaacagcaccaggcaaacgccccaaactcattaattatgatgtctaagtaactccggcctagtacgggtttctaacgtcgtccttctacttaggttaacaagttctcggacaacgacggccctacctcgaacctatccgtcgttcgggactccgaggctaggtacggacgacggtcgttagtatttaatacgtgtacgacgtctactaattaactaacgaagacgagcgtaagcgtaacggtcggggttaccttaccgggaacgttacggggaacccgtaagggttccctaacccgggttacccgttccccgaaccggttccaaacccggaccccgtaaaccgggacccccttaaaccccgaacccggg

SEQ ID NO: 85565 - DNA, 795 bp, Homo sapiens
  misc_feature: GYAE6OF01AF04B.3.28.C06.1.454.CMB.1.raw
tcagagacgcactccacgaccggtgctcgatttagagctcacgtattgggtttggggggggtctcaggaggcagcgctctcgggacgtctccaccatggcctgggctctgctattcctcaccctcctcactcagggcacgagggtcctgggcccagtctgccctgactcagcctgcctcgtgtcgtggtcctccgtggacagtcgatcacgtccgccatcctcctgcctacgtcgggaaccagccgtaggtcggtacggttgggtagttaataacgttagtcgtcctccgtaggtactacgaacgtacgaccgacccgacggaaccaaacccgacccccctaaatacctaatttaactttagtacgtagtacgtaccgtaacgttaacgtccccggtcccgttaaggttaacgggtttactaacgtaccgtcgttaccttacggttacggttaacgtacggttccgtaaggacccgtaaccgtacccggtacccttcccgtaccgtaccttaccgttccgttacgggtaccggtccgtaccgggacgggtacgtacgggtaacgggtacgggtaccgtcgttacgtttaaacgtttacgtacgtcggctaacggtcctaacgtaaactaacgtaacgaacgtccgtaacgaccgttacgaccgggttcgggttaaccgggttaccggtaaccgggtaaccggtacccgggtacggtacccggtacccgtacccggtaccccgtacccgtacgtacccggacccggtacccggaaccccgtcccctaaccggtccg

SEQ ID NO: 85566 - DNA, 749 bp, Homo sapiens
  misc_feature: GYAE6OF01DGC0T.3.28.C06.1.454.CMB.1.raw
  modified_base (244)..(244): a, c, t, g, unknown or other
  misc_feature (244)..(244): n is a, c, g, or t
tcagagacgcactccacgaccggtgctcgatttagagctcacgtattggggtttgggggggggtctcaggaggcagcgctctcgggacgtctccaccatggcctgggctctgctattcctcaccctcctcactcagggcacgagggtcctgggcccagtctcgccctgactcacgcctgccctccgtgtcgtgggtcctccgtggacagtcgatcactcgccatcctcctgccacgtggaaccngcagtggacgttggtcgtaataactatgtctcgtagtatcaacagccaaccgacggaccaaaccgacccccaaactactaaacttaagtttactagtattagtacaagttaacgccggtaccgtgttacgggttactagtccgtacttacgtcgttacggttaacaacggttcgtacggtaacgtaaccctaccggtccccttacccgtaacgtacccttaagtccgttaccggtcgggtaccttaccgggaggtacccgttaagggtaacgggaacccgggtacgggtacgttaacgttaacgttttaacgttaccgtacgggaacctacggtaccttacgtaaactaacgttaacgtaaacgcgaaaccggtcaacgtccggtaacggttcggggttaaccggttacgggtaacccggtacgggtaaaccgtaccgggtacctccccggttaccgtaccgaccgttaccgaaccgaccccggaaccggacccaacccgtaccg

SEQ ID NO: 85567 - DNA, 785 bp, Homo sapiens
  misc_feature: GYAE6OF01E5L2B.3.28.C06.1.454.CMB.1.raw
  modified_base (236)..(236): a, c, t, g, unknown or other
  misc_feature (236)..(236): n is a, c, g, or t
tcagagacgcactccacgaccggtgctcgatttagagctcacgtattggggtttggggggggtctcaggaggcagcgctctcgggacgtctccaccatggcctgggctctgctattcctcaccctcctcactcagggcacgagggtcctgggcccagtctgccctgactcagcctgcctcgtgtcgtcgggtctccgtggacagtcgatcatcgccatctcctgcacgtggaaccngcagtgacgttggtagttaataacagtcgtctcgtggtactacaacacgaccaacccgaggaaccaaacccggacccccctaaaatactaattaaactttagtaggtacttacgtacgtaacggtaaccgtcccgggtcccgttacgggttaacggggttttactaaacgttccgttacctttaccgttacgttacggttaaccgaaggttccggtacggaaccctaaaccggtacccggtcccttacccgtagaacccttagttccgtccgtcgggtacctaccggtaggtcgtaagggaacgggaacgggttaacggtcttaagttaacgttttactaccgtggactaacggttacctacgtaacttaacgtaaccgaacgtacgaacgttacgaacggtacggttaccgggtttcggggttaccgttaaccgggaaccgggttacggaacccgtaacgggtcccggtaaacccggttcccgaaaccccgtacggtaccgaaccccggtaacccgaacccggtaacccccgtaaaccccgttaccgg

SEQ ID NO: 85568 - DNA, 576 bp, Homo sapiens
  misc_feature: GYAE6OF01BAYXS.3.28.C06.1.454.CMB.1.raw
  modified_base (369)..(369): a, c, t, g, unknown or other
  misc_feature (369)..(369): n is a, c, g, or t
  modified_base (399)..(399): a, c, t, g, unknown or other
  misc_feature (399)..(399): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggacaaacgcccccaaactcaactaatttatgatgtcagtaatcggccctcgtagggttctaatcgcttctctgttacagtctgcacncgcctcctcgacactctcgcggtcctccgnggcgtgacggacggaggctagtactttattacgtgcacgtctacataatacaagcaggacacgacgtacggtggggttaccgttacgggaaccggtacgggaaccgtaggtacccgtacccggtccgtaccccgaccggtccaaccggaccccgaacggccccgaaacccccgtacg

SEQ ID NO: 85569 - DNA, 754 bp, Homo sapiens
  misc_feature: GYAE6OF01DOGLB.3.28.C06.1.454.CMB.1.raw
tcagagacgcactccacgaccggtgctcgatttagagctcacgtattggggtttgggggggggtctcaggaggcagcgctctcgggacgtctccaccatggcctgggctctgctattcctcaccctcctcactcagggcacagggtcctgggcccagtctgccctgactcagcctgcctccgtgtctggtctcctggacagtcgatcatcgccatcctcctgcacgtggaaccagcagtgtacggttggtggttaataactatgtctctggtatacaacagccaaccgaggaccaaacgacccccaaactctaattaatttactgattgtacaagttaacgtccggcccttacgtagggttttactaagttccgtactttcttcgttacggttaactaaggttcgtacggacctaaccgacccggtccctacccgtacgaaccctataccgttccgtcgggtccctccgagggtcgtacggaacgggaacgaggtctaagttaactttacgttacgtcggtactacgtaccttacaacgttaacttaaccggaaacgtacgacgtacgaacggtaccgtaacgggttaccggggtttaccggttaacccggggtaaacggtacgggggtaaaaccccgtaacggggtttaccccggttaaacccgggtcccccggttaaccccgtaacccgggtaccgtaacccggttacccggtaacccggaaaccccgggtaaccccctaaaaccccccggg

SEQ ID NO: 85570 - DNA, 694 bp, Homo sapiens
  misc_feature: GYAE6OF01B8MWW.3.28.C06.1.454.CMB.1.raw
  modified_base (244)..(244): a, c, t, g, unknown or other
  misc_feature (244)..(244): n is a, c, g, or t
tcagagacgcactccacgaccggtgctcgatttagagctcacgtattggggtttggggggggtctcaggaggcagcgctctcgggacgtctccaccatggcctgggctctgctattcctcaccctcctcactcagggcacagggtcctgggcccagtctcgccctgactcagcctgcctccgtgtcgtgggtcctcctggacagtcgatcatccgacctatcctcctgacctacgtggaaaccngctaggtgtacggttggtagttaataactatcgtctcgtaggtactacaacacgaccaccgaggaccaaaccgacccccaaatctaattaattactagtacttagtactaagttaacgtccggtaccccgtacgttaacgggttttactaacgtttcgtttcgtacgttaggttaacctagtacgtacggacaaccgtccggtaccctacctacgacctactccgtcgtcggtcctacgacggtacgtagggacggaccggtagtcgttagttaactttacgttaccgtcgactacgtacttacaattaactaacgaacgctaagaccacggtaccgtacgggttacggttacgtaccgggaaacggtaccggaacgtacggttacccgacccggttccgtacccgacgtaccgacccgacccgaacccgaccccaacccgtcgtacccg

SEQ ID NO: 85571 - DNA, 966 bp, Homo sapiens
  misc_feature: GYAE6OF01AE88B.3.28.C06.1.454.CMB.1.raw
tcagagacgcactccacgaccggtgctcgatttagagctcacgtattgggtttggggggggtctcaggaggcagcgctctcgggacgtctccaccatggcccgtggctcgcgtcttacttccctaccctaccccttccctacctacctacggacgggaccaacgggtaccgggttccgggtccgggacccgtacgttccgtcccgtcccgtacgtacctacgaccgtccgtccgtccccgttccggttcggttcgggttcggttcccgttccggtacggaacgtacggtacgtactactacgtcccgacctaccttcccttccgtcgaccgtacggtaaccggaaccgacgacgtaggtacggttacgggtttgggtttaacgttaaacttaacgttgttccgttcccgttcggttagtacctaaccgaacgaccgaccccaaccggacggaaacccaaacccccgaaccccctaatacttaaatttaattgagtacttacgaacgtaagttaccggtccccgtaccgttaggggtttaacggtttaacctacgtccgttccttacgttacggttaacgttaaccgtcggttccggtacgaaccctaacccgggtccccgttcccctaccggtaacctaccttcgttccggtcgggtccgtacccgtacggacggttcgaaggggaaccggtacggtcgttagtagttttaacttaccgtcgacggtacctacgttaccctaagttaacgtaaccgtaaacggaaccgtaggtaaccgaccgggttaaccggtaccgggtttacccggggggtttcgggtttaacccgtaaaacccgggggtacgggtaaacccggggtaaaccggttacccgggttacccccgttacccgggttaccccggaaccccgtagtaacccccgggaccccgtaaacccgggaacccgttaaccctccccgttacccgg

SEQ ID NO: 85572 - DNA, 772 bp, Homo sapiens
  misc_feature: GYAE6OF01DBCAX.3.28.C06.1.454.CMB.1.raw
  modified_base (202)..(202): a, c, t, g, unknown or other
  misc_feature (202)..(202): n is a, c, g, or t
tcagagacgcactccacgaccggtgctcgatttagagctcacgtattggggtttgggggggggtctcaggaggcagcgctctcgggacgtctccaccatggcctgggctctgctattcctcaccctcctcactcagggcacgagggtcctgggcccagtctgccctgactcagcctgcctccgtgtctggtctccgtggacngtcgatcatccgccatctcctgctacgtcggaaccagctagtggtacggtttggtaggttaactaactatgtctccgtgtatacaacgagaccaccgaggaaccaaaccgaccccctaaaactctaaactttaaatttacgtagtattcgttaacaacgtaacgttcccggacccttagggttacgggttttactaacgttccgttcttaccgttacgtttacggtaacgtaagtcggtacgacctaaccgtaccggtacccttccgacgacctacgtcgtcgtcgggcctacggtacggtcgtacggacggacgtacggtacgttagtaactttacgttacgtacgactacgtctaacgttactaacgtaaccgaaggtaccgaacggtacgaacggtccggttaacggggttcccgggggttttaaccgtaaccggggttaaccgggtaaaccgggggtacccgttaaaccgggtccccggtaccccggtaccgggttaccccgtaaccggaacccgtaacccgggaaccccggtaaaacccggtaacccccaaccccggtttaaccg

SEQ ID NO: 85573 - DNA, 804 bp, Homo sapiens
  misc_feature: GYAE6OF01EMPLV.3.28.C06.1.454.CMB.1.raw
  modified_base (239)..(239): a, c, t, g, unknown or other
  misc_feature (239)..(239): n is a, c, g, or t
tcagagacgcactccacgaccggtgctcgatttagagctcacgtattggggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcatccgctatcctcctgacctacgtcggaaccngacaggttcggtacggtttggtaggttaataacttatcgtctcgtaggtactacaacacgaccaccgaggaccaaaccgaccccctaaactacttaagtttaaactttacgtagtaacttcggtaactaacggttaaccgtccgggtaccccgttagggttaacggggttttacctaacgttccgttacgtttcttaccggttacggttaactaacggttccgtaacggaccgtaaacccgtacccgggttccctaccccgtacgtaaccccttagttcccgttacggttccgggtacctacccggtaagggccgttacgggaacgggtacggtaaggttcgttaagttaattttacgttaacgtgactacgtacttacgtaactaagtaacccgagtcccgtaagaccgacggtaaccgttacggggttaccgggttaccgttaaccggggtaaaccggttacggggaaacccgtaaccgggttcccgtaacccggtcccgttaacccggtaaccggtaccgaacccggtaaccccgaaccggtaacccccaacccgttaaccg

SEQ ID NO: 85574 - DNA, 634 bp, Homo sapiens
  misc_feature: GYAE6OF01B3MB7.3.28.C06.1.454.CMB.1.raw
  modified_base (232)..(232): a, c, t, g, unknown or other
  misc_feature (232)..(232): n is a, c, g, or t
  modified_base (271)..(271): a, c, t, g, unknown or other
  misc_feature (271)..(271): n is a, c, g, or t
  modified_base (303)..(303): a, c, t, g, unknown or other
  misc_feature (303)..(303): n is a, c, g, or t
  modified_base (310)..(310): a, c, t, g, unknown or other
  misc_feature (310)..(310): n is a, c, g, or t
tcagagacgcactccacgaccggtgctcgatttagagctcacgtattgggtttggggggggtctcaggaggcagcgctctcgggacgtctccaccatggcctggctctgctattccctcaccctcctcactcagggcacagggtcctgggcccagtctgccctgactcagcctgcctccgtgtctgggtctccgtggacagtcgatcatcgccatctcctgcactggaaccngcagtgacgttggtgtataactatgtctctgtatcaacngcaccaggacaaacgccccaaatcataattangatgtanagtaatccggtacctacgtacgggtttactaattcgtcttctcgttaggttacaagtcgtagacaacgccggtcctccctacgacctactcctcgtcggcctccgaggccgtaggaacggacggaaggtctaggtaatttacttacgtgactaagtctacaattaagtaacaagtacgagtacagtacgacggttggggttccttaccgggaaaccggtcgggtaaaccctaaagggtcccttaaacccggggtcccgttaaccccgacggttaccgaaccggaacccccggtaaacccggtacccccgtaaaccccgtaccgg

SEQ ID NO: 85575 - DNA, 650 bp, Homo sapiens
  misc_feature: GYAE6OF01BMLKE.3.28.C06.1.454.CMB.1.raw
  modified_base (282)..(282): a, c, t, g, unknown or other
  misc_feature (282)..(282): n is a, c, g, or t
  modified_base (326)..(326): a, c, t, g, unknown or other
  misc_feature (326)..(326): n is a, c, g, or t
  modified_base (445)..(445): a, c, t, g, unknown or other
  misc_feature (445)..(445): n is a, c, g, or t
tcagagacgcactccacgaccggtgctcgatttagagctcacgtattggggtttggggggggtctcaggaggcagcgctctcgggacgtctccaccatggcctgggctctgctattcctcaccctcctcactcagggcacagggtcctgggcccagtctgccctgactcagcctgcctccgtgtcgtggtctcgtggacagtcatcatccgcatctcctgcacgtcggaaccagcagtcggtacgttggtagttaataactatcgttctctaggtatacaanacgaccaccgagaccaaaccgaccccaaatactaataatttagngtatggtactagtaacgtccgtcctagtacgggtttacagtacgtcttctcgttagtactagtctacggaccaacctccgtcctccgtacgtacctacttcgtcgtccggtcctaccgnggtactagggacggacggtacggcgttaagtactttactttacgacgtcgtacgtccttaagtaagtaactaacgaacgtcgacggactaacggtcgtaacgggtcggttacgtaacggtaacggtacggtaaccgtacgggaccttcccgggtacctaccccggtagtcccaacgtacccggaacctaccccgtacccgtaccg

SEQ ID NO: 85576 - DNA, 727 bp, Homo sapiens
  misc_feature: GYAE6OF01EKTGO.3.28.C06.1.454.CMB.1.raw
tcagagacgcactccacgaccggtgctcgatttagagctcacgtattggggtttgggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcatccgcatctcctgcacgtaggaaccagcagtgtacgttggtagttaataactatgtctccgtgtatcaacagcaccagacaaacgccccaaactcaattaattatgatgtactagtaactccggtaccctcggtacgggtttactaagtccgtcttcgtcgttaggttaacaagttcgtaggacaaccgaccggtcccttaccctcgaccctagttccgtacgtccgggacctccgagggtcgttacgggaacgggtaccggaggtcgttaagttaatttaacgttacgtcggaccgtacggtaccctataacttaacgtaacgaaacggtacctaacggaacacgggtacccgtaacgggttccggggtttaaccgtacccgggtaaaccgggttacggggaaacccgttaaccggggtaccccgttaacccggttccccggttaacccgtaacccgggtcccgaaacccggaacccccggaaaccccgggtaccccctaaacccccggttaacccgg

SEQ ID NO: 85577 - DNA, 844 bp, Homo sapiens
  misc_feature: GYAE6OF01DNT11.3.28.C06.1.454.CMB.1.raw
  modified_base (199)..(199): a, c, t, g, unknown or other
  misc_feature (199)..(199): n is a, c, g, or t
  modified_base (232)..(232): a, c, t, g, unknown or other
  misc_feature (232)..(232): n is a, c, g, or t
tcagagacgcactccacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctcgccctgactcagcctgcctcgtgtctgggtctctggacngtcatcatcgccatcctcctgcacgtggaaccngcagtgacggttggtgttaataactatgtctcgtgtacacaacagaccaccgaggacaaaccgacccccaaactactaattaaactttatagatgtactaagtaacgtccggtcccgtacgttacgggtttactaacgttaccgtctttcgttcgttacggttaacaacgttcgtacggaacctaaaccgtacccgggtccccttaccccgtacgtaacccttacttccgttccggtcgggtacccttaccggacgggtccgtacgggaaacgggaccgggtacggtacgttaggttaaacttttaacttaaccgtcgtacgacggttacctaacgtaaacttaacgtaaaccgaacggtaaccaacggtacctaaccggtaccgttaaccggggtttaccggggggtttaaccctttaaacccgggggtaaaccggggttaacccggggtaaaaccccggtaaaacccgggggtttaccccgtaaccccccgggtttaaccccccgggttaacccccggtaaaccccggtttaacccccgggaaaaccccgggtaccccccggtaaaaaccccggggtaacccccccctaaaaccccccggttaaccccgg

SEQ ID NO: 85578 - DNA, 657 bp, Homo sapiens
  misc_feature: GYAE6OF01CQGVG.3.28.C06.1.454.CMB.1.raw
  modified_base (237)..(237): a, c, t, g, unknown or other
  misc_feature (237)..(237): n is a, c, g, or t
  modified_base (318)..(318): a, c, t, g, unknown or other
  misc_feature (318)..(318): n is a, c, g, or t
tcagagacgcactccacgaccggtgctcgatttagagctcacgtattggggtttggggggggtctcaggaggcagcgctctcgggacgtctccaccatggcctgggctctgctattcctcaccctctcactcagggcacgagggtcctgggcccagtctgccctgactcagcctgcctccgtgtcgtgggtcctcgtggacagtcgatcatccgctatcctctgccacgtggaaccngcaggttgacggttggtagttaataactatgtctctggtactcaacagcaccagaccaacgaccccaaatacattaattangtatgtactagtaactcggcctagtacgggttataacgtcgtcttctcgtaggttactaagtctcggacaaccgtaccggtcctcccgtgaccctattcctaccggtcggtccgttaccgagggtcgtacgggaacgggaacggacggtacgtagttactttaagttaccgtagacgtacgtcctataacgtactaacgtaacgcgacgacgacgtcgtacggttcgggttaccgttacgggtacggtacgggaacccgtaacggttacccgtacccggtaccggtacccgaccgttaccgaaccggtaccccaaccggtaccccgaaaccccttacgg

SEQ ID NO: 85579 - DNA, 821 bp, Homo sapiens
  misc_feature: GYAE6OF01DKWSZ.3.28.C06.1.454.CMB.1.raw
  modified_base (202)..(202): a, c, t, g, unknown or other
  misc_feature (202)..(202): n is a, c, g, or t
  modified_base (348)..(348): a, c, t, g, unknown or other
  misc_feature (348)..(348): n is a, c, g, or t
tcagagacgcactccacgaccggtgctcgatttagagctcacgtattggggtttgggggggggtctcaggaggcagcgctcgtcgggacgtctccaccatggcctgggctctgctattcctcaccctctcactcagggcacagggtcctgggcccagtcctgccctgactcagcctcgcctccgtgtctggtctcgtggacngtcgatcatcgctatccgtcctgacacgtacggaaccagtacgaggtggtacgtttgggttagttaataactatcgtctcgtagtactacaacgacgccaccgaaggaccaaaccggaccccctaaatacctaattaaacgtttanagtactgtacgtaagtacgtccggtacctaggtacggttactactcgtcttcgtagtacgtactaggtcacggtaactaaccgccggtcccttaccgtacgtaccgtacttccgtacggtaccgggtccgtaccggtcggtaccggttagggaaccgggtacgtacgggttaccgttaggtttaaccttttaaacggtccgttacggtaacccgtacggttaccctaacgtttaacggtaaaacttaaccgaaaccggtacggaccgtaaccgggtaacgggttaccgggttaccggggttaaccggggtttaccggaaacccggggttaaacgggttaaaccccggggtaaccgttaaccggggtaaccccgttaccccccggttaacccgggtacccccgtaaccgggttaaacccgacccgggttaacccccgaaaccccggtaaacccccccggtaccttaaccccggg

SEQ ID NO: 85580 - DNA, 829 bp, Homo sapiens
  misc_feature: GYAE6OF01APVXO.3.28.C06.1.454.CMB.1.raw
  modified_base (274)..(274): a, c, t, g, unknown or other
  misc_feature (274)..(274): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacngcaccaggacaaacgccccaaactcataattatgatgtcagtaactccggacctcgtacgggtttctaacgtcgtcttctacgtacggttaacaaggttctacgggacctaaaccgtaccggtccccttacccgtacggtaccctaagttccgttaccggttacgggggtccccttaccccggtaggggtaccgttaacggggaaccggggtaaccggtacgggggtaacctttaagggttaaaccttttaacgttttaaaccggttacggacccgttaacgggttaccctttaaccgtaaagttttaaaccgttaaccgaaacgggttacccgaagggttacccaaaccgggttacccggttaacgggttccgggggggttaaccctttaacccggggtaaaacccggttaccgggggtaaaccccgtaaaccggggtttccccgtaaaccccccggggtttcccggtttaacccccggaaaccccgggttaccctaaacccgggtaaccccccggaaaacccggggtccccctaaaaccccccgttaaccggg

SEQ ID NO: 85581 - DNA, 751 bp, Homo sapiens
  misc_feature: GYAE6OF01D8O1F.3.28.C06.1.454.CMB.1.raw
  modified_base (396)..(396): a, c, t, g, unknown or other
  misc_feature (396)..(396): n is a, c, g, or t
  modified_base (595)..(595): a, c, t, g, unknown or other
  misc_feature (595)..(595): n is a, c, g, or t
  modified_base (638)..(638): a, c, t, g, unknown or other
  misc_feature (638)..(638): n is a, c, g, or t
tcagagacgcactccacgaccggtgctcgatttagagctcacgtattggggtttggggggggtctcaggaggcagcgctctcgggacgtctccaccatggcctggctctgctattcctcaccctcctcactcagggcacgagggtccgtggcccagtctgccctgactcacgcctcgccgtccgtgttcgtcgggtcctccgtggactacggttcatcatccgctacttcctcctgaccacgtacggaaccaggctaggtcggtacggtttggttagttaacttacgtagtcgtccgttccgttaggtactacgaacgtacgccgaaccgaggacccaaaaccggtaccccctaaactactaaatttaactttcagtactgtacgtaacgttaacnccggtaccttacggttacgggttaaccttacgtaccgtcctttacgttcgttaaggtaactaccggtcgtacggacccgaaacccgtacccgtaccttacccgacgtacccgttcgttaccgtaccgtccgggtacctccggacggtagaccgggtaagggacccggtacgttacgtaccgtttaattaacgttacggntacgtccgtaactagtaacgttaacgactaggaaccttaacgngaccgtacgttcgggtacggtttaccgaccgggtaaacgttcgaaccggtacgtaccgcccggttaccaccgtaccgtcgaaccgaccccgtaacccgtaacccgtactaccg

SEQ ID NO: 85582 - DNA, 519 bp, Homo sapiens
  misc_feature: GYAE6OF01BG0K3.3.28.C06.1.454.CMB.1.raw
tcagagacgcactccacgaccggtgctcgatttagagctcacgtattgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaagcccccaaaactccataactttatgatgtcagtaatcggccctcaggggtttctaatcgcttctctgttacaagtctggcaacacggcctcctgaccatctctgggcctccgaggcctggacggacgaggctggatttattactgcagctcatatacaagtcagcagcacgtgggtcttcggaactcgggacaggtcaccgtcgtcccacgtcacgcccaagcccacccgtac

SEQ ID NO: 85583 - DNA, 782 bp, Homo sapiens
  misc_feature: GYAE6OF01CMCM2.3.28.C06.1.454.CMB.1.raw
  modified_base (200)..(200): a, c, t, g, unknown or other
  misc_feature (200)..(200): n is a, c, g, or t
tcagagacgcactccacgaccggtgctcgatttagagctcacgtattggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcatcgcatctcctgcacgtggaaaccagcaagtgacggttggtaggttaataactatgtctcctggtatacaacagcaccgaggcaaaacgacccccaaactcaacttaaagttatagacttgactagtaaagtccggccctacgtaggggtttactaagttccgctttccgtcgttacggtttacaaaggttccgtacggtaaccaaaccgtacgggccccttacccgttacggaaccctaagttccgttacgtacgggtccgttaccgaacggggcccgttagggaacggtaaccgggacgggtcttaaggtaacgttttaacgtttaccgtagggtaccaaggtacccttacgttaaactaacgttaaacccgaaaagtccgaacgtaaccgaacggtacctaaccgggtttacgggggtaacccgtttaccggggaaaaccggtttacggggaaaccccggttaaaccgggaacccgttaaccccggttaaccccggttccccttaaaccgggttcccaaacccgggaccccgtaaaaacccgggtaaccccctaaacccccgttaaaccgg

SEQ ID NO: 85584 - DNA, 658 bp, Homo sapiens
  misc_feature: GYAE6OF01DRYC4.3.28.C06.1.454.CMB.1.raw
  modified_base (238)..(238): a, c, t, g, unknown or other
  misc_feature (238)..(238): n is a, c, g, or t
tcagagacgcactccacgaccggtgctcgatttagagctcacgtattggggtttgggggggggtctcagggaggcagcgctctcggggacgtctccaccatggcctgggctctgctattcctcaccctcctcactcagggcacagggtcctgggcccagtctgccctgactcagcctgcctccgtgtctgggtcctccgtggacagtcgatcatcgccatcctcctgcactggaaccngcagtgacgttggtagtataactatgtctctgtatcaacacgaccaccaggaccaaaccgaccccctaaactactaattaatttagtgtaatcgtacaagtaacgtccggaccctgtacgggtttactaactcgtcttctctaggttacaagtctggacaacaccggacctcccgtagaaccctagttcctcgtcgggtcctccgtacggtcgtaggaacgggacggtacggtacgttagtaactttaacgttacgtgtaccgacgtctaactaataacgaacgtaacacgtacgactacggacgtacgggttcgggttacgttaccgggaacggttacgggaaacccgtagggtcccgtacccggttaccgtaccccgtaacgtaccgaaccgacccgaacccgacccgaacccgtacg

SEQ ID NO: 85585 - DNA, 661 bp, Homo sapiens
  misc_feature: GYAE6OF01BTC4K.3.28.C06.1.454.CMB.1.raw
  modified_base (228)..(228): a, c, t, g, unknown or other
  misc_feature (228)..(228): n is a, c, g, or t
  modified_base (511)..(511): a, c, t, g, unknown or other
  misc_feature (511)..(511): n is a, c, g, or t
  modified_base (543)..(543): a, c, t, g, unknown or other
  misc_feature (543)..(543): n is a, c, g, or t
tcagagacgcactccacgaccggtgctcgatttagagctcacgtattggggtttgggggggggtctcaggaggcagcgctctcgggacgtctccaccatgcctggctctgctattcctcaccctcctcactcgagggcacgagggtcctgggcccagtctcgccctgactcacgcctgcctccgtgtcgtcgggtctccgtggacagtcgatcactccgcctatctcngctacgtggaaccagcgagtcggtaggttaggtagttaactaatatgtcctcgtagtatacaacacgaccaaccgagaaccaaaccgacccctaaacgtactaattaactttatgtaacgtgtaactagtacgtaccggtccgttacgtacgggtttactacgtcgttcttcgttcgtaggttaacgtagttacgacgtacacgaccgtccctacctcgacctacgtcgtcggtcggcctcggacgcgtagggacggtaacgtcggcttaggtacttatacgngtcagtactactataactacgacgtacagacncgtacgtcggttacggtaccgttcggaacgggtaccggtaacgtaccgggttcccgtacggtaccccggtacaaccggtaccgtacccgaaccggaccctaacccgtaaccgtcccgg

SEQ ID NO: 85586 - DNA, 574 bp, Homo sapiens
  misc_feature: GYAE6OF01A191R.3.28.C06.1.454.CMB.1.raw
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctcctggtatcaacagcacccaggcaaacgcccccaaatcataatttatgatgtcagtaatcggccctcgtagggtttctaatcgtcttctctggttacaagtctggacaacacggcctcctcgaccatcctcgtcgggcctccgaggtctgggacggacgaggcttaggtatttattaccgtgcgagtctacataactacaagcagcgacgcgtacggtggggtccttacggaacgtcgggacctaagggtccctacccggtcgtccccgacggttccaccggtaccccgaaacggccccctaaaccccgtaccg

SEQ ID NO: 85587 - DNA, 689 bp, Homo sapiens
  misc_feature: GYAE6OF01CJRNQ.3.28.C06.1.454.CMB.1.raw
  modified_base (242)..(242): a, c, t, g, unknown or other
  misc_feature (242)..(242): n is a, c, g, or t
  modified_base (293)..(293): a, c, t, g, unknown or other
  misc_feature (293)..(293): n is a, c, g, or t
  modified_base (334)..(334): a, c, t, g, unknown or other
  misc_feature (334)..(334): n is a, c, g, or t
tcagagacgcactccacgaccggtgctcgatttagagctcacgtattggggtttgggggggggtctcaggaggcagcgctctcgggacgtctccaccatggcctgggctctgctattcctcaccctcctcactcgagggcacgagggtcctgggcccagtcctcgccctgactcagcctcgcctccgtgtcgtgggtctccgtggacagtcgatcatcgccatctctgcacgtacggaaccngctaggtcggacggttggtagttaataactatcgtctcgtggtatacaacngacacccgagaccaaaccgaccccaaatactataactttangattgtacaagttaacgccggtaccgtaggttacgggtttactacgtccgtactttcgtacgttgttaacagttcgtaggactaaaccgccgtcctaccgtacacctactcgtcggtcgggtcctcgaacggtcgtacgggaacggcggaggtcttaggtaactttagttacgtacgacgtacgttaactactaataactaaccgaacggtacacggtacaacggccgttacgggttcgggttaccgtaacgggtaacgtaccggggaaccgttaacgggaccccttccgggttaccccgtacccgtaacgtccccgaaccggaaccccgaacccggtccccgtaaacccgtccg

SEQ ID NO: 85588 - DNA, 786 bp, Homo sapiens
  misc_feature: GYAE6OF01AWB1Q.3.28.C06.1.454.CMB.1.raw
  modified_base (187)..(187): a, c, t, g, unknown or other
  misc_feature (187)..(187): n is a, c, g, or t
  modified_base (200)..(200): a, c, t, g, unknown or other
  misc_feature (200)..(200): n is a, c, g, or t
  modified_base (232)..(232): a, c, t, g, unknown or other
  misc_feature (232)..(232): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcgagggcacgagggtcctgggcccagtctgccctgactcagcctgcctcgtgtcgnggtctcctggacngtcgatcatcgcatctcctgcactcggaaccngcagtgacgttggtattaatactatcgttctccgttggtaactcaaacgtacgaccgaaccgacggaaccaaaacccgtcccccaaaactacctaaattaacttttaagtagtacgtcggtaactaggttaaacgtccccggtaccgtcgggtttaaggttaccgttacgtcggttaccttcgttcgttaacggttaacaacgttccgacgtacgaacccgtacggtcccttacccgcgtaaccgtacttccgtcggtacgtccgtaccgtacggtcgtacgggacgtacggacggccgttaagttacgttaacgttacgtacgtactacgtacctaacgttaactaacgttaaccgaacgtaccgtacgtaaccgtacgtaccgtaaccgggttccgggttaccggtaaccggggttaaccggtaccggggtaaaaccccggttagggttaaccccggtacccccgggttaacccggttaccccggtaacggtacccccgaacccgggtaacccgaaacccccggggttacccctaaaccccgttaccccggg

SEQ ID NO: 85589 - DNA, 781 bp, Homo sapiens
  misc_feature: GYAE6OF01EJ12J.3.28.C06.1.454.CMB.1.raw
tcagagacgcactccacgaccggtgctcgatttagagctcacgtattggggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacggttggtgttataactatgtctcctggtatacaacagccacccaggaccaaacgcccccaaactctaattaaactttatgtatcgtactaagtaacgtccggtcccttacgtaggggttttacctaaacgttccgtcctttccgtcgttacgggtttaaacctaaggttaccgtacggtaccgaaaccgtaccgggtcccctcccgtacggtaccctactttccgttaccggttcgggtcccttccggacgggtccgtagggaacgggtacggtacgggtcttaggttaacttttaacgtttacgtacgccgtaacgtccttaacgtaacgttaactaaccgaaggaccgtaacggaccgtaacggtaccgtaaccggggtttcgggggtttaacccgttaccggggtaaaacgggttaccgggggaaccgttaaaccgggggtcccgtaacccccggtttacccggtacccccgtacggtacccgaacccggaaacccccggaaacccgggtaaccccccaaacccccgttaacccggg

SEQ ID NO: 85590 - DNA, 757 bp, Homo sapiens
  misc_feature: GYAE6OF01AV8NS.3.28.C06.1.454.CMB.1.raw
  modified_base (210)..(210): a, c, t, g, unknown or other
  misc_feature (210)..(210): n is a, c, g, or t
  modified_base (260)..(260): a, c, t, g, unknown or other
  misc_feature (260)..(260): n is a, c, g, or t
  modified_base (602)..(602): a, c, t, g, unknown or other
  misc_feature (602)..(602): n is a, c, g, or t
tcagagacgcactccacgaccggtgctcgatttagagctcacgtattggggtttggggggggtcgtcgaggaggcagcgctcgtcgggacgtctccaccatggccgtggctctgctattcctcaccctctcactcagggcacgagggtcctcgggcccagtctcgccctagactcagcctcgcctccgtgtcgtgggtcctccgtggacncgtcgactcagtcccgtcacttcctcgtacgcctaacggtcggaaacccnggacctaggtggtaacggggtttttggtacggttaataacttagtcgttccttccggtagtaactacgtaacgacgaccaccgaacggaaccgaaaccctaacccccaaactactaacttaaattagtacgtagttacgtacttaacggtaccgtaccgtaccgtacggtttacgggttacttacgtacttcttcgttcgtacgtaacgtaacggttcgttacggaccaaccggtacccggtcctacccgtacgaccttacgttaccgttcgaccggtccgtaccgtacggtaccgtagggaacgacgggaccgtagttcgttaacttacgttactggaacncgttactaacgtaacgttaacgaactacgtaacgcggaactaggacgtaccgggttcggtaccgttacggtaccggtaacgggtccgaaccgtaccggtccgtacccgtaccgttaccggacctaccggacccgtaaccgaccctcccgtaaacg

SEQ ID NO: 85591 - DNA, 707 bp, Homo sapiens
  misc_feature: GYAE6OF01AST73.3.28.C06.1.454.CMB.1.raw
  modified_base (238)..(238): a, c, t, g, unknown or other
  misc_feature (238)..(238): n is a, c, g, or t
tcagagacgcactccacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcatcatccgccattcctcctgactacctaggaaccnggctaggttggtacggtttggtacggtttaataacttattcgtcttccgtggtataccaacacgccaaccgacggaaccaaaacccgaccccctaaaactctaactttaaatttagtacgattagtacgaagttacgtccggtacccgtaggttagggttttactaacgtccgttcttccttgttacggttaacacggttctacggtaccaacgtccggtccctacccgtacgacctacttccgtcgtcgggtcctacgcggtacgtaggaacggacgaggtcttagtaatttacgtactcggtacacgtctaactataactacgaacgcaacgtcacggtacgttacgggtcgggtttacgtacccggaacggttaccgggaaaccggttaccgggtacccgtcccgggtacccgtacccgaaccgtcccgaaacccgtacccggaaacccgtccccaacccgtaccg

SEQ ID NO: 85592 - DNA, 650 bp, Homo sapiens
  misc_feature: GYAE6OF01EDK4E.3.28.C06.1.454.CMB.1.raw
  modified_base (232)..(232): a, c, t, g, unknown or other
  misc_feature (232)..(232): n is a, c, g, or t
tcagagacgcactccacgaccggtgctcgatttagagctcacgtattggggtttggggggggtctcaggaggcagcgctctcgggacgtctccaccatggcctggctctgctattcctcaccctcctcactcagggcacagggtcctgggcccagtctgccctgactcagcctgcctccgtgtctgggtctctggacagtcgatcatccgccatcctcctgcactggaaccngcagtgacgttggtgtatactatgtctcctgtatcaacagcaccaggacaacgcccccaaactcattaatttatgatgtactagtaactccggccctacgtacggggtttactaagtcgtcttcgtcgttaggttaacaacgttcgtgacctaacgaccggtccctccctgaccctagttcctacgtcgggtctccgacggtcgtagggacggtacgacggtactagttacttacgtacgtcgtactacgtctactaagtaactaacgaacgtcgacgaccgacgtcgtacggttaccgggtaccgttaccgggtaacggtaccgggtaaccgtaccggtaccggtacccggttaccccgtacccggtaaccggtaccgaacccggtacccgaaacccgtacccctaccccgtaaccg

SEQ ID NO: 85593 - DNA, 663 bp, Homo sapiens
  misc_feature: GYAE6OF01CQBWH.3.28.C06.1.454.CMB.1.raw
tcagagacgcactccacgaccggtgctcgatttagagctcacgtattggggtttgggggggggtctcaggaggcagcgctctcggggacgtctccaccatggcctgggctctgctattcctcacccctcctcactcagggcacagggtcctgggcccagtctgccctgactcagcctgcctccgtgtctgggtctcctggacagtcgatcatcgccatctcctgcactggaaccagcagtgacgttggtgttataactatgtctctggtatcaacagcaccaggacaaacgcccccaaactcataattatgatgtcagtaatccggcctcgaggggtttctaatcgtcttctcgtggttaacagttcaggacaaccacggccctccctacgacctatactcgtcgggtctccgagggtctaggacggacgaggtcgtagtaatttattacgtgacagtacctactaagtactaacgaacgtacgacgtacaggtccgtaaccggttggggggtttacccgttacggggtaaaccggtacggggtaaacccggtaagggttaccccggtaacccgggttccccggttaaccccgaccgggttacccggaacccggtaaccccccggaacccgggtacccccgtaaaacccccccggttacccgg

SEQ ID NO: 85594 - DNA, 711 bp, Homo sapiens
  misc_feature: GYAE6OF01DSXJ5.3.28.C06.1.454.CMB.1.raw
  modified_base (257)..(257): a, c, t, g, unknown or other
  misc_feature (257)..(257): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcacgtggaaccagcagtgacgttggtgttatactatntctctgtatcaacagcaccaggacaaacgaccccctaaactctaattaatttagtagatgtactaagttaacgtccggtacccgtacgtacgggttttactaacgttcgtctttcgttcgttacggttaactaaagttccgtacggaccaacgtacccggtcccttaccctacgtaaccctagtcccgttcgtacgggtccctaccggtagggtcgtaggaacgggtacggtacggtcgttacggttaatttacgttaacgtcgtacgtacgtctacttaataactaacgaagcaacgcgacgtacgtacggttccggggttaaccgttaccggggtaaaccgtacggggaaacccgttaacgggttcccgtaccccgggttaacccgtccccgtaaacggttacccgaacccggaaccccggaaacccggtccccgaaacccccgttaaccgg

SEQ ID NO: 85595 - DNA, 797 bp, Homo sapiens
  misc_feature: GYAE6OF01DCKRI.3.28.C06.1.454.CMB.1.raw
tcagagacgcactccacgaccggtgctcgatttagagctcacgtattggggtttgggggggggtctcagggaggcagcgctcgtcggggacgtctccaccatggcctgggctctgctattcctcaccctcctcactcagggcacgagggtcctcgggcccagtctgccctgactcagcctgcctccgtgtctgggtctcgtggacagtcgatcatcgcctatcctctgcactaggaaccagcagtgtacggtggttagtaatactatgtctaccgtgtatacaacacgaccaccgaggaccaaaccgaccccaaacttaccgtaatttaaatttacgtagtaacgttacgtactaacgttaaacgtcccggtacccgtagggtttaaccgggtttacctaaaggttccgttactttaccgtttacgttacgggttaaacctaacggttacggtacggtaacccgtaaaccggacccgggttaccccgttacccgttaccggaaccttaccttaccggttccggaaccggtcccgttacggacggggtacgttaacgggacgggaacgggtacggttcgtacggttaatttaaacgtaccggtactacgtagtaaccttgtaaattacgtaaaccgacgtaccgtaacgacgccttacggtacggtttacgggtacgttaaaccgggtaacggtaccgggacggtaaaccggttacccgacccgggttacccgtacccggtaacggttaccccggacccgtaacccgaaaccccggtacccctaacccggttaacccg

SEQ ID NO: 85596 - DNA, 679 bp, Homo sapiens
  misc_feature: GYAE6OF01B0KVG.3.28.C06.1.454.CMB.1.raw
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcatcgccatctcctgcactggaaccagcaggtgacgttggtgttaataactatgtctctgtatcaacagcaccaggaccaaacgacccccaaactctaattaaattttactagatacgtactaagtaacgtccggtcccgtacgtacgggtttactaactcgtcttcgtctacgttaacgtaacgtctacggacaacgaccgtcctcccgtacgacctacgttccgtccgtcgggtacctaccgaggtcccgtaggaacgggaaccggtacggtacgttacggttaattaacgtttacgtcgtacgtacgtgtacctaataacttaaaccgacgtacaacgacgtacgaccggtacggttacggggtaccgttaccggtaacggtacgggaaccgtaacggtcccgtaaccccggttccgtaccccgtaccggtaccaccggtaacccggaaccgaaccccgtacccgtaacccg

SEQ ID NO: 85597 - DNA, 611 bp, Homo sapiens
  misc_feature: GYAE6OF01B781A.3.28.C06.1.454.CMB.1.raw
  modified_base (285)..(285): a, c, t, g, unknown or other
  misc_feature (285)..(285): n is a, c, g, or t
  modified_base (316)..(316): a, c, t, g, unknown or other
  misc_feature (316)..(316): n is a, c, g, or t
  modified_base (406)..(406): a, c, t, g, unknown or other
  misc_feature (406)..(406): n is a, c, g, or t
  modified_base (476)..(476): a, c, t, g, unknown or other
  misc_feature (476)..(476): n is a, c, g, or t
tcagagacgcactccacgaccggtgctcgatttagagctcacgtattgggtttggggggggtctcaggaggcagcgctctcgggacgtctccaccatggcctggctctgctattcctcaccctcctcactcagggcacgagggtcctgggcccagtctgccctgactcagcctgcctccgtgtctgggtcctcctggacagtcgatcatcgcctatctcctgccacgtcggaaccagcgtaggtcgtacggtttggtacgttaatacgtatgtctctgtatcacnacacgaggacaacacccaatctagtaattgngatgagacgtacgtcgacgtcgttacgggttacacgttcgtacttcgtacgttaggttacgagtcgtcgactaccgaccgtcctccctanacctctccgtcgtgtcctacgtacgtacgtagaaggacgacggtctagtattacgttagctcgactctanaacgtatacgagtcgaacgcgacgtcggtacgtggttacccgtacggtaacgggtacggtaccgacggttccctacccggtccgtccgtaacccggtcgtacccgaacccggaaccgccccgtaacccttaccgg

SEQ ID NO: 85598 - DNA, 645 bp, Homo sapiens
  misc_feature: GYAE6OF01B5J95.3.28.C06.1.454.CMB.1.raw
  modified_base (238)..(238): a, c, t, g, unknown or other
  misc_feature (238)..(238): n is a, c, g, or t
  modified_base (279)..(279): a, c, t, g, unknown or other
  misc_feature (279)..(279): n is a, c, g, or t
  modified_base (321)..(321): a, c, t, g, unknown or other
  misc_feature (321)..(321): n is a, c, g, or t
  modified_base (477)..(477): a, c, t, g, unknown or other
  misc_feature (477)..(477): n is a, c, g, or t
tcagagacgcactccacgaccggtgctcgatttagagctcacgtattggggtttggggggggtctcaggaggcagcgctctcgggacgtctccaccatggcctgggctctgctattcctcaccctcctcactcagggcacgagggtcctgggcccagtctgccctgactcagcctgcctccgtgtctgggtctcctggacagtcgatcagtccgccatcctcctgcacgtcggaaccngcagtgacggttggtgttatatatgtctcgtgtatacaacngaccaccgaggaccaaaccgacccccaaatctaattaattanagtatgtacagtaacgtccggtacctagtacgggttactaacgtcgtcttctacgttagtaactagtcgtacgacaccgccgcctcccacgtacctacgtctcggtcggtcctcgagtcgtaggacgggacgtacgtctagtaactttacgtacgngtaccgtagtcctacgtaataacgtaacgaacgtaccgacgacgacgtacgtaccgggttacgggttaccggttaccggaaccgggtaccggtaccgtaacggtcccgtaaccggtcccgtacccgacgtacccgaccgtaccccgaacccggaccccaacccgtacg

SEQ ID NO: 85599 - DNA, 743 bp, Homo sapiens
  misc_feature: GYAE6OF01BWSSE.3.28.C06.1.454.CMB.1.raw
  modified_base (240)..(240): a, c, t, g, unknown or other
  misc_feature (240)..(240): n is a, c, g, or t
  modified_base (341)..(341): a, c, t, g, unknown or other
  misc_feature (341)..(341): n is a, c, g, or t
tcagagacgcactccacgaccggtgctcgatttagagctcacgtattgggtttgggggggggtctcaggaggcagcgctctcgggacgtctccaccatggcctgggctctgctattcctcaccctcctcactcagggcacagggtcctggggcccagtctgccctgactcagcctcgcctccgtgtcgtgggtctcctggacagtcgatcatccgccatcctcctgaccactaggaaccngcagtggtacggttggtagttaataactattcgttactccttggtataccaacacgaccaaccgaggaccaaaccgacccccaaatctaatttaacttagngtattgtacacgttaacgtcccggaccgttacgtaacggggttttactaacgtcgttcttacgttcggttaacggttaactaacggtacgtacgggtaaccaacccggtacccggtaccctacccgtaccgacccttacgttaccgtacggtttccgggaccgtaccggtccggtacggtacgggaaggggtacggacggttacgttagttaacttaactccgtaagtccgtacgtactactaaacgtactaacgacgtacgacgacccgtaggtaccctacgggttcgggtacgttacggggaaacgggtaccgggtaaaccgttaccggacccggtcccgggttacccgtaacgtcccgtaaccgacccgaaccccggtaaccaccccctaaccgtaccg

SEQ ID NO: 85600 - DNA, 588 bp, Homo sapiens
  misc_feature: GYAE6OF01C9DQA.3.28.C06.1.454.CMB.1.raw
  modified_base (238)..(238): a, c, t, g, unknown or other
  misc_feature (238)..(238): n is a, c, g, or t
  modified_base (266)..(266): a, c, t, g, unknown or other
  misc_feature (266)..(266): n is a, c, g, or t
  modified_base (282)..(282): a, c, t, g, unknown or other
  misc_feature (282)..(282): n is a, c, g, or t
  modified_base (291)..(291): a, c, t, g, unknown or other
  misc_feature (291)..(291): n is a, c, g, or t
  modified_base (309)..(309): a, c, t, g, unknown or other
  misc_feature (309)..(309): n is a, c, g, or t
  modified_base (348)..(348): a, c, t, g, unknown or other
  misc_feature (348)..(348): n is a, c, g, or t
  modified_base (372)..(372): a, c, t, g, unknown or other
  misc_feature (372)..(372): n is a, c, g, or t
  modified_base (394)..(394): a, c, t, g, unknown or other
  misc_feature (394)..(394): n is a, c, g, or t
  modified_base (407)..(407): a, c, t, g, unknown or other
  misc_feature (407)..(407): n is a, c, g, or t
  modified_base (425)..(425): a, c, t, g, unknown or other
  misc_feature (425)..(425): n is a, c, g, or t
  modified_base (440)..(440): a, c, t, g, unknown or other
  misc_feature (440)..(440): n is a, c, g, or t
tcagagacgcactccacgaccggtgctcgatttagagctcacgtattggggtttgggggggggtctcaggaggcagcgctctcgggacgtctccaccatggcctgggctctgctattcctcaccctcctcactcagggcacgagggtcctgggcccagtctgccctgactcagcctgcctcgtgtctgggtctccgtgacagtcgatcatccgcctatcctcctgcacgtcggaaccngctagtgtacggttggtagttataactntgtctctagtatcaanacgcaccgngacaaaccgccccaaatnaacttattatagatgacagtactccgcctagtacggttntactcgtctctgtagttacagtcncgacacgccgtcctctcgactntcgtgtcgctacncggtgagaggacgacgtntagtattacttacgngacacgtctactaataacgtaacacgtacacgacgacgtccgtaacggggtcggttaccgtaacgggtacggtaccgggaaccgtacgggtaccctccgggtccctaccgacgtacccgtacgacccgaacgtccctaacccgtaccg

SEQ ID NO: 85601 - DNA, 820 bp, Homo sapiens
  misc_feature: GYAE6OF01CD8Z8.3.28.C06.1.454.CMB.1.raw
  modified_base (242)..(242): a, c, t, g, unknown or other
  misc_feature (242)..(242): n is a, c, g, or t
tcagagacgcactccacgaccggtgctcgatttagagctcacgtattggggtttggggggggtctcaggaggcagcgctctcgggacgtctccaccatggcctgggctctgctattcctcaccctcctcactcagggcacgagggtcctgggcccagtctcgccctgactcagcctgccctcgtgtcgtgggtcctccgtggacagtcgatcatccgccatcctcctgccacgtcggaaccngactaggtggtacggtttagggttaggttaacttaacgttacgttcgttacccgttccgttagggttaactacgaaccgacggacccgaaccccgaacgggaacccaaaacccggaaccccccctaaaacttacctaaactttaaagtttactaggtacttaggtaacgtaacgttaacgtcccgggtcccgttacggttaacggggttttactaacgttcgttccttcgtttaccggttaggttaactaacggtcgtacggtaccaccgtaccgccccttacccgtacgacctactccgttcgtcggtccgtcgtacgggtactagggaacggtaccggtacggtcttacggttaatttaaccgtacgtcggtacgacgtctaacgttaataacgtaaccgacgtacctaaggaccgacggtaccgttaccgggtcggggttaaccgttaccgggtaaacgggtaccgggtaaacccggaccgggttacccggtaaccccggttcccggtaccccgtaaccgggttacccgaacccgggttaaccccgaacccggtaccccccgtaaccccgtaccg

SEQ ID NO: 85602 - DNA, 572 bp, Homo sapiens
  misc_feature: GYAE6OF01E4VAY.3.28.C06.1.454.CMB.1.raw
  modified_base (232)..(232): a, c, t, g, unknown or other
  misc_feature (232)..(232): n is a, c, g, or t
tcagagacgcactccacgaccggtgctcgatttagagctcacgtattggggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcatcatcgccatctcctgcactggaaccngcagtgtacgttggtggttataactatgtctcctggtatcaacacgcacccaggacaaacgccccaaactcaataatttatgatgtacagtaatccgccctgtagggtttctatcgtcttctctgtacagtctggacacacggcctccctacgaccactcgtcgtcggcctcccgaggtcgtcggaacggacggagtcgttaggtaatttagttactgcagctactataatacaagacagcacgacctacggttcggggtaccttacgggacgtcgggaccgtaagtaccgtacccgtccgtacccgcgtaccacggacccaaccggaccccaacccgtc

SEQ ID NO: 85603 - DNA, 785 bp, Homo sapiens
  misc_feature: GYAE6OF01DMSIO.3.28.C06.1.454.CMB.1.raw
  modified_base (249)..(249): a, c, t, g, unknown or other
  misc_feature (249)..(249): n is a, c, g, or t
tcagagacgcactccacgaccggtgctcgatttagagctcacgtattggggtttggggggggtctcaggaggcagcgctctcgggacgtctccaccatggcctgggctctgctattcctcaccctctcactcgagggcacgagggtcctgggcccagtctcgccctgactcagcctcgccttccgtgtcgtgggtcctccgtggacagtcgatcatccgacctatcctcctgcctacgtacggaaaccngacgtaaggttcggaacggtttgggttagtttaaataaccgttattcgttaccttccgttaggtaactaccaaacgtacgacccaacccgaacgggaccaaaacccgtaacccccctaaaactacttaaactttaaatttagtacgtatacggtacctaagttaaccgtcccgggtaccccttacgggttacgggttttactaacgttccgttacgtttcttacggttacggttaacgtaacgttccgtacggaaccgaacccgtacccggtccctacccgtacgaaccttctccggtaccgtcgggaccttccggagggtcgtacgggaacggtacggcgtacgttagtactttaccgttagcgctacgtactacgtaactactaacgaagtcacgtacgacgtcgtacggttcgggttaactaccgggtaaccgtacggggtaaccctacggggttaccctaaccccggttcccggtaaccgtaccggtaacccgaacccggaccccgtaacccggaaccccctaacgtacccg

SEQ ID NO: 85604 - DNA, 729 bp, Homo sapiens
  misc_feature: GYAE6OF01AHP06.3.28.C06.1.454.CMB.1.raw
  modified_base (239)..(239): a, c, t, g, unknown or other
  misc_feature (239)..(239): n is a, c, g, or t
  modified_base (409)..(409): a, c, t, g, unknown or other
  misc_feature (409)..(409): n is a, c, g, or t
tcagagacgcactccacgaccggtgctcgatttagagctcacgtattggggtttgggggggggtctcaggaggcagcgctctcgggacgtctccaccatggcctgggctctgctattcctcaccctcctcactcagggcacgagggtcctgggcccagtctgccctgactcagcctgcctccgtgtctgggtcctccgtggacagtcatcatccgccatcctcctgccacgtggaaccngcagtgtacggtttggtaggttaataactatgttctcctggtatcaacagccaccgaggacaaaccgccccaaactcaattaatttatagatagtacagtaacgtccggtaccctacggtagggtttactaacgttcgtcttctcgtaggttactagtcgtcgacaaccnccgtccctcccgtacgaccctatccttcgtcgggtcctccggacggtcgtacggaacgggaccggtacggtacgttacgttaacgtttaaccgtttacgtacgaccggttacgtaccgttacgaaacgtttaacgtaaacccgaaggtccgtaagaccgaccggtacgtaacggggttacgggttacccggttaacgggtaaaccggttacccggggaaaccgtaacccggttacccggtaccccgggttcccggtaacccccgtaccggtaaccgacccggaaacccccgaacggtacccccgtaaaccccgtacccgg

SEQ ID NO: 85605 - DNA, 799 bp, Homo sapiens
  misc_feature: GYAE6OF01C922J.3.28.C06.1.454.CMB.1.raw
  modified_base (324)..(324): a, c, t, g, unknown or other
  misc_feature (324)..(324): n is a, c, g, or t
tcagagacgcactccacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcagcctgcctcgtgtctcgggtctccgtggacagtcgatcatccgccatcctcctgcacgtcggaaccagcagtgtacgttggtagttataactatgtctctggtatcaacacgccaccgaggaccaaacgaccccaaactactaattaagtttanagtatacgtactaagttaacgtccggcccgttacggtacgggtttactaagttccgtcttacgttcgttacggttaacgtaacgttcgtaggtaccgaaccgtaccggtccccttacccgtacggtaacccttactaccgttcggtcgggtacccttaccggacgggtccggtacgggtaacgggaaccgggtacggtcttaaggttaactttaacttacgttccgacgtacgtacccttactaacttaacgtaaccgtaacgacctaacggtaccgaacggtccgttaaccggggtttaccgggggttaaccgttaacccggggtaaacccggtaaccggggtaaacccggtaacccgggttacccggtaacccccgggtttaccccggttacccccgtaaccccgggttaccgaacccccggtaaacccccggtaaaccccgggtaaacccccctaaacccggttaacccccg

SEQ ID NO: 85606 - DNA, 694 bp, Homo sapiens
  misc_feature: GYAE6OF01D8Z0C.3.28.C06.1.454.CMB.1.raw
  modified_base (197)..(197): a, c, t, g, unknown or other
  misc_feature (197)..(197): n is a, c, g, or t
  modified_base (232)..(232): a, c, t, g, unknown or other
  misc_feature (232)..(232): n is a, c, g, or t
  modified_base (272)..(272): a, c, t, g, unknown or other
  misc_feature (272)..(272): n is a, c, g, or t
  modified_base (308)..(308): a, c, t, g, unknown or other
  misc_feature (308)..(308): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctggcccagtctgccctgactcagcctgcctccgtgtctgggtctctggacngtcgatcatccgcctatcctcctgcactggaaccngcagtgtacgttggtgtataactatgtctctgtatcaacngcaccgaggacaaaccgccccaaatcaattaattangtatgtacagtaacgtccggtcccttacggtagggtttactaacttcgtccttttacttcggtacggtttaacgtacggttcgttacggaaccgtaaacccgtcccggtacccttccccgtagtaccctattccttacggtccgggtcctccgtacgggtcggtacggaacgggtaccgggacggtacgttagtttaactttaacgtttaccgtgacccgtacgtcttactaaataacgtaacaacggtacaacggtacgacgtacggtacggttcggggttaccgttaaccgggaacggtacggggtaacccgtaacggtacccggtacccgtacccggtacccgtaccgtcgaaccgtacccgacccgtaccccaccctaccgg

SEQ ID NO: 85607 - DNA, 752 bp, Homo sapiens
  misc_feature: GYAE6OF01DVQL2.3.28.C06.1.454.CMB.1.raw
tcagagacgcactccacgaccggtgctcgatttagagctcacgtattgggtttgggggggggtctcaggaggcagcgctctcgggacgtctccaccatggcctgggctctgctattcctcaccctcctcactcgagggcacgagggtcctgggcccagtctcgccctgactcagcctgcctcgtgtcgtgggtctctggactacgtcgatcatccgacctatcctcctgcacgtggaaccagcgagtcgacggttggtagttaataactgtcgtccttccgtagtactacaacgacgaccaccgacggaccaaacccgaccccctaaatactaatttaaagttataggtacttaggactaacgtaacgtcccggtccttacggttacgggtttactaagttccgtctttcgtacgttacggttaacaacggttcgtacggaaccgtaaccgtcccggtcccctaccgtacgtaaccctcgttccgtcggtcgggtccctaccgggacggtcccggtagggaacgggtacgtaggtaccttagttaactttacgttacgtacgtccggtaatcctaacgtaagttaacctaaaccggaacgccgtaaaccgacgtaacggtaccggtacgggtttacggggttaccgtaccggggtaaccgtacggggaacccgttaacggtacccgtacccggtcccgtacccgtaaccgtaccggaacccgaaccccggaaccctaccccgaaccgtaccg

SEQ ID NO: 85608 - DNA, 702 bp, Homo sapiens
  misc_feature: GYAE6OF01D9VMY.3.28.C06.1.454.CMB.1.raw
  modified_base (243)..(243): a, c, t, g, unknown or other
  misc_feature (243)..(243): n is a, c, g, or t
  modified_base (342)..(342): a, c, t, g, unknown or other
  misc_feature (342)..(342): n is a, c, g, or t
tcagagacgcactccacgaccggtgctcgatttagagctcacgtattggggtttgggggggggtctcaggaggcagcgctcgtcgggacgtctccaccatggcctgggctctgctattcctcaccctcctcactcagggcacgagggtcctgggccctagtctcgccctgactcagcctgcctcgtgtctgggtctcgtggacagtcgatcatccgcctattcctcctgccacgtcggaaccngccagtgtacggtttgggtagttaataactatgttctcctaggtactacaacacgccacccgaggaccaaaccgacccccaaatactaattaatttagngtatgtactaagtacgtccggtaccttacggtacgggtttactaagtcgtcttcttcgttacggttaactacgtcgtcggaacctaaccgacccggtccctacccgtacgtaccctactccgttacggtcggtacctaccgaggtaccgtaggacggacggaggtctacgtagttactacgtcgacgacgtctaacaattaactaacgacgtacgaagtaccgaggtacgtacggggttcggttacggttaaccggtaacgggtaccgggtaaccgacgggttacccgtcccggtttacccggacccgtaccgtaacccggaccgtaaacccggacccggtaacccccaaccccggtacg

SEQ ID NO: 85609 - DNA, 757 bp, Homo sapiens
  misc_feature: GYAE6OF01C8WZG.3.28.C06.1.454.CMB.1.raw
  modified_base (595)..(595): a, c, t, g, unknown or other
  misc_feature (595)..(595): n is a, c, g, or t
tcagagacgcactccacgaccggtgctcgatttagagctcacgtattggggtttgggggggggtctcaggaggcagcgctctcgggacgtctccacatggcctgggctctgctattcctcaccctcctcactcgagggcacgacgggtcctgggcccagtctcgccctgactcagcctgcctcgtgtcgtgggtcctcctggacagttcgatcgatccgcctatcctcctgcctacgtacggaaccagtcaggtcggtacgttgggttaggttaacttaacgttgtacgttaccgtcgttacggttaactacaaacgcgtacccaacccgaacggaaccgaaacccgtaaccccctaaacgttactaaacttaatttagtacgtaattggtactaagttaacgtaccgtcccgttaggttacgggtttaacttaacgtcgttacctttcgtacgtttacggttaactaacggtcgtacggaacctaaccggtaccgtcccgtacccgtacgacccttaacgtccgttacggtccggtcctacggtacgtcggtaacggacggaccgtggtacctagttaaccgtttaactcgacncgtacgtactacgtaactaacgtacacgcgtacgacacggtaccgtacggttaccggtacgtaccgggtaacgtcgggtaacgtacccgttacggtcccggtaccgttaccccggactacccgggaaccctaccccggtaaaccgccccgtaaccttaccgg

SEQ ID NO: 85610 - DNA, 826 bp, Homo sapiens
  misc_feature: GYAE6OF01CZFBX.3.28.C06.1.454.CMB.1.raw
  modified_base (274)..(274): a, c, t, g, unknown or other
  misc_feature (274)..(274): n is a, c, g, or t
  modified_base (317)..(317): a, c, t, g, unknown or other
  misc_feature (317)..(317): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacgagggtcctgggcccagtctcgccctgactcagtcctgcctccgtgtctgggtctccgtggacagtcgatcatcgcatcgtcctgctactgaaccagtcagtgacgttgtagtaataactatgtctctggtatanaacagcaaccaggacaaacgacccccaaaatcaattaatttanacgtatagtcaagtaactccggacctaggtagggtttactaaagtcgtaacttcgtacgtggttaacaagttcgtacgacaaccgtacggtccctacctacgaccattccgttacgtcgggtcctacgaacgtcgtacggaaagggaacccggtaggaccgttaggttaaactttaaacgtttacccgtaggtaacccgtaacggtaccgttacctaaaaggtttaaaccttaaaacggaaaacccgtagtaaaaccgggacgttaaaccgggaacccggtaccggggttttaacggggggggtttaaaccccttttaaaccggggggaaacccgttaccgggggggtaaaaaccccttaaaagggggttaccccgtaaaacccccccgggggttttacccccgttaaaccccggttaaaccccggggtttacccgtaaaaacccggaccccccgggtaaaaaaaccccggggcccccccgtaaaaaaccccccggtttaaaccccggg

SEQ ID NO: 85611 - DNA, 268 bp, Homo sapiens
  misc_feature: GYAE6OF01B0BUW.3.28.C06.1.454.CMB.1.raw
  modified_base (258)..(268): a, c, t, g, unknown or other
  misc_feature (258)..(268): n is a, c, g, or t
tcagagacgcactccacgaccggtgctcgatttagagctcacgtattgggtttggggggtttggtggtctccactcccgccttgacgaggctgattattactgcagctcatatacaagcagcagcacgtggggtcttcggaactgggaccaaggtcaccgtcgtcccagtcagcccaaggcccaaccccactgtcactctcgttccccgccctcctcgagtgcgtctctggagccgggctgggacaagggcacatagnnnnnnnnnnn

SEQ ID NO: 85612 - DNA, 606 bp, Homo sapiens
  misc_feature: GYAE6OF01A8OC3.3.28.C06.1.454.CMB.1.raw
  modified_base (199)..(199): a, c, t, g, unknown or other
  misc_feature (199)..(199): n is a, c, g, or t
  modified_base (231)..(231): a, c, t, g, unknown or other
  misc_feature (231)..(231): n is a, c, g, or t
  modified_base (269)..(269): a, c, t, g, unknown or other
  misc_feature (269)..(269): n is a, c, g, or t
  modified_base (275)..(275): a, c, t, g, unknown or other
  misc_feature (275)..(275): n is a, c, g, or t
  modified_base (298)..(298): a, c, t, g, unknown or other
  misc_feature (298)..(298): n is a, c, g, or t
  modified_base (442)..(442): a, c, t, g, unknown or other
  misc_feature (442)..(442): n is a, c, g, or t
  modified_base (447)..(447): a, c, t, g, unknown or other
  misc_feature (447)..(447): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcatcgccatctcctgcatcggaaccngcagtgacgttggtgttatatatgtctctgtatcaacngcaccngacaacgccccaactcataattngatcgtactagtaactccggtaccctgtacgggtttactaagtcgtcttctcgtgttacagttcgtggaccacgaccgtcctacctcgacctactctcgtcggtctacgcgtacgcggacggacgagtcgtagtagttacttcngtacncgtcgtactaatacacgagtccgagcgagtacgacggttcgggtaaccgttacgggaaccggttacgggtaacccggtacggtacccgtcccggttacccgtaccccgtaacggtcccgaaccggaccccgaaccggaaccccctaacccgttacccgg

SEQ ID NO: 85613 - DNA, 690 bp, Homo sapiens
  misc_feature: GYAE6OF01BGESB.3.28.C06.1.454.CMB.1.raw
  modified_base (235)..(235): a, c, t, g, unknown or other
  misc_feature (235)..(235): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacgagggtcctgggcccagtctgccctgactcagcctgcctccgtgtcgtgggtctccgtggacagtcgatcatcgccatctcctgcacgtggaaccngcagtgacgtttggaggttataactatcgtctccgtggtatactaacacgccaacccgtagaccaaaccgaccccctaaactcaattaattatgtaatgtactaagtaactccggtaccttacgtacgggtttactaactcgtacttctacgtagttaacacgtcgtgaccaacgtcggtccctccgtacgtacctacgtccgttcgacggtccgtaccgacggtcgtcgggaacggaccgggtagtcgttagtaactttaactacgtcgtacacggtcctaacgtacgtaaactacggtaacgaccgtaacgcgaacgtaccggtaccgttcggggttaccttacgggaaccgttaccgggtaaccgtaccgggtaccgtaccccgggttaccgtaccccgtaacggtacccgtaaccgggacccccgaaccggaccccgtaaaccccgtacgg

SEQ ID NO: 85614 - DNA, 566 bp, Homo sapiens
  misc_feature: GYAE6OF01A9WZW.3.28.C06.1.454.CMB.1.raw
  modified_base (232)..(232): a, c, t, g, unknown or other
  misc_feature (232)..(232): n is a, c, g, or t
  modified_base (462)..(462): a, c, t, g, unknown or other
  misc_feature (462)..(462): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatcctcctgcactggaaccngcagtgacgttggtgttataactatgtctctggtatcaacagcaccaggccaaacgcccccaaatcaattaatttatgattgtactagtaactccggtccctcgtacgggtttctaagtcgtcttcttcgttggttaacaacgtcgtcggacaacgaccgtccctcccgtcgacctactctcgtacgggcctcgaggctggacggacgagtcgtagtatttatactgcanctcaatacaacaagcaagtcacgcgtagtcgggtactacggaacgtcgggacctaaggtccgaccgtccgtcccagtccacgtacccgaacgccccaacctccg

SEQ ID NO: 85615 - DNA, 642 bp, Homo sapiens
  misc_feature: GYAE6OF01BAOZR.3.28.C06.1.454.CMB.1.raw
  modified_base (388)..(388): a, c, t, g, unknown or other
  misc_feature (388)..(388): n is a, c, g, or t
  modified_base (489)..(489): a, c, t, g, unknown or other
  misc_feature (489)..(489): n is a, c, g, or t
tcagagacgcactccacgaccggtgctcgatttagagctcacgtattggggtttgggggggggtctcaggaggcagcgctctcgggacgtctccaccatggcctgggctctgctattcctcaccctcctcactcagggcacgagggtcctgggcccagtctgccctgactcagcctgcctccgtgtcgtgggtctcctggacagtcgatcatcgccatctcctgcacgtcggaaccagcagtgtacgttggtagttataactatgtctcctggtatcaacagccaccgaggacaaaccgccccctaaaatctaattaatttagtgtatcgtactaacgtaactccggtccctggtacgggtttctaagtcgtcttcgtcgtacgttanacgtcgtagacgtaaccgccggccctccgtacgacctacgttcctcggtcggtcctaccggaggtcgtagggacggacgtaggctagttaatttactacgngtcgacgtcttaacaagtaacctaagacggtaccacgcgaacgcgttacgggtcggggtacgtaccggtaacggtacgggtaaccgtacgggtaccctcccggtaccgtacccgacgtacccgacggaaccccaaccggcccaaaccccgtcg

SEQ ID NO: 85616 - DNA, 736 bp, Homo sapiens
  misc_feature: GYAE6OF01AK00C.3.28.C06.1.454.CMB.1.raw
  modified_base (174)..(174): a, c, t, g, unknown or other
  misc_feature (174)..(174): n is a, c, g, or t
  modified_base (248)..(248): a, c, t, g, unknown or other
  misc_feature (248)..(248): n is a, c, g, or t
  modified_base (310)..(310): a, c, t, g, unknown or other
  misc_feature (310)..(310): n is a, c, g, or t
  modified_base (555)..(555): a, c, t, g, unknown or other
  misc_feature (555)..(555): n is a, c, g, or t
  modified_base (579)..(579): a, c, t, g, unknown or other
  misc_feature (579)..(579): n is a, c, g, or t
  modified_base (615)..(615): a, c, t, g, unknown or other
  misc_feature (615)..(615): n is a, c, g, or t
tcagagacgcactccacgaccggtgctcgatttagagctcacgtattggggtttggggggggtctcgaggaggcagcgctcgtcgggacgtctccaccatggcctggctctgctattcctcaccctctcactcgagggcacgtagggtcctgggcccagtctcgccctgacctnacgcctgcctcgtgtcgtggtcctcgtggacagtcgatcagtccgcctatccgttccagcctacgcggaaaccngcaggtcgtacggtttggtacgttataacgttgtcgtccgtcctaggtaactaccgaaaccncggtaccaacccggaggaacccaaaacccgtcccccctaaagttactaaacttttaagtttacgaggtacttacggttaactaaacgttccggtcccgttcccgtaaggttacggttttacacgtcgtactttcgttccgtacggtataccgtcgtaccgactaaccgtaccggtcccctacgtaccgtacccgtatttccggtcgtccgggtaccttacggcgtacggttacgacgggttaacncggtaacttagtaactttcgtacncgaactcgtacctagtaacaactacggagtacgaangtacccgtagggtggttaaccgtccggtaacgtaccgggtacgtaaccggtacgtccggtacccgttacccgaaccggtttcgaaaccccgaggtaaccccgacccaaccccggtcggtac

SEQ ID NO: 85617 - DNA, 772 bp, Homo sapiens
  misc_feature: GYAE6OF01BHIAZ.3.28.C06.1.454.CMB.1.raw
  modified_base (202)..(202): a, c, t, g, unknown or other
  misc_feature (202)..(202): n is a, c, g, or t
  modified_base (291)..(291): a, c, t, g, unknown or other
  misc_feature (291)..(291): n is a, c, g, or t
tcagagacgcactccacgaccggtgctcgatttagagctcacgtattggggtttgggggggggtctcaggaggcagcgctctcgggacgtctccaccatggcctgggctctgctattcctcaccctcctcactcagggcacgagggtcctgggcccagtctgccctgactcagcctgcctccgtgtctgggtctcctggacngtcgatcgatcgccatcctcctgcacgtaggaaccagcaagtgtacgtttggtagttaactaacgtatgtctccgtaggtactacgaanacgccaccgaaggaccaaaaccgacccccaaaactctaattaatttactagattcgtaactagttaaaacgtccgtacccgttacggtagggtttactaagttccgtactttccgtacgtaggtttaacaacggttcgtacggaaccgtaaaccgacccgggtcccttacccgacgtaaccctagttcctcgtacgggtccttaccggaaggtcgtacggaacgaacgggtagtacgttacgtaatttaacgttactacgtaccgtagaccttaactaaacgttaataaaccgaacgtacgaacggtccgtaacggaccggttaaccggttaccggggttacgttaacccgggtaaacgttaaccgggggtaacccgtaaccggttacccggtaaaccccgttcccggggtaacccctaaccggtacccgtaacccggaacccccggttaaaccggaaccccctaaaccccccggtaacgg

SEQ ID NO: 85618 - DNA, 814 bp, Homo sapiens
  misc_feature: GYAE6OF01EDT33.3.28.C06.1.454.CMB.1.raw
  modified_base (202)..(202): a, c, t, g, unknown or other
  misc_feature (202)..(202): n is a, c, g, or t
  modified_base (239)..(239): a, c, t, g, unknown or other
  misc_feature (239)..(239): n is a, c, g, or t
tcagagacgcactccacgaccggtgctcgatttagagctcacgtattgggtttgggggggggtctcaggaggcagcgctctcgggacgtctccaccactggcctgggctctgctattcctcacccctcctcactcagggcacagggtcctgggcccagtctcgccctgactcagcctgcctcgtgtctggtctccgtggacngtcgatcactccgccatcctcctgcacgtaggaaccngcagtgtacggttggtagttataactatgtctccgtagtactacaacagccacccaggaccaaaaccgaccccctaaaactacctaattaaactttagtacgtaagttcgtactaacggtaacgtcccgggtacccgttacggttaacggggttttacttaacggttccgttaccgtttcgttacgtttacgggtttaaaccgtaaggttaccgtacgggaaccgtaaaccgtaccccgggtcccccttaccccgtaccgaacccttaactcccgtttcggtaccgggtacccttacccggacgggtaccgtagggtaaccgggtaaccggtacgggtaccttaggttaactttaacgttaccgtacgtaccgtacgtaccgtactaacttaactaacgaaccgtacgtaacgacgtacgaccggttacggttacgggggttaccgttaacgggaacccgggtacgggtaaacccggtaaccgggttacccgtaccccggttcccggtaaccccgtaaccggtacccgtaacccggacccccgaaacccgggacccccctaaaccccgttacccg

SEQ ID NO: 85619 - DNA, 765 bp, Homo sapiens
  misc_feature: GYAE6OF01D6IWT.3.28.C06.1.454.CMB.1.raw
  modified_base (257)..(257): a, c, t, g, unknown or other
  misc_feature (257)..(257): n is a, c, g, or t
  modified_base (289)..(289): a, c, t, g, unknown or other
  misc_feature (289)..(289): n is a, c, g, or t
  modified_base (595)..(595): a, c, t, g, unknown or other
  misc_feature (595)..(595): n is a, c, g, or t
tcagagacgcactccacgaccggtgctcgatttagagctcacgtattggggtttgggggggggtctcaggaggcagcgctctcgggacgtctccaccatggcctgggctctgctattcctccaccctcctcactcgagggcacgagggtcctgggccctagtctcgccctgacctcgacgtcctcgcccttcgtgtcgtcgggtctccgtggactagtcgatcacgtcgcctatccgtctgacctacgtcggaaccngctaggtcgtacggtttggtacgtaataactntcgtccgttccgtagtactacacgacgtccaccgtaggaacccaaaccggtaccccctaaaatccgttaaatttaacgtttcgagtaacgttacgtacgttaacgttaaccgtccggttacccgttaagggttacgggttttacaacgttccggttaccttttcgtacggttaacggttaaccgtacgttccgtacggtaaccgtaaccgtaccccggttcccttacccgacgttacctacgttccggtaccgtcggtacctcgacgggtcgaggacggtcgtacggtctagttacttacgtcganccgtagtacctacgtaagttaactaacgacgtaccgtagacgaccgttacggaccgggttacggttacccgggtaacgacgggtaccggtaaaccgtaccgggtccccttaacgcccgttacgacccggtccgaaccccggaaccgtaccccggtaccctacggtacccg

SEQ ID NO: 85620 - DNA, 1065 bp, Homo sapiens
  misc_feature: GYAE6OF01ASD9S.3.28.C06.1.454.CMB.1.raw
  modified_base (162)..(162): a, c, t, g, unknown or other
  misc_feature (162)..(162): n is a, c, g, or t
tcagagacgcactccacgaccggtgctcgatttagagctcacgtattggggtttgggggggggtctcaggaggcagcgctctcgggacgtctccaccatggcctgggctctgctacttcctccaccctcctcactcagggcacagggtcctgggcccagtcncgccctgactcgacgcctcgcctccggtgtcgtgggtctccgtagggactacgtcgaactcactccgcctaacttcctccgtacgcgtaaccgtacgggaaacccgacggtacgtacgggttacgggttaaccgggttttagggggttaacgtttaaacgttaaaaccgtttaagtttccggtttaccccgttaccggtttacgggttaaaaccgttaacccaaaaccggtaacccgtaccccgaaccccgggaaacggaaaacccgtaaaacccccggaaaccccccgtaaaaaccttaccttaaatttaaacttttaacgtagtaacgttacggttaacgtaaacggttaacccgttacccgggttacccgttacgggtttaacgggtttaacttaacggttaccgttaccgtttcgtacgttaacgggttaacgtaacgttaccggtacgtaacccgtaaaccggtcccgtaccttaccccgtacgtaaccgtaaccgttccggttaccgggtaccggtccctaacggtacggggtacgtaacggggaaacgggtaccggggttaaacggtaccggtttaacgtttaacgttaaacccgttttagaaccggttccgtaacggttaccttaacgggttaaaccaaaccttaaaacggaaccggtaacgttaaccgggtaaccgttaacggggaaccggtttaaccccgggggtttaacgggttaccggttaaaaccccgggggtaaccgggttaaacccggggtaaccggtaaacccccggggttacccggttaacccccgggtccccggttaaaaaccccgggtacccgttaaaccccgggaaccccgttaaacccccggggaaaaccccgttacccccgtaaaccccgggttaaccccc

SEQ ID NO: 85621 - DNA, 790 bp, Homo sapiens
  misc_feature: GYAE6OF01DHGE2.3.28.C06.1.454.CMB.1.raw
  modified_base (313)..(313): a, c, t, g, unknown or other
  misc_feature (313)..(313): n is a, c, g, or t
tcagagacgcactccacgaccggtgctcgatttagagctcacgtattgggtttgggggggggtctcaggaggcagcgctctcgggacgtctccaccatggcctgggctctgctattcctcaccctctcactcagggcacagggtcctgggcccagtctgccctgactcagcctgcctccgtgtctgggtctccgtggacagtcgatcatccgcatcctcctgcacgtcggaaccagctagtgtacggttggtgttaataactatgtctcgtgtatacaacacgccaaccgaggaccaaaccgaccccaaactnaacttaatttatagattacgtactaagtaacgtccggtacccgtaggtacgggtttactaacgttcgtacttcttacgttacgttaactaagtcgtacggacctaaccgaccggtcccctaccgtacgtaacctacgtacgtccgtacgggtcccgtaccgtaacgtcggttacgggaaacgggtaaccgtacggtacgttacgttaaacgttttaacgttacgttacgtacctaacggttacctaactaaacgttaacgttaaaccgaacggtcgaaacgaccggtaacggtacccgttacgggggtttacggggttaacccgggttacccggggtaaacggttacccgggggtaaacccgttaaaccggggtaccccttaaaccccgggttaccccggttaccccgtaaccggttaacccgaacccccgggttaaccccgaaaccccggaaacccccgtaaccccgttaaacccg

SEQ ID NO: 85622 - DNA, 996 bp, Homo sapiens
  misc_feature: GYAE6OF01BNA59.3.28.C06.1.454.CMB.1.raw
  modified_base (158)..(158): a, c, t, g, unknown or other
  misc_feature (158)..(158): n is a, c, g, or t
  modified_base (162)..(162): a, c, t, g, unknown or other
  misc_feature (162)..(162): n is a, c, g, or t
  modified_base (166)..(166): a, c, t, g, unknown or other
  misc_feature (166)..(166): n is a, c, g, or t
  modified_base (168)..(168): a, c, t, g, unknown or other
  misc_feature (168)..(168): n is a, c, g, or t
  modified_base (170)..(170): a, c, t, g, unknown or other
  misc_feature (170)..(170): n is a, c, g, or t
  modified_base (174)..(174): a, c, t, g, unknown or other
  misc_feature (174)..(174): n is a, c, g, or t
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (210)..(210): a, c, t, g, unknown or other
  misc_feature (210)..(210): n is a, c, g, or t
  modified_base (213)..(213): a, c, t, g, unknown or other
  misc_feature (213)..(213): n is a, c, g, or t
tcagagacgcactccacgaccggtgctcgatttagagctcacgtattgggtttgggggggggtctcaggaggcagcgctctcgggacgtctccaccatggcctgggctctgctattcctcaccctcctcactcagggcacagtcgtcgcggcctatcncgcngacncncnctcnccgtcgtcgtcgtcgtctcgngacacgtcntctacnccnctactctctcacctacgtacgaaccacgacgtaggtacggttacggttaggttaacgttaacttaacgttgttccgttccgtacggttagtaacctaacaacgaccgaacccgaaccggaacgaaaccccgaaaccccgaaacccctaaaccttaacttaaacttttaacgttacgttaacgttacgttacgtaacgttaacgttaccggttaccccggttaccggtttaaccgggttttaaccggtttaccgttaaccgttccgtttaccgtttacgtttacggtttaacgggtaaaccgttaaccggttaccggtaaccgtaaccccgtaaccggtaccccgttaccccttaccgtaccgtacccttaccggttcccggtaccggttccggtacccgtaccggggttacggaccggtaacgggaccgggtaacgttacgggttagtttaaacgtttaaccttttaacccggtacggtaccgacccgtttaacttaaccggttaaattaaaccggttaacgtaaaccgggaaccgtaccgttaacggaaccccggtaaccgggtttcgggtttaaaccccggggggtttacgtttttaaaccccggggggaaaccggtaccccgggtaaacccggggttaaacccggtttaccccggggttaacccccccggttaccccgggttaaccccccgaacggggttaaccccccgggttaaaccccgaaacccccggggtaaacccccgggtaaacccccccgtaaccccgttttaaaacccccgg

SEQ ID NO: 85623 - DNA, 668 bp, Homo sapiens
  misc_feature: GYAE6OF01A5ONW.3.28.C06.1.454.CMB.1.raw
  modified_base (328)..(328): a, c, t, g, unknown or other
  misc_feature (328)..(328): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcatccgccatctcctgcacgtacgaaccagcaggtgacggtttggtagttactaactatcgtctcgtaggtatacaacacgccacccgaggaccaaaccgacccccaaatactaattaatttangtatgtactagtaacgtccggtcccgttacggttacgggtttactaacgtccgttcctttaccgttcgttaacggttaactacggttcgtacgtaccgaaacccgtccggtcccctacccgtacgaacccttacgttccgttcggtccgggtcctccggaggtccgtagggacggaacggtacgacgttagtaaatttactacgtacgcgtactctactaagtaacgaccaagacgagacacgacgtagggtccggtacgtacggaacgtacggtaaccgtacggtacctacccggtccgtacccgacgtacgacccgacccgaccgcccctaacgtccg

SEQ ID NO: 85624 - DNA, 741 bp, Homo sapiens
  misc_feature: GYAE6OF01CPD1F.3.28.C06.1.454.CMB.1.raw
  modified_base (141)..(141): a, c, t, g, unknown or other
  misc_feature (141)..(141): n is a, c, g, or t
  modified_base (170)..(170): a, c, t, g, unknown or other
  misc_feature (170)..(170): n is a, c, g, or t
  modified_base (203)..(203): a, c, t, g, unknown or other
  misc_feature (203)..(203): n is a, c, g, or t
  modified_base (364)..(364): a, c, t, g, unknown or other
  misc_feature (364)..(364): n is a, c, g, or t
  modified_base (542)..(542): a, c, t, g, unknown or other
  misc_feature (542)..(542): n is a, c, g, or t
tcagagacgcactccacgaccggtgctcgatttagagctcacgtattggggtttggggggggtctcgaggaggcagcgctctcgggacgtctccaccatggcctggctctgctatcctcaccctctcactcgagggcacgngggtcctgggccagtctcgccctgactcnggcctcgcctccgtgtcgtcggtctcgtggacngtcgactcagtccgctatcctcgtgactacgtacggaacctgctggtcgtaggttggtacgttaatacttagtcgtcctacggtagtacacaacgtcgaaccgaccgaaggtaaccaaacccgaacccctaaactttacaacgtttaaacttcgacgttanacgttactacgtaaccgtccggtaccgtttacggtaacggttactaccttcgttacttcggttacgttaataacggtacgttccgaacggtaaccgaaccgttcccggtccctacgtacgaccttcttcgttccgggttcgaccgttccggaggtaccggttaggaacgggtaccggngttacgtttacggtatttaaccgtcgtacgtcgtacgtcttaacgtaactaacggtaaccgtaacggcgaaacgtcgtaaccggtaccggtaacgggttacggtaccgttaaccgggacggttaacccggaaacggttaacgtccccgtaccgtacggtacccctacgcaaccccgtacgacccgacccgtaaccctcg

SEQ ID NO: 85625 - DNA, 798 bp, Homo sapiens
  misc_feature: GYAE6OF01BZQ60.3.28.C06.1.454.CMB.1.raw
  modified_base (242)..(242): a, c, t, g, unknown or other
  misc_feature (242)..(242): n is a, c, g, or t
tcagagacgcactccacgaccggtgctcgatttagagctcacgtattggggtttggggggggtctcaggaggcagcgctctcgggacgtctccaccatggcctgggctctgctattcctcaccctcctcactcagggcacgagggtcctgggcccagtctgccctgactcagcctgcctccgtgtccgtgggtcctcgtggacagtcgatcgatccgcctatctcctgccacgtacggaccngctagtggtacggttggtagttaatactatcgtctcgtgtatcaacagccacgaggacaaaccgacccccaaatcctaagttaactttagacgtagtgtacgtaacgttaaacgtccggtacccgttacggttacggggttttactaaacgttcccgttacgtttccttacgtttaaggttaaccgtacggttacgttaccggaaccgtaaacccgacccggttccccgttacccgtacggtaacccctaacgttcccggttaacggtccggttacccgtaccccggtagggtaccgtagggaacccggggtagaaccgggttcttaacgtaaggttttaacctaggtaccgtacagttcccgttaagtaacgttaactaaccggaagaccgttaacggacgtaaccggtccgtaaccggggttcgggtttaacccgtacggggtaaccggtaccgggtaaaccgggtaacccgttacccggtcccgggttaccctacccggacggttacccgaaccggtaccccgaaaccggtaccccccgtaaccgtaacccgg

SEQ ID NO: 85626 - DNA, 726 bp, Homo sapiens
  misc_feature: GYAE6OF01BZDRC.3.28.C06.1.454.CMB.1.raw
  modified_base (228)..(228): a, c, t, g, unknown or other
  misc_feature (228)..(228): n is a, c, g, or t
  modified_base (235)..(235): a, c, t, g, unknown or other
  misc_feature (235)..(235): n is a, c, g, or t
  modified_base (248)..(248): a, c, t, g, unknown or other
  misc_feature (248)..(248): n is a, c, g, or t
  modified_base (266)..(266): a, c, t, g, unknown or other
  misc_feature (266)..(266): n is a, c, g, or t
  modified_base (272)..(272): a, c, t, g, unknown or other
  misc_feature (272)..(272): n is a, c, g, or t
  modified_base (284)..(284): a, c, t, g, unknown or other
  misc_feature (284)..(284): n is a, c, g, or t
  modified_base (291)..(291): a, c, t, g, unknown or other
  misc_feature (291)..(291): n is a, c, g, or t
  modified_base (334)..(334): a, c, t, g, unknown or other
  misc_feature (334)..(334): n is a, c, g, or t
  modified_base (392)..(392): a, c, t, g, unknown or other
  misc_feature (392)..(392): n is a, c, g, or t
  modified_base (435)..(435): a, c, t, g, unknown or other
  misc_feature (435)..(435): n is a, c, g, or t
tcagagacgcactccacgaccggtgctcgatttagagctcacgtattggggtttgggggggggtctcaggaggcagcgctctcgggacgtctccaccatggcctggctctgctattccctcaccctcctcactcgacgggcacgaggggtcctaggacccagtctcgccctgactcacgcctcgccttcggtgtcgtgggtctccgtggactgtcgatcatcgacctntcctccngcacgtcgaaccngtcgagtgtacgttggtntatatntctctctagtanacacacnccgaaccgacggaccaaaccgacccctaactactaattattancgtatcgtacgtaacgtacgtcccggtaccttcggttacgggttactagttcctcttntcgtagtacgagtcgtcgaccacgtccgccctaccgctacctntccgtcgacggtcctacgcggtcggtaggaacgtacgggtcgtgtaacgttactttaacgttcgacgttcgtaccgtacttactaacgttaaacgtaccgaaacgggttccaaggaccgttacgtacggttacggggttacccgggttcggtttaaacccgggtaacccgggtaaaccggggtaacccggtaccgggttaacccgccccgggttaccccgttaacccgggaacccggtaccgtaaacccccggaccccgggtaaaccctaacccccggtaaacccctacgg

SEQ ID NO: 85627 - DNA, 588 bp, Homo sapiens
  misc_feature: GYAE6OF01DSUFM.3.28.C06.1.454.CMB.1.raw
  modified_base (399)..(399): a, c, t, g, unknown or other
  misc_feature (399)..(399): n is a, c, g, or t
  modified_base (432)..(432): a, c, t, g, unknown or other
  misc_feature (432)..(432): n is a, c, g, or t
  modified_base (503)..(503): a, c, t, g, unknown or other
  misc_feature (503)..(503): n is a, c, g, or t
tcagagacgcactccacgaccggtgctcgatttagagctcacgtattggggtttgggggggggtctcaggaggcagcgctctcgggacgtctccaccatggcctgggctctgctattcctcaccctcctcactcagggcacagggtcctgggcccagtctcgccctgactcagcctgcctcgtgtctgggtctcctggacagtcgatcatccgccatcctcctgccacgtcggaaccagcaggtgacggtttggtagttaataactatgtctctggtatacaacagccaccaggacaaaccgacccccaaactcaatttaatttatagattgtacaagttaaacgtccggtacccttcgtacgggtttactaattcgtcttctcgtgttacaagttcgnggtacaaccgcgtccctcctgacctactcgtcncgggtcctacgtggacgtggacgggacgacggctgtaattactactgcacgctagatataacagtcagcancgtacgtcgggtcgtacggacgtaggaaccgtacggtccgccgtaccgtcccgacgtccaccgtaccgaacccgcccacctaccg

SEQ ID NO: 85628 - DNA, 806 bp, Homo sapiens
  misc_feature: GYAE6OF01AUZBP.3.28.C06.1.454.CMB.1.raw
  modified_base (202)..(202): a, c, t, g, unknown or other
  misc_feature (202)..(202): n is a, c, g, or t
tcagagacgcactccacgaccggtgctcgatttagagctcacgtattggggtttgggggggggtctcaggaggcagcgctctcgggacgtctccaccatggcctgggctctgctattcctcaccctcctcactcagggcacgagggtcctgggcccagtctcgccctgactcagcctgcctcgtgtctgggtctcctggacngtcgatcatcgcatcctctgcacgtggaaccagcagtgacgttggtagttataactatgtctcctgtatacaacagcaccgaggacaaaccgaccccctaaactcaattaactttatagactggtactaagtaacgtcccggtacccgtcggtaacggggttttactaacgttccgttacgtttaccttacgttaacggttaactaaacggttcgtaacggtacccgaaccgaaccggtacccctacccgttacgaacccgtattacccgtcggttaccgggcccttacccggtaacggtccggttaacggggaacgggtaaaccgggtaaagggttccgttaacggttaaacgttttaacgttttaaccggtcgtaaccgttaacgtacccgttaacgttaacttaaaccgtaaaccgtaaagacccgtaacggtacgtaaccggacgtaacccggggttcggggttaaccgttacccgggtaaaacggtacccggggtaaccgtaaccggggttaccgtaaccccggttacccggtaccccgtaaaccgggttcccgaacccgggtaaccccgtaaaccggccccgtaaacccccgtaacgg

SEQ ID NO: 85629 - DNA, 870 bp, Homo sapiens
  misc_feature: GYAE6OF01AWMZG.3.28.C06.1.454.CMB.1.raw
  modified_base (236)..(236): a, c, t, g, unknown or other
  misc_feature (236)..(236): n is a, c, g, or t
tcagagacgcactccacgaccggtgctcgatttagagctcacgtattggggtttggggggggtctcaggaggcagcgctctcgggacgtctccaccatggcctgggctctgctattcctcaccctctcactcaggcacagggtcctgggcccagtctgccctgactcagcctgcctccgtgtctgggtctccgtggacagtcatcatcaccatcctcctgctacgtacggaaaccnggctaggtcgtacggttggtagttaactaacttatcgttcttccgtaggtaactaccaaacgacgtacccaacccgaaggaacccaaaacccgaaccccccaaaactacgtaaatttaaaaccttttagtacgaacgttacggttaaccctaaaggttaaaccgttccccgggaccccgtttaaccggggttaacggggtttttaccctaaacgtttcccggtaccttttaccgttacgttaaacggtttaaacctaacggtttaccgttacggtaaccccgtaaaacccggtacccgggttaccccttaccccgttaaccgtaacccttacgttcccgttccgggttaccgggtacccttaccgggaaacgggtccgttaaacggggaaccgggttaccggaaacggttaccgtttaaagttaacgttttaacgttacgtacggtaccgtacgtacccttaggtaaactaacgttaaacgaacggtccaacggtaacgacgtaccggtaaccggggttcgggtttaaccgtaacggggtaaccgtaccggggaaaccgttacggtcccgtacccggaccgtaccccgtacgtacccgaacccgacccgaaccgtaaccccgtaacccgtaccg

SEQ ID NO: 85630 - DNA, 830 bp, Homo sapiens
  misc_feature: GYAE6OF01B8ONM.3.28.C06.1.454.CMB.1.raw
  modified_base (606)..(606): a, c, t, g, unknown or other
  misc_feature (606)..(606): n is a, c, g, or t
tcagagacgcactccacgaccggtgctcgatttagagctcacgtattgggtttggggggggtctcaggaggcagcgctctcgggacgtctccaccatggcctggctctgctattcctcaccctcctcactcagggcacgagggtcctgggcccagtctcgccctgactcagcctgcctccgtgtcgtggtctccgtggacagtcgactcagtccgcctatctccctgccacgtacggaaaccagctaggtcggtacggtttggtaggttaataaactagttgttccttccgtaggtaactacaaacacgaccaacccgaaggaccaaaaccgtaccccccaaaactaccgtaaattaaacttttagtacggtaattgtaactaaagtttaaccggtccggtaccccgttacggtaacggggttttactaaccgttccgtccgtttacgttacgttacggtttaactaacggttccgtacggaaccgtaacccgtacccggtaccctacccgtaccgacccgtacttccgtaccgtcgggtacccgtccggaacgggtcgtacgggtaacgggaccggtacggtacgtagttaacgttaacgttacncggtacctacggtacttacaacgtttaaaccaacggtaacgtcctaacggtacctaagtcccggttaaggggttaccgggttaccgttaaaccggggttaaccggtaacggggtaaccccgtaacgggttacccttccccgggttacccgtaccccggtaaccgtacccggaaccccggtaaccccgaaaccccggtaaacccccgtaaccccccggttaaccg

SEQ ID NO: 85631 - DNA, 764 bp, Homo sapiens
  misc_feature: GYAE6OF01EWYJZ.3.28.C06.1.454.CMB.1.raw
tcagagacgcactccacgaccggtgctcgatttagagctcacgtattggggtttggggggggtctcaggaggcagcgctctcgggacgtctccaccatggcctgggctctgctattcctcaccctcctcactcgagggcacgagggtcctgggcccagtctgccctgactcagcctgcctccgtagtctgggtacctcctggactagtcatcatccgcactctcctgcacgtggaaccagcagtcgacggttggtagttaactactagtcgtctaccgtaggtactacaaacgtcgaccgtaacccgagtaaccaaaccgtaccccctaaactcgtaaactttaattacgtagtacttcggtaactaacgtaccgttccggtacccttacggtacggtttactacgtccggtacttcgtacgttacgtaactacgtcgtacgactaaaccgtccgtccctaccgtagtaacctacttccgtccggtacggtacctaccgggtacggtccgtaaggaaccggggtacgtaccggtaccgttaaggttaacctttacgttaacgtccggaacgttacgtccctaagtaacctaacgtaacccggtaggtaccgaaccggtactaccgggtaccgttacgggttaccgggggttaccctaacggggtaacccgtcggggtaaaaccccgttaggtccccctaacgggtaccccgttccgaaacccggtaccgacccgtaccccgaacgtacccccgtaaccgtaccg

SEQ ID NO: 85632 - DNA, 809 bp, Homo sapiens
  misc_feature: GYAE6OF01AFEBV.3.28.C06.1.454.CMB.1.raw
  modified_base (138)..(138): a, c, t, g, unknown or other
  misc_feature (138)..(138): n is a, c, g, or t
  modified_base (301)..(301): a, c, t, g, unknown or other
  misc_feature (301)..(301): n is a, c, g, or t
tcagagacgcactccacgaccggtgctcgatttagagctcacgtattgggtttggggggggtctcaggaggcagcgctctcgggacgtctccaccatggctgggctctgctattcctctaccctctcatcgagggcanacgggtcctgggacccagtctcggccctgaccgtcacgcctacggccctccgttgtccgtcggtcctccgtggacgtcgtcacgtcagttccgctattcctctcggaccagtcgggaaaccagccgtaagtcggtacggttttcggtagtttaactaacgttntcggttctccgtaggttacctacggaacacggtccaccggtacgaccgtaaacccgccctaaactacctaagttaagtttcgacgttagccggtagtaacgtccgttaccgcccttaaggtaaccgggttctaaacgtccgtttcgtaccgtttacggtaacgttaccgtaacgttccgtaacggaccctaaacgcccggtaacccttcctaaccgtaccctgttccgtacgtccggtacctacggtacggacgttacgggacgtaccggtagttaccgttaatacttttaaccggttcgaaccgtacgtacctacgttaacctaacgttaaccacggttaaccggactacggttaccgaccgggtttacgtacccgggtttaacgggttaccccgtcgggaaaccgggttaacggttaaccggaccgttaccgtaccccgttcggttaccccgggacttcccgggaacccgtaacccccggcgttaaccccccgtaaacgttcccgg

SEQ ID NO: 85633 - DNA, 716 bp, Homo sapiens
  misc_feature: GYAE6OF01ET143.3.28.C06.1.454.CMB.1.raw
  modified_base (282)..(282): a, c, t, g, unknown or other
  misc_feature (282)..(282): n is a, c, g, or t
  modified_base (444)..(444): a, c, t, g, unknown or other
  misc_feature (444)..(444): n is a, c, g, or t
tcagagacgcactccacgaccggtgctcgatttagagctcacgtattggggtttgggggggggtctcaggaggcagcgctctcgggacgtctccaccatggcctgggctctgctattcctcaccctcctcactcagggcacgagggtcctgggcccagtctgccctgactcagcctgcctcgtgtctgggtctcctggacagtcgatcatccgctattcctcctgctacgtggaaaccgcaggtggtcggttggtagttataactatcgtcctctaggtacncaacagccacccgaggaccaaaaccgacccctaatcaacttaagttatcgagttcgaactagtaacgtccggtcctaggttacgggtttactacgtcgtacctttcgtcttcggttaagtactcgacggactaccgccggtccctccgtacgactacgttcncgtcggcctcgacggtgtagggacggagcggtactttaggtacttacgttcgtacgccgtacgtccttaacgtaataacgggtaaacgtacgaccgttacgaacggttaccggtaccggtacggggtttaccgggttaaccggttaaccgggtaacccggggtaccgggaaacccgttacccgggtacccggttaaccccggttccccggtaacccgtcccgaaccggtacccggtaaccccgtaacccggaacccctacccggttaacccg

SEQ ID NO: 85634 - DNA, 508 bp, Homo sapiens
  misc_feature: GYAE6OF02I61DN.3.28.C06.1.454.CMB.1.raw
tcagagacgcactccacgaccggtgctcgatttagagctcacgtattgggtttgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaagcccccaaactcataattatgatgtcagtaatcggcctcaggggtttctaatcgcttctctggttacaagtctggcaacacggcctccctgaccatctctgggctccaggctgaggacgaggctgattattactgcagctcatatacaagcagcagcacgtggggtcttcggaactgggaaccaaggtcaccgtcgtcccacgtcagcccaaggcccaacccac

SEQ ID NO: 85635 - DNA, 253 bp, Homo sapiens
  misc_feature: GYAE6OF02ISDUS.3.28.C06.1.454.CMB.1.raw
  modified_base (249)..(253): a, c, t, g, unknown or other
  misc_feature (249)..(253): n is a, c, g, or t
tcagagacgcactccacgaccggtgctcgatttagagctcacgtattgggtttgggggtttggtggtctccactcccgccttgacgaggctgattattactgcagctcatatacaagcagcagcactggggtcttcggaactgggaccaaggtcaccgtcgtcccacgtcagcccaaggccaaccccactgtcactctgttcccgccctcctcgagtgcgtctctgagcgggctggcaaggcgcatagnnnnn

SEQ ID NO: 85636 - DNA, 514 bp, Homo sapiens
  misc_feature: GYAE6OF02JDSMI.3.28.C06.1.454.CMB.1.raw
tcagagacgcactccacgaccggtgctcgatttagagctcacgtattgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaagcccccaaactcataatttatgatgtcagtaatcggccctcaggggtttctaatcgcttctctggttacaagtctggcaacacggcctccctgaccatctctgggctccaggctgaggacgaggctgatttattactgcagctcatatacaagcagcagcacgtgggtcttggaactgggaacctaggtcaccgtcgtcccacgtcacgcccaacggcccaaccctcg

SEQ ID NO: 85637 - DNA, 528 bp, Homo sapiens
  misc_feature: GYAE6OF02G8I0Y.3.28.C06.1.454.CMB.1.raw
  modified_base (446)..(446): a, c, t, g, unknown or other
  misc_feature (446)..(446): n is a, c, g, or t
tcagagacgcactccacgaccggtgctcgatttagagctcacgtattgggtttgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggacaaacgcccccaaactcataatttatgatgtcagtaatcggcctcgaggggtttctaatcgtcttctctggttacaagtctggacaacacggcctccctcgaccatctcgtgggctccgaggcctggaggacgaggctgtattattactgcagctcatatacaancagcagcacgtgggtcttcggaacgtgggaccaaggtccaccgtccgtcccacgtcacgacccgaacggcccaacccctacg

SEQ ID NO: 85638 - DNA, 511 bp, Homo sapiens
  misc_feature: GYAE6OF02GWRDZ.3.28.C06.1.454.CMB.1.raw
tcagagacgcactccacgaccggtgctcgatttagagctcacgtattgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaagcccccaaactcataatttatgatgtcagtaatcggcctcaggggtttctaatcgcttctctggttacaagtctggcaacacggcctccctgaccatctctgggctccaggctgaggacgaggctgattattactgcagctcatatacaagcagcagcagtggggcttcggaactgggaaccaaggtcaccgtcgtcccacgtcacgcccaaggcccaaccctacg

SEQ ID NO: 85639 - DNA, 508 bp, Homo sapiens
  misc_feature: GYAE6OF02GND0Y.3.28.C06.1.454.CMB.1.raw
tcagagacgcactccacgaccggtgctcgatttagagctcacgtattgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaagcccccaaactcataatttatgatgtcagtaatcggccctcaggggtttctaatcgcttctctgttacaagtctggcaacacggcctcctgaccatctctgggctcaggctgaggacgaggctgattattactgcagctcatatacaagcagcagcacgtgggtcttcggactgggaccaaggtcaccgtcgcccacgtcacgcccaacggcccaaccctacg

SEQ ID NO: 85640 - DNA, 512 bp, Homo sapiens
  misc_feature: GYAE6OF02GQW9B.3.28.C06.1.454.CMB.1.raw
tcagagacgcactccacgaccggtgctcgatttagagctcacgtattgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaagcccccaaatcataatttatgatgtcagtaatcggcctcagggtttctaatcgcttctctggttacaagtctggcaacacggcctcctgaccatctctgggcctccaggctgaggacgaggctgatttattactgcagctcatatacaagcagcagcacgtgggtcttggaactgggaaccaaggtcaccgttcgtcccacgtcacgcccaacggcccaaccctcg

SEQ ID NO: 85641 - DNA, 529 bp, Homo sapiens
  misc_feature: GYAE6OF02HDX6I.3.28.C06.1.454.CMB.1.raw
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaaagcccccaaactcataatttatgatgtcagtaatcggccctcgaggggtttctaatcgcttctctggttacaagtctggcaacgacgtcctccctgacctatctctcgggctccgaggctgaggacgaggctgatttattactgcagctcatatacaagcagcagcacgtgggtctacggacgtgggaaccaggtcgaccgtcgtacccgtacgtccacgtcccgaaggccccaaccctacg

SEQ ID NO: 85642 - DNA, 520 bp, Homo sapiens
  misc_feature: GYAE6OF02I0J9W.3.28.C06.1.454.CMB.1.raw
  modified_base (306)..(306): a, c, t, g, unknown or other
  misc_feature (306)..(306): n is a, c, g, or t
  modified_base (363)..(363): a, c, t, g, unknown or other
  misc_feature (363)..(363): n is a, c, g, or t
tcagagacgcactccacgaccggtgctcgatttagagctcacgtattgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctcctggtatcaacagcacccaggcaaacgccccaaactcataatttangatgtcagtaatcggcctcgagggtttcaatcgcttctctggttacagtctgcaacncgcctcctgaccatctctggctcaggctgaggacgaggctgattattactgcagctcatactacaagcagcagcacgtgggtacttcggaacgtcgggaacctaacggtctaacccggtcgtacccacgtccgacgcccaacggcccaacccctacg

SEQ ID NO: 85643 - DNA, 504 bp, Homo sapiens
  misc_feature: GYAE6OF02G944I.3.28.C06.1.454.CMB.1.raw
  modified_base (418)..(418): a, c, t, g, unknown or other
  misc_feature (418)..(418): n is a, c, g, or t
  modified_base (503)..(503): a, c, t, g, unknown or other
  misc_feature (503)..(503): n is a, c, g, or t
tcagagacgcactccacgaccggtgctcgatttagagctcacgtattgggtttgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaagcccccaaactcataattatgatgtcagtaatcggcctcaggggtttctaatcgcttctctggttacaagtctggcaacacggcctccctgaccatctctgggctccaggctgaggacgaggctgattattacngcagctcatatacaagcagcagcagtgggtcttcggaactgggaaccaaggtcacgtcgtcccacgtcagcccaaggccaacccnc

SEQ ID NO: 85644 - DNA, 527 bp, Homo sapiens
  misc_feature: GYAE6OF02H08SJ.3.28.C06.1.454.CMB.1.raw
  modified_base (231)..(231): a, c, t, g, unknown or other
  misc_feature (231)..(231): n is a, c, g, or t
  modified_base (375)..(375): a, c, t, g, unknown or other
  misc_feature (375)..(375): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacgttggtgttataactatgtctcctggtatcaacagcacccaggcaaacgcccccaaactcaataatttatgatgtcagtaactcggcctcgaggggtttctaatcgtcttctctgtacagtctgcacacgcctccngaccatctcgtggctccaggctgaggacgaggctgtattattactgcagctcatatacaagcagcagcacgtgggtcttacgggaacgtgggaacctaaggtccaccggtccgtcccgacgtcgacgaccccgaacggccccaacccgtacg

SEQ ID NO: 85645 - DNA, 250 bp, Homo sapiens
  misc_feature: GYAE6OF02G1X8M.3.28.C06.1.454.CMB.1.raw
  modified_base (248)..(250): a, c, t, g, unknown or other
  misc_feature (248)..(250): n is a, c, g, or t
tcagagacgcactccacgaccggtgctcgatttagagctcacgtattgggtttgggggtttggtggtctccactcccgccttgacgaggctgattattactgcagctcatatacaagcagcagcactggggtcttcggaactgggaccaaggtcaccgtcgtcccacgtcagcccaaggccaacccactgtcactctgttcccaccctcctcgagtgcgtctctgagcgggctggcaaggcgcatagnnn

SEQ ID NO: 85646 - DNA, 920 bp, Homo sapiens
  misc_feature: GYAE6OF02JLQMG.3.28.C06.1.454.CMB.1.raw
tcagagacgcactccacgaccggtgctcgatttagagctcacgtattgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtccctcgacgagtcgtactctactcgccgactctcctcgcacctacggtaaccgaacgcgacgtaggtacggttcggttgggttagttaactaatgtctccttcggtagttactaacaacgtacgaccccaacggacgaaacgaacccccgaaacccctaactaccttaaaattttaacttagacgtagttccgtaacgttaaacgttaaccggtccccgttacccttacggggggttttaccggttaaacttaaccggtcctttaccgttccgtttacgggtttaaccggttaaaacgtttccggttacggttaccgaaaaccctaaacccggggtaccccgttccccccgttaccgttaacccgaacctttaccggttccccgttaggggtccccgtacccttaaccgggggcctttaccggggaaaggggtaaccggggaaccggggtacctttaggtaaacggttttaaactttttaaccggttacgccgtaaacgtaaccgttttccctaaagttaattaaaccgtaaaaccggtacgaaccggttaacaccgtaaaccgaacccggttttcggggggtaaccgttttacccgggtaacccggtaacgggggtaacccggtaaacgggttaccgtaaccccggggttaaccccgttccccgtaacccggtaccgtaaccgggaaccccctaaccggggaaccccttaacccccccgaaaccgttccgg

SEQ ID NO: 85647 - DNA, 514 bp, Homo sapiens
  misc_feature: GYAE6OF02G2KMO.3.28.C06.1.454.CMB.1.raw
  modified_base (327)..(327): a, c, t, g, unknown or other
  misc_feature (327)..(327): n is a, c, g, or t
tcagagacgcactccacgaccggtgctcgatttagagctcacgtattgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaacgcccccaaactcataatttatgatgtcagtaatcggcctntagggtttctaatcgcttctctggttacaagtctggacaacacggcctccctgaccatctctggctccaggctgaggacgaggctgattacttactgcagtctcatatacaagcagcagcagtgggtcttggactgggaccaaggtcaccgtcgtcccgacgtcacgcccaacggacccaccctacg

SEQ ID NO: 85648 - DNA, 514 bp, Homo sapiens
  misc_feature: GYAE6OF02I0J5M.3.28.C06.1.454.CMB.1.raw
  modified_base (327)..(327): a, c, t, g, unknown or other
  misc_feature (327)..(327): n is a, c, g, or t
tcagagacgcactccacgaccggtgctcgatttagagctcacgtattgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaagcccccaaactcataatttatgatgtcagtaatcggccctnaggggtttcaatcgcttctctggttacaagtctggcaacacggcctccctgaccatctctgggctccaggctgaggcgaggctgattattactgcagctcatatacaagcagcaagcagtggggtcttcggaactgggaccaaggtcaccggtcgtcccacgtcagcccaagggccccaaccctacg

SEQ ID NO: 85649 - DNA, 512 bp, Homo sapiens
  misc_feature: GYAE6OF02I5NQF.3.28.C06.1.454.CMB.1.raw
tcagagacgcactccacgaccggtgctcgatttagagctcacgtattgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcaccaggcaaagcccccaaactcataatttatgatgtcagtaatcggcctcagggtttctaatcgcttctctggttacagtctgcaacacgcctcctgaccatctctgggctccagctgaggacgaggctgattattactgcagctcatatacaagcagcagcacgtgggttcttcgaacgtgggaccaagggtcaaccggtcgtacccgacgtcgacgcccaacggcccaaccctacg

SEQ ID NO: 85650 - DNA, 256 bp, Homo sapiens
  misc_feature: GYAE6OF02I08XY.3.28.C06.1.454.CMB.1.raw
  modified_base (252)..(256): a, c, t, g, unknown or other
  misc_feature (252)..(256): n is a, c, g, or t
tcagagacgcactccacgaccggtgctcgatttagagctcacgtattgggtttggggggtttggtggtctccactcccgccttgacgaggctgattattactgcagctcatatacaagcagcagcactggggtcttcggaactgggaccaaggtcaccgtcgtcccacgtcagcccaaggcccaaaccccactgtcactctgttcccgccctcctcgagtgcgtctctgagcgggctggcaaggcgcatagnnnnn

SEQ ID NO: 85651 - DNA, 526 bp, Homo sapiens
  misc_feature: GYAE6OF02JL3GR.3.28.C06.1.454.CMB.1.raw
  modified_base (310)..(310): a, c, t, g, unknown or other
  misc_feature (310)..(310): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggccaaacgcccccaaactcataatttangatgtcagtaactcggcctcgtagggttctaatcgcttctctggttacagtctggcaacacgcctcctgacatctcgtcggctccgaggctaggacggacgaggtctagatttatactgcagctcattacacagcagcagcacgtgggtctacggacgtcgggaaccaaggtcaccgtcgtaccgacgtcgacgacccaacggtacccaccctacg

SEQ ID NO: 85652 - DNA, 507 bp, Homo sapiens
  misc_feature: GYAE6OF02F860N.3.28.C06.1.454.CMB.1.raw
tcagagacgcactccacgaccggtgctcgatttagagctcacgtattgggtttggggggtctcaggaggcagcgctctcgagacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcaccccaggcaaaagcccccaaactcataatttatgatgtcagtaatcggccctcagggtttctaatcgcttctctggttacaagtctggcaacacggcctccctgaccatctctgggctccaggctgaggacgaggctgattattactgcagctcatatacaagcagcagcacgtgggtcttcggaactgggaccaaggtcaccgtcgtcccacgtcagcccaggccaacccc

SEQ ID NO: 85653 - DNA, 525 bp, Homo sapiens
  misc_feature: GYAE6OF02G3OK2.3.28.C06.1.454.CMB.1.raw
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctgaacagtcgatcatcgccatctcctgcactggaaccagcagtgacgttggtggttataactatgtctcctggtatcaacagcacccaggcaaacgcccccaaactcataatttatgatgtcagtaatcggccctcgaggggtttctaatcgcttctctggttacaagtctggcaacacggcctcctgaccatctctgggctccgaggctgaggacgaggctgatttattactgcagctcatatacaagcagcagcacgtgggtcttcggaactcgggaaccaaggtccaccggtccgtcccgacgtcgacgcccaacggcccaaccctacg

SEQ ID NO: 85654 - DNA, 253 bp, Homo sapiens; identical to SEQ ID NO: 85635
  misc_feature: GYAE6OF02IRHBP.3.28.C06.1.454.CMB.1.raw
  modified_base (249)..(253): a, c, t, g, unknown or other
  misc_feature (249)..(253): n is a, c, g, or t

SEQ ID NO: 85655 - DNA, 674 bp, Homo sapiens
  misc_feature: GYAE6OF02J3IPJ.3.28.C06.1.454.CMB.1.raw
  modified_base (374)..(374): a, c, t, g, unknown or other
  misc_feature (374)..(374): n is a, c, g, or t
  modified_base (421)..(421): a, c, t, g, unknown or other
  misc_feature (421)..(421): n is a, c, g, or t
  modified_base (561)..(561): a, c, t, g, unknown or other
  misc_feature (561)..(561): n is a, c, g, or t
  modified_base (576)..(576): a, c, t, g, unknown or other
  misc_feature (576)..(576): n is a, c, g, or t
  modified_base (592)..(592): a, c, t, g, unknown or other
  misc_feature (592)..(592): n is a, c, g, or t
tcagagacgcactccacgaccggtgctcgatttagagctcacgtattgggttgggggggttcgtcgaggaggcagcgctcgtcgggacgtctccaccatggccgtggctctgctatcctcaccctctcactcaggcacgacgggtcctcgggcccagtcctcgccctgacctcgacgccctgcccttccggtgtccgtcgggtcctaccgtggaccagttcgactcactccgcctattcctcccgtgacctacgtcggaaccaggctaagttcggtaccgttggtcgttaactaactgtcgtctcgtaggtactaccgaacacgaccacccgaaggaacctaaacccggcccctaaatctaaactaattacggnacgttacgactaacgtaacgtccggtaccttaggtacggttactacncgttcttacgtgtacgtaactacggtacgtcggaactaaccgtcccgtccgtacccgacgtaacctcgtcgtaccgcgggttacctacggaccggttagacggtcgggaacgtacgtcgttagtaacctttagtaccgtnacgtactccgttaanaacttaagacgtaacncacgtcgagtaccgtgttcgacgtcgacgtacggacctacgactcccgtcgacctcaccgaccgtaccgctacccacgtacg

SEQ ID NO: 85656 - DNA, 518 bp, Homo sapiens
  misc_feature: GYAE6OF02IKMFY.3.28.C06.1.454.CMB.1.raw
  modified_base (431)..(431): a, c, t, g, unknown or other
  misc_feature (431)..(431): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaagcccccaaactcataatttatgatgtcagtaatcggccctcgagggtttctaatcgcttctctggttacaagtctggcaacacggcctccctgaccatctctgggctccaggctgaggacgaggctgatttatactgctagctnatatacaagcagcagcacgtgggtctcggaactcgggaacaggtccaccgttcgacccgacgtcacgcccaaggccccaacccgtcg

SEQ ID NO: 85657 - DNA, 528 bp, Homo sapiens
  misc_feature: GYAE6OF02HYSSN.3.28.C06.1.454.CMB.1.raw
  modified_base (327)..(327): a, c, t, g, unknown or other
  misc_feature (327)..(327): n is a, c, g, or t
  modified_base (429)..(429): a, c, t, g, unknown or other
  misc_feature (429)..(429): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaagcccccaaactcataatttatgatgtcagtaatcggcctnagggtttcaatcgcttctctggttacaagtctggacaacacggcctccctgaccatctctgggcctcaggctgaggacgaggctgatttattactgcagctnaatatacaagcagcagcaacgtggggtacttacgggactacgggacctaaggtccaccgttccgtcccacgtcaccgacccgaaggccccaaccctacg

SEQ ID NO: 85658 - DNA, 599 bp, Homo sapiens
  misc_feature: GYAE6OF02GFV5H.3.28.C06.1.454.CMB.1.raw
  modified_base (244)..(244): a, c, t, g, unknown or other
  misc_feature (244)..(244): n is a, c, g, or t
  modified_base (327)..(327): a, c, t, g, unknown or other
  misc_feature (327)..(327): n is a, c, g, or t
  modified_base (368)..(368): a, c, t, g, unknown or other
  misc_feature (368)..(368): n is a, c, g, or t
tcagagacgcactccacgaccggtgctcgatttagagctcacgtattgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggnggttataactatgtctcctggtatcaacagcacccaggcaaagcccccaaactcataatttatgatgtcagtaatcggccctnagggtttctaatcgcttctctggttacaagtctggacaacncggcctcctgaccatctctggctccgaggccgtaggacggacgcgcgtagttattacttcgtgacgtacgtctactataactaacgaacgacgacgacgacgaccgtacgggtcgggttacggttaccgggtaacggtaccgggtaaaccggtaacggtacccgtacccggttacccgtacccgtaccgtaccgacccgaacccggaacccgtaacccccaacccgtaccg

SEQ ID NO: 85659 - DNA, 504 bp, Homo sapiens
  misc_feature: GYAE6OF02GQDS7.3.28.C06.1.454.CMB.1.raw
  modified_base (363)..(363): a, c, t, g, unknown or other
  misc_feature (363)..(363): n is a, c, g, or t
  modified_base (423)..(423): a, c, t, g, unknown or other
  misc_feature (423)..(423): n is a, c, g, or t
  modified_base (484)..(484): a, c, t, g, unknown or other
  misc_feature (484)..(484): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctcctggtatcaacagcacccaggcaaacgcccccaaatcataattatgatgtcagtaatcggcctcaggggtttctaatcgcttctctgttacagtctgcaacncggcctcctgaccatctctgggctcaggctgaggacgaggctgatttattactgcagctnatatacaagcagcagcacgtgggtcttcggaactgggaccaggtcaccgtcgtccacgtcncgacccaggcccaccctacg

SEQ ID NO: 85660 - DNA, 528 bp, Homo sapiens
  misc_feature: GYAE6OF02G5HQZ.3.28.C06.1.454.CMB.1.raw
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaacgcccccaaactcataatttatgatgtcagtaatcggcctcgtaggggtttctaatcgtcttctctggttacaagtctggcaacacggcctcctgaccatctcgtgggctccgaggctgaggacgaggctgattattactgcagctcatatacaagcagcagcacgtgggtcttacggaacgtcgggaaccaaggtccaccgtccgtcccacgtccacgacccaacggcccaacccgtacg

SEQ ID NO: 85661 - DNA, 544 bp, Homo sapiens
  misc_feature: GYAE6OF02I3ODO.3.28.C06.1.454.CMB.1.raw
  modified_base (231)..(231): a, c, t, g, unknown or other
  misc_feature (231)..(231): n is a, c, g, or t
  modified_base (308)..(308): a, c, t, g, unknown or other
  misc_feature (308)..(308): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacgttggtgttataactatgtctcctggtatcaacagcacccaggcaaacgcccccaaactcataatttangatgtacagtaatcggcctcgagggtttctaatcgacttctcgtggttacaagttctggacaacacggcctcctgacccatcgtacgtgggcctccgaggtctggacggacgaggctggatttattacgtgactagctcatatacaagcagcagcacgtgggtcttacggactcgggaactacggtcgacccgttcgtacccgacgtcgaccgacccgaacggcccaacccctacg

SEQ ID NO: 85662 - DNA, 530 bp, Homo sapiens
  misc_feature: GYAE6OF02IXXJ4.3.28.C06.1.454.CMB.1.raw
  modified_base (404)..(404): a, c, t, g, unknown or other
  misc_feature (404)..(404): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctcctggtatcaacagcacccaggcaaagcccccaaatcataatttatgatgtcagtaatcggcctcgagggtttctaatcgcttctctggttacagtctggcaacacgcctccctgaccatctctggctccgagctgacggacgnggctgattattactgcagctacatatacaagcagcaagtcaacgttgggtacttcggaactcggggaacctaaggtctaacccgtcgtaccccgtacgtcacgccccaacggtcccaacccctacg

SEQ ID NO: 85663 - DNA, 609 bp, Homo sapiens
  misc_feature: GYAE6OF02JZAPB.3.28.C06.1.454.CMB.1.raw
  modified_base (234)..(234): a, c, t, g, unknown or other
  misc_feature (234)..(234): n is a, c, g, or t
  modified_base (310)..(310): a, c, t, g, unknown or other
  misc_feature (310)..(310): n is a, c, g, or t
  modified_base (388)..(388): a, c, t, g, unknown or other
  misc_feature (388)..(388): n is a, c, g, or t
tcagagacgcactccacgaccggtgctcgatttagagctcacgtattgggtttggggggggttcgtcgaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacgttggtggttataactatgtctctgtatcaacagcaccaggacaaacgccccaaactcaataacttangtatgtacaagtaactccggcccttacgtagggtttactaagtcgtacttctcgttagttaacagttctgactaaacnccggtaccctcccgtacgaccctattcccgtacgtcggtacctaccggaggtctaggaacggacggaggtctaggtaactttactacgtgacagtctacaatactaactaacgcaagtccagcctacggtggggttcctacgggaacgtacgggaacctaacggtccaacccgttccgtacccgtacgtccgacgtaaccccgacggaccctaaccccgtg

SEQ ID NO: 85664 - DNA, 523 bp, Homo sapiens
  misc_feature: GYAE6OF02GXFBD.3.28.C06.1.454.CMB.1.raw
  modified_base (426)..(426): a, c, t, g, unknown or other
  misc_feature (426)..(426): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaagcccccaaactcataatttatgatgtcagtaatcggccctcaggggtttcaatcgcttctctggttacaagtctggcaacacggcctccctgaccatctctgggctccaggctgaggacgaggctgtattattactgcngctcatatacaagcagcaagcacgtggggtcttcggaactgggaaccaaggtccacccgttcgtaccccacgtcacgccccaaggcccacccctacg

SEQ ID NO: 85665 - DNA, 255 bp, Homo sapiens
  misc_feature: GYAE6OF02I6YZ7.3.28.C06.1.454.CMB.1.raw
  modified_base (249)..(255): a, c, t, g, unknown or other
  misc_feature (249)..(255): n is a, c, g, or t
tcagagacgcactccacgaccggtgctcgatttagagctcacgtattgggtttgggggtttggtggtctccactcccgccttgacgaggctgattattactgcagctcatatacaagcagcagcactggggtcttcggaactgggaccaaggtcaccgtcgtcccacgtcagcccaaggccaaccccactgtcactctgttcccgccctcctcgagtgcgtctctgagcgggctggcaaggcgcatagnnnnnnn

SEQ ID NO: 85666 - DNA, 526 bp, Homo sapiens
  misc_feature: GYAE6OF02FONWZ.3.28.C06.1.454.CMB.1.raw
  modified_base (231)..(231): a, c, t, g, unknown or other
  misc_feature (231)..(231): n is a, c, g, or t
  modified_base (308)..(308): a, c, t, g, unknown or other
  misc_feature (308)..(308): n is a, c, g, or t
  modified_base (421)..(421): a, c, t, g, unknown or other
  misc_feature (421)..(421): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacgttggtggttataactatgtctcctggtatcaacagcaccaggcaaacgcccccaaactcataatttangatgtcagtaatcggccctgagggtttctaatcgcttctcgtggttacagtctggcaacgcgcctcctgaccatcgtctgggctccgaggctgaggacgagctgattattacngcagctacatatacaagcagcagcacgtcgggtcttcggaacgtcgggaacctaggtccaccggttcgacccgacgtccgacgacccgaacgtacccaaccctcg

SEQ ID NO: 85667 - DNA, 576 bp, Homo sapiens
  misc_feature: GYAE6OF02IEL24.3.28.C06.1.454.CMB.1.raw
  modified_base (313)..(313): a, c, t, g, unknown or other
  misc_feature (313)..(313): n is a, c, g, or t
  modified_base (366)..(366): a, c, t, g, unknown or other
  misc_feature (366)..(366): n is a, c, g, or t
  modified_base (371)..(371): a, c, t, g, unknown or other
  misc_feature (371)..(371): n is a, c, g, or t
  modified_base (398)..(398): a, c, t, g, unknown or other
  misc_feature (398)..(398): n is a, c, g, or t
  modified_base (410)..(410): a, c, t, g, unknown or other
  misc_feature (410)..(410): n is a, c, g, or t
tcagagacgcactccacgaccggtgctcgatttagagctcacgtattggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctcctggtatcaacagcacccaggaccaaacgcccccaaactcaattaatttangatgtcaagtaactcgccctgtagggtttcaatcgcttctctggttacagtcngcacncgcctcctgaccatctcgtggctccgngctgacggacgnggctagtatttatactgacgagtctacattaatacaagccaagccgaagcccgacgttcgggggttaccttaccggggaaacgttggggaaccctaacgggttacccacccggttccgttaccccgacgttacccgaccgacccgaacgggaccccaacccctacg

SEQ ID NO: 85668 - DNA, 268 bp, Homo sapiens
  misc_feature: GYAE6OF02H0DYG.3.28.C06.1.454.CMB.1.raw
  modified_base (250)..(268): a, c, t, g, unknown or other
  misc_feature (250)..(268): n is a, c, g, or t
tcagagacgcactccacgaccggtgctcgatttagagctcacgtattgggtttggggggtttggtggtctccactcccgccttgacgaggctgattattactgcagctcatatacaagcagcagcactggggtcttcggaactgggaccaaggtcaccgtcgtcccacgtcagcccaaggccaaccccactgtcactctgttcccgccctcctcgagtgcgtctctgagcgggctggcaaggcgcatagnnnnnnnnnnnnnnnnnnn

SEQ ID NO: 85669 - DNA, 523 bp, Homo sapiens
  misc_feature: GYAE6OF02ION54.3.28.C06.1.454.CMB.1.raw
  modified_base (407)..(407): a, c, t, g, unknown or other
  misc_feature (407)..(407): n is a, c, g, or t
tcagagacgcactccacgaccggtgctcgatttagagctcacgtattgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaacgcccccaaactcataatttatgatgtcagtaatcggcctcaggggtttctaatcgcttctctggttacagtctggcaacacggcctccctgaccatctctgggctccaggctgaggacgnggctgattattactgcagctcatatacaagcagcagcacgtggggtcttcggaacgtgggaaccaaggtccaccggttccgtcccgacgtcacgccccgaaggccccaaccctacg

SEQ ID NO: 85670 - DNA, 250 bp, Homo sapiens
  misc_feature: GYAE6OF02HZBWC.3.28.C06.1.454.CMB.1.raw
  modified_base (249)..(250): a, c, t, g, unknown or other
  misc_feature (249)..(250): n is a, c, g, or t
tcagagacgcactccacgaccggtgctcgatttagagctcacgtattgggtttgggggtttggtggtctccactcccgccttgacgaggctgattattactgcagctcatatacaagcagcagcactggggtcttcggaactgggaccaaggtcaccgtcgtcccacgtcagcccaaggccaaccccactgtcactctgttcccgccctcctcgagtgcgtctctgagcgggctggcaaggcgcatagnn

SEQ ID NO: 85671 - DNA, 581 bp, Homo sapiens
  misc_feature: GYAE6OF02JCTTE.3.28.C06.1.454.CMB.1.raw
  modified_base (452)..(452): a, c, t, g, unknown or other
  misc_feature (452)..(452): n is a, c, g, or t
  modified_base (458)..(458): a, c, t, g, unknown or other
  misc_feature (458)..(458): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctcctggtatcaacagccacccaggcaaacgcccccaaactcattaatttatgatgtcaagtaatcggccctcgaggggtttctaatcgcttctctggttacagtctgacaacacgtcctccctgaccatcctcgtcgggcctccgacggcttggacggtacggaggcctaggtactttattacgtagccgtanccgttnaatactacaagcagcacgctacgtcgggttactacggtaacgtacggggaacctaagggtccgtaacccgttccgtcccgacggttaccaccggaccccgtaaccggaccccaaccctacccg

SEQ ID NO: 85672 - DNA, 539 bp, Homo sapiens
  misc_feature: GYAE6OF02GAWN1.3.28.C06.1.454.CMB.1.raw
  modified_base (431)..(431): a, c, t, g, unknown or other
  misc_feature (431)..(431): n is a, c, g, or t
tcagagacgcactccacgaccggtgctcgatttagagctcacgtattgggtttggggggggtctcagtaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaacgcccccaaactcataatttatgatgtcagtaatcggcctcgagggtttctaatcgcttctctggttacaagtctggcaacacggcctccctgaccatctctgggctcgaggctgacggacgaggctgattattactgcagctnatatacaagcagcagcacgtggggtcttacgggaacgtcgggaacctaagggtccaaccggttccgtacccgacggtccacggaccccaacggccccaaccccgtacg

SEQ ID NO: 85673 - DNA, 562 bp, Homo sapiens
  misc_feature: GYAE6OF02GZFZ9.3.28.C06.1.454.CMB.1.raw
  modified_base (373)..(373): a, c, t, g, unknown or other
  misc_feature (373)..(373): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctcctggtatcaacagcacccaggacaaacgcccccaaactcataatttatgatgtcagtaactcggcctcgtagggtttactaatcgtcttctctggttacagtctggacaacncggcctcctgacctatctcgtgggcctccaggtctggacggacgaggctagtatttacttactgcagtcctcatatacaagcagcagcctacgtcggggttacctcgggaacgtcgggaacctaacggtccacccggttccgaccccgtacggtccgaacggaccccgaacggtccccaaaccccgtcg

SEQ ID NO: 85674 - DNA, 547 bp, Homo sapiens
  misc_feature: GYAE6OF02G3GWA.3.28.C06.1.454.CMB.1.raw
  modified_base (307)..(307): a, c, t, g, unknown or other
  misc_feature (307)..(307): n is a, c, g, or t
  modified_base (413)..(413): a, c, t, g, unknown or other
  misc_feature (413)..(413): n is a, c, g, or t
  modified_base (427)..(427): a, c, t, g, unknown or other
  misc_feature (427)..(427): n is a, c, g, or t
  modified_base (445)..(445): a, c, t, g, unknown or other
  misc_feature (445)..(445): n is a, c, g, or t
tcagagacgcactccacgaccggtgctcgatttagagctcacgtattgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaacgcccccaaactcataattangatgtcagtaactcggcctcgagggtttctaatcgcttctctggttacaagtctggcaacacggtcctccctgaccatctcgtcgggctccgaggctgacggacgnggctgattattacngcagctacatactacaancagcagcacgttcggggtcttaccgggaacgtcggggaacctaaggtccaccggttccgtacccgacgtccaccggacccgaacggtacccaaccccgtacg

SEQ ID NO: 85675 - DNA, 564 bp, Homo sapiens
  misc_feature: GYAE6OF02F0S3G.3.28.C06.1.454.CMB.1.raw
  modified_base (369)..(369): a, c, t, g, unknown or other
  misc_feature (369)..(369): n is a, c, g, or t
  modified_base (437)..(437): a, c, t, g, unknown or other
  misc_feature (437)..(437): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaacgcccccaaactcataatttatgatgtcagtaatcggcctgagggtttctaatcgcttctctggttacaagtctggacaacncggcctcctgaccatctctgggcctccgaggctgacggacgaggctagtatttattactgcagtcctnaatataacaagcagcacgcacggttgggtccttacgggaacgttcggggaacctaaggtcccgaacccggttccgtaccccgtacggttccgaaccgtaccccgaacgggaccccaacccccgtacg

SEQ ID NO: 85676 - DNA, 558 bp, Homo sapiens
  misc_feature: GYAE6OF02FUOC2.3.28.C06.1.454.CMB.1.raw
  modified_base (231)..(231): a, c, t, g, unknown or other
  misc_feature (231)..(231): n is a, c, g, or t
  modified_base (274)..(274): a, c, t, g, unknown or other
  misc_feature (274)..(274): n is a, c, g, or t
  modified_base (328)..(328): a, c, t, g, unknown or other
  misc_feature (328)..(328): n is a, c, g, or t
  modified_base (432)..(432): a, c, t, g, unknown or other
  misc_feature (432)..(432): n is a, c, g, or t
  modified_base (436)..(436): a, c, t, g, unknown or other
  misc_feature (436)..(436): n is a, c, g, or t
  modified_base (440)..(440): a, c, t, g, unknown or other
  misc_feature (440)..(440): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacgttggtggttataactatgtctcctggtatcaacngcacccaggcaaagcccccaaatcataatttatgatgtcagtaactcggccctntaggggtttactaatcgtcttctcgtgttacaagttctggacaacacggtcctccctcgaccatcctctgggctccgaggtctgaggcgaggctgtattattcngacngctnaatataaccaagcaagcaacgcgtagttcggggtacttacgggaacgtcgggaacctaacgggtccacccggttccgtacccgaccgttcgaaccgcccgaacggaccccaccctacg

SEQ ID NO: 85677 - DNA, 524 bp, Homo sapiens
  misc_feature: GYAE6OF02FIVPL.3.28.C06.1.454.CMB.1.raw
  modified_base (231)..(231): a, c, t, g, unknown or other
  misc_feature (231)..(231): n is a, c, g, or t
  modified_base (368)..(368): a, c, t, g, unknown or other
  misc_feature (368)..(368): n is a, c, g, or t
  modified_base (423)..(423): a, c, t, g, unknown or other
  misc_feature (423)..(423): n is a, c, g, or t
  modified_base (432)..(432): a, c, t, g, unknown or other
  misc_feature (432)..(432): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacgttggtggttataactatgtctcctggtatcaacagcacccaggcaaacgcccccaaactcataatttatgatgtcagtaatcggccctcgtagggttctaatcgcttctctggttacagtctgcaacncgcctcctgaccatctcgtggcctccgaggctgaggacgaggctgtattattacngcagtctanatactacagcagcagcacgtgggtcttcggacgtcgggaccaaggtccaccggtccgtcccgacgtccacgcccaacggcccaacccgtacg

SEQ ID NO: 85678 - DNA, 639 bp, Homo sapiens
  misc_feature: GYAE6OF02H8M2N.3.28.C06.1.454.CMB.1.raw
tcagagacgcactccacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgcatctcctgcactggaaccagcagttgacggtttggtggttaataactatgtctcctggtatcaacagccacccaaggaccaaaacgccccccaaaactcgtaattaaatttatagtatgtacaagtaactccggcctagacgggtttctaagtcgtcttctcttaggttacaagttctaggactaacgacgtcctaccctacgacccgtactctcgtcggtcctccgaggtcctggacggacgtaggcttaggtaacttttagtaccgtgcagtacctactaatacgtaagaacgtcgacgacacgactaacggttcggggttaccgttacggtaacgttacggggtaacccgtaacggttacccgtacccggttccgtacccgacgttaccgaccgacccgtaaccggtaccccaaccccgtaccg

SEQ ID NO: 85679 - DNA, 517 bp, Homo sapiens
  misc_feature: GYAE6OF02GY13W.3.28.C06.1.454.CMB.1.raw
  modified_base (309)..(309): a, c, t, g, unknown or other
  misc_feature (309)..(309): n is a, c, g, or t
  modified_base (383)..(383): a, c, t, g, unknown or other
  misc_feature (383)..(383): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaacgcccccaaactcattaattanagatgtcagtaatccggccctgtagggtttctaatcgtcttctctggttacaagtctggacaacacggcctccngaccatctctgggctcgagctgaggacgaggctgtattagtactgcagctacatatacaagcagcagcagtgggtctaggacgtggaactagtcaccgtcgtacccacgtcacgacccgaacggcccaacctcg

SEQ ID NO: 85680 - DNA, 598 bp, Homo sapiens
  misc_feature: GYAE6OF02GT15T.3.28.C06.1.454.CMB.1.raw
  modified_base (308)..(308): a, c, t, g, unknown or other
  misc_feature (308)..(308): n is a, c, g, or t
  modified_base (368)..(368): a, c, t, g, unknown or other
  misc_feature (368)..(368): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctcctggtatcaacagcacccaggcaaacgcccccaaactcataatttangatgtcagtaactcggcctcgagggtttctaatcgcttctctggttacaagtctgcaacncggcctccctgaccactctctgggctccgaggtctggacggacgacggtctgtaactttattacgtgacagtcttacaattactaacgaagcgaagcaacggtctaacggttcggggttaccttacgggaaccgttcggggaaccctaaacgggttccctaacccggttccggtacccctacggttccgaaccggtaccccgaaaccggtcccctaaccccgtaacccgg

SEQ ID NO: 85681 - DNA, 547 bp, Homo sapiens
  misc_feature: GYAE6OF02HPMBD.3.28.C06.1.454.CMB.1.raw
  modified_base (273)..(273): a, c, t, g, unknown or other
  misc_feature (273)..(273): n is a, c, g, or t
  modified_base (383)..(383): a, c, t, g, unknown or other
  misc_feature (383)..(383): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaanagcacccaggcaaacgcccccaaactcataattatgatgtcagtaatcgcctgtagggtttctatcgacttctctgttacagtctggcaacacgcctcctgacctatctntcgggcctccgaggtctggaggacgaggtctgatttatactgcagctcatactacagcagcagctaacgttgggtacttaccggtacgtacgggaacctaaggtcccgacccggttccgacccgtacgtaccacggtaccccgaacggccccaacccctaccgg

SEQ ID NO: 85682 - DNA, 608 bp, Homo sapiens
  misc_feature: GYAE6OF02H820C.3.28.C06.1.454.CMB.1.raw
  modified_base (230)..(230): a, c, t, g, unknown or other
  misc_feature (230)..(230): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgcatctcctgcactggaaccngcagtgacgttggtgttataactatgtctctggtatcaacagcaccaggaccaaaacgaccccccaaactcaattaatttatgatgtcagtaactcggtcctcgtagggtttacaatcgtcttctcgtagttacagttcacgacaacaccggtcctcccgtcgaccactcgtacgtcgggcctcgaggcgtagacggacgaggtctagtatttacttactgacagtctctaataactacgaacgtacgagaccgagaccgtacgggttcggggttacctttaccgggaacggttacgggaacctaacgggtaccgtaacccggttccgtacccgtacggtaaccaccggaccccgaacggtacccccaacccgtaccg

SEQ ID NO: 85683 - DNA, 779 bp, Homo sapiens
  misc_feature: GYAE6OF02JG6SD.3.28.C06.1.454.CMB.1.raw
tcagagacgcactccacgaccggtgctcgatttagagctcacgtattgggtttgggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttaataactatgtctcctggtatcaacagcaccaggcaaacgaccccaaactcaataattatgatgtcaagtaatcggccctcgtaggggtttctaaattccgtcttacttcgttacgtttactaaaggttctcgggtactaaaccgaaccggtcccttaccccgtcgtaaccctacttccgttaccgttacgggcctttaccccgagggtacccgttagggaacgggtaccgggtaacgggccttagggttaacgttttaaagttttaaccttcgggtacgtaacgtaccgttaccgtaaactttaaacgtaaaccgtaaacgtccgaaacgtacccaaagggtacccaaccgggtttaccgggggtttaacccttaccgggggttaaaacccggttcggggtaaaaccccggtaaacgggttaccccggtaaacccgggtttaacccccggtaccccggttaaaccgttacccgggtaaacccggtcccccgtaaaaaccggggaccccccttaaaccccgttaaccccgg

SEQ ID NO: 85684 - DNA, 652 bp, Homo sapiens
  misc_feature: GYAE6OF02G60AV.3.28.C06.1.454.CMB.1.raw
  modified_base (230)..(230): a, c, t, g, unknown or other
  misc_feature (230)..(230): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcatcgccatctcctgcactggaaccngcagtgacgttggtagttataactatgtctctggtatcaacagcaccaggacaaacgccccaaactcaactaatttactagatgtacaagtaactcggtccctcgtagggtttactaatcgtcttctcgtgttacaagtctggacacgacgcctcctcgaccactctacgtcggctccgagcgtaggacgggtaccgaaggtctaggtatttaacgttactgacgagtcctactaattaacttaacgaacgtcaacgacaacgtaccgaacgggtttcggggttaccgttaccgggaaacggttacccggggaaaccgtaacgggttacccgtaaccccgggttaccccgtaccccggtaccggttacccggtaacccggaacccccgtaaaccgggtaccccccaaaccccgttaacccgg

SEQ ID NO: 85685 - DNA, 649 bp, Homo sapiens
  misc_feature: GYAE6OF02JRJHW.3.28.C06.1.454.CMB.1.raw
  modified_base (231)..(231): a, c, t, g, unknown or other
  misc_feature (231)..(231): n is a, c, g, or t
tcagagacgcactccacgaccggtgctcgatttagagctcacgtattgggtttggggggggtctcaagaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacgttggtgttataactatgtctcctggtatcaacagcaccaggcaaacgcccccaatcataattatagatgtacagtaactccggcctacgtagggtttctaatccgtcttactcgttacggttaacaagttcgtggaccaacgtaccggtcccttccctgaacccatcctcgtcgggctccgaggtctaggaggtacggacggtcctagtaatttacttacgtggtacaggtccttacaattactaaccgaagtaccaaggtaccaacggccgtaaccggttcgggggttaccttaccgggtaaaccgtacgggggaacccttaacgggttccctaacccgggttcccgtaccccgtaacggttccgaacccggtaccccgtaaaccggacccccgtaacccctaacccg

SEQ ID NO: 85686 - DNA, 525 bp, Homo sapiens
  misc_feature: GYAE6OF02GZ9GV.3.28.C06.1.454.CMB.1.raw
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctcctggtatcaacagcacccaggcaaacgccccaaactcataattatgatgtcagtaatcggcctgagggtttctaatcgtcttctctggttacaagtctggacaacgacggcctccctgaccatctctcgggctccgaggctggacggacgaggctagatttattactgcagctacatatacgaagcagacagcacgtgggtcttacgggactaggaaccaggtccaccgtccgccacgtcacgcccgaacggcccaacccgtcg

SEQ ID NO: 85687 - DNA, 688 bp, Homo sapiens
  misc_feature: GYAE6OF02GP56M.3.28.C06.1.454.CMB.1.raw
  modified_base (231)..(231): a, c, t, g, unknown or other
  misc_feature (231)..(231): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacggttggtaggttaactaactatgtctccgtggtatacaacagccacccgaggaccaaaaccgacccccaaactactaacttaaatttactagtatcgtactaagtaacgtccggtccctacggtaacgggtttactaacgtcgtcttctacgttacggttaactaacgttcgtacggactaaaccgaccggtcccttcccgtacgtaacctacgttccgtcggtccggtcgtacccgtagggtcgtacgggaacgggtaaccggacgggtacgttacgttaattttacgttaccgtcgacgtacgtacctaactataactaacgaagccgaagaccgtacgacgtacggtcgggttacgtacgggacggtacggtaaccgtacggtaccgtacccggtcccgtacccgacgttccggaccgacccgaaccggacccctaacccgtaccg

SEQ ID NO: 85688 - DNA, 538 bp, Homo sapiens
  misc_feature: GYAE6OF02HSUAZ.3.28.C06.1.454.CMB.1.raw
  modified_base (434)..(434): a, c, t, g, unknown or other
  misc_feature (434)..(434): n is a, c, g, or t
  modified_base (445)..(445): a, c, t, g, unknown or other
  misc_feature (445)..(445): n is a, c, g, or t
  modified_base (449)..(449): a, c, t, g, unknown or other
  misc_feature (449)..(449): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttaataactatgtctcctggtatcaacagcaccaggacaaacgcccccaaactcaataatttatcgatgtcagtaactcgcctgtagggttactaatcgcttctctgttacaagtctggcaacgacggcctccctgaccatctcgtggctcgagtcgtgacgcggaggctagatttatactgcagctnaatatacgaancagnacgcacgttgggtacttacggacgtacgggacaacggttcaccggtcgtacccgacggtcaccgtacccgaacgccctaaccccgtacg

SEQ ID NO: 85689 - DNA, 589 bp, Homo sapiens
  misc_feature: GYAE6OF02F1TZ0.3.28.C06.1.454.CMB.1.raw
  modified_base (233)..(233): a, c, t, g, unknown or other
  misc_feature (233)..(233): n is a, c, g, or t
  modified_base (408)..(408): a, c, t, g, unknown or other
  misc_feature (408)..(408): n is a, c, g, or t
tcagagacgcactccacgaccggtgctcgatttagagctcacgtattggggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacgttggtgttataactatgtctctggtatcaacagccaccgaggaccaaacgaccccaaactcataatttatgatgtacaagtactcggcctgtagggttctaagtcgcttctctaggttacagtctggacaacgcggtccctcctcgactatctcgtcggcctccgnggtctggaacggaccggagtacgtagttactttagttacgtcgtcgatcctactataatacgaagtccaagtcacgtacgtacggttcggggttacttacgggaccgtagggaacctaacggtacctacccggtccgtacccgacgtaccgaccgacccggtaccgaccccgaccctaccg

SEQ ID NO: 85690 - DNA, 688 bp, Homo sapiens
  misc_feature: GYAE6OF02G6QVS.3.28.C06.1.454.CMB.1.raw
  modified_base (276)..(276): a, c, t, g, unknown or other
  misc_feature (276)..(276): n is a, c, g, or t
  modified_base (299)..(299): a, c, t, g, unknown or other
  misc_feature (299)..(299): n is a, c, g, or t
  modified_base (309)..(309): a, c, t, g, unknown or other
  misc_feature (309)..(309): n is a, c, g, or t
tcagagacgcactccacgaccggtgctcgatttagagctcacgtattgggtttggggggggtctcaggaggcagcgctctcgggacgtctccaccatggcctgggctctgctattcctcaccctctcactcagggcacagggtcctgggcccagtctgccctgactcagcctgcctccgtgtctgggtctccgtggacagtcgatcatcgcctatctcctgcacgtcggaaccagcagtgacgttggtggttataactatgtctctggtatcaacngcacccagacaaacgccccaacncaataattangatgtactagtaacgtccgcctagtacggggtttctaactccgtacttcctcgttacggttaacaaacggttcgtacggtaccaaaccgtaaccggtcccttacccgtacgtaaccctacgttacgttccggtgggtccttccgacggtctaggaacgggacgacggtcttagtaacgtttacttacgtgacctaggtacttactaacttactaaccgaagtaccgaacgcgaacggtaccgtaccgggttacgggtaccgtttacgggaaccggttaccggggaaacctaacgggttcccggtacccggttacccggtaccccgtacggtaccgacccggtaacccccggaacggtacccccgtaaaccccgtaccgg

SEQ ID NO: 85691 - DNA, 282 bp, Homo sapiens
  misc_feature: GYAE6OF02J2S91.3.28.C06.1.454.CMB.1.raw
  modified_base (259)..(259): a, c, t, g, unknown or other
  misc_feature (259)..(259): n is a, c, g, or t
  modified_base (261)..(263): a, c, t, g, unknown or other
  misc_feature (261)..(263): n is a, c, g, or t
  modified_base (265)..(274): a, c, t, g, unknown or other
  misc_feature (265)..(274): n is a, c, g, or t
  modified_base (276)..(282): a, c, t, g, unknown or other
  misc_feature (276)..(282): n is a, c, g, or t
tcagagacgcactccacgaccggtgctcgatttagagctcacgtattggtttgggggtttggtggtctccactccgccttgacgaggctgattattactgcagctcatatacaagcagcagcactgggtcttcggaactgggaccaaggtcaccgtcgtcccacgtcacgcccaaggccaacccactgtccactctcgttccccgccctcctcgacgtcgccgtcctctgacgccgggtctggccaaggccgcatagcncnnngnnnnnnnnnntnnnnnnn

SEQ ID NO: 85692 - DNA, 550 bp, Homo sapiens
  misc_feature: GYAE6OF02FXTHT.3.28.C06.1.454.CMB.1.raw
  modified_base (306)..(306): a, c, t, g, unknown or other
  misc_feature (306)..(306): n is a, c, g, or t
  modified_base (434)..(435): a, c, t, g, unknown or other
  misc_feature (434)..(435): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctctggtatcaacagcaccaggcaaacgccccaaactcataatttangatgtcagtatcggcctgagggtttctaagtcgtcttctctgttacaagtctggacaacacggcctccgtgaccatctcgtcgggctcgacggtctggacggacgaggctgtattattacgtcgaacnnctcatatacaagcagcacgcgacggtcgggtcgttacggaacgtcgggaacctaacgggtccgtacccgtacgtacccgacgtcaccggacccgaaccggacccaaccccgtacg

SEQ ID NO: 85693 - DNA, 566 bp, Homo sapiens
  misc_feature: GYAE6OF02FKQ5E.3.28.C06.1.454.CMB.1.raw
  modified_base (313)..(313): a, c, t, g, unknown or other
  misc_feature (313)..(313): n is a, c, g, or t
  modified_base (326)..(326): a, c, t, g, unknown or other
  misc_feature (326)..(326): n is a, c, g, or t
  modified_base (380)..(380): a, c, t, g, unknown or other
  misc_feature (380)..(380): n is a, c, g, or t
tcagagacgcactccacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatcctcctgcactggaaccagcagtgacgttggtggttataactatgtctcctggtatcaacagcacccaggacaaacgcccccaaactcaataatttangtatgtcagtaanccggccctcgtaggggtttctaatcgtcttctcttggttacagtctggacaacnccggccctcccgtcgacctatcctcgtgggcctccgaggctggacgggacgaggctagtatttatacgtgcagtctacatataacagcagacagctacggtgggtccttacggacgtcgggaaccgtacggtccacccggtccgtacccgccgtaccgaccgacccgaaccggaccccaccctacg

SEQ ID NO: 85694 - DNA, 592 bp, Homo sapiens
  misc_feature: GYAE6OF02FVWS8.3.28.C06.1.454.CMB.1.raw
  modified_base (232)..(232): a, c, t, g, unknown or other
  misc_feature (232)..(232): n is a, c, g, or t
  modified_base (309)..(309): a, c, t, g, unknown or other
  misc_feature (309)..(309): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatcctcctgcactggaaccngcagtgacgttgtgttatactatgtctctggtatcaacagccacccaggacaaacgcccccaaactcaataatttangatgtcagtaatcggcctcgagggtttctaagtctcttctctggttacagtctgacaacgcgccctcctgaccatcctcgtcgggccttccgaggtctcggaagggacggaacggcttagtaatttaacgttacgtcgacacgtcctacgtataacttacgaagccagacacgtactacggttcggggttccttacggaacgtcggggtaaccaacgggttccacccggttccgtacccgacggttccaaccggtaccccgaaggaccccctaacccgtaacg

SEQ ID NO: 85695 - DNA, 561 bp, Homo sapiens
  misc_feature: GYAE6OF02G4JZG.3.28.C06.1.454.CMB.1.raw
  modified_base (200)..(200): a, c, t, g, unknown or other
  misc_feature (200)..(200): n is a, c, g, or t
tcagagacgcactccacgaccggtgctcgatttagagctcacgtattggggtttgggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacngtcgatcatcgccatctcctgcactggaaccagcagtgacgttggtgttataactatgtctcctggtatcaacagccaccaggacaaacgccccaaactcaactaatttatgatgtacagtaatcggccctacgtaggggtttctaatcgtcttctcgttagttacaagtctaggacaacgacgcctcccgtgacctatctcgtcggctccgacggtcgtgaggacgaggctagatttactacgtcgctagctcatatacagcagcagcgtacgtgggtcctacggacgtacgggaaccgtacggtacctaccgtccgaccgtaccgtacgaccgacccgaacggtacccaacccgtaccg

SEQ ID NO: 85696 - DNA, 667 bp, Homo sapiens
  misc_feature: GYAE6OF02G9DL1.3.28.C06.1.454.CMB.1.raw
  modified_base (230)..(230): a, c, t, g, unknown or other
  misc_feature (230)..(230): n is a, c, g, or t
  modified_base (314)..(314): a, c, t, g, unknown or other
  misc_feature (314)..(314): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcatcgccatctcctgcactggaaccngcagtgacgttggtgttataactatgtctcgtggtatcaacagcaacccgaggacaaacgaccccaaactctaacttaatttanagtatgtactaagtaactccggtacctacggtagggtttactaacgtcgtccttccttcgttacgggtttaacctaaggttcgtacgggtacctaaaccggaccggtaccttccccgtagacctactccgtcgtcgggccttccgaggtctacggacggacgtacggcttagtaatttacgttctagctagctactataacgactaacgctaacgactacgacgtaccggttcgggttaccgttacgggaacgttacgggaaacccgttaaccggtccgtaaccccggttcccgtacccggtaaccgttaccgaacccggtaccccgaaacggtaccccaaaccccgttaccg

SEQ ID NO: 85697 - DNA, 578 bp, Homo sapiens
  misc_feature: GYAE6OF02HGPGN.3.28.C06.1.454.CMB.1.raw
tcagagacgcactccacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctcctggtatcaacagcacccaggcaaacgacccccaaactcataatttatgatgtcagtaactccggcctcgtagggtttactaatcgtcttctctgttacaagtctgacaacacggcctccctcgacctatcctcgtcgggtcctccgaggtcgtggaggaccggaggctagtaatttattacgtgcagtctactaattactaacgaagcagacacgacacggttcgggttacttacggacgtacgggaaccgaacggtccacccggtaccgtcccgtacgtccgaccgtacccgaaccggaccccaacccgtaccg

SEQ ID NO: 85698 - DNA, 654 bp, Homo sapiens
  misc_feature: GYAE6OF02JDXLF.3.28.C06.1.454.CMB.1.raw
  modified_base (331)..(331): a, c, t, g, unknown or other
  misc_feature (331)..(331): n is a, c, g, or t
  modified_base (541)..(541): a, c, t, g, unknown or other
  misc_feature (541)..(541): n is a, c, g, or t
  modified_base (548)..(548): a, c, t, g, unknown or other
  misc_feature (548)..(548): n is a, c, g, or t
tcagagacgcactccacgaccggtgctcgatttagagctcacgtattggggtttgggggggggtctcaggaggcagcgctctcgggacgtctccaccatggcctgggctctgctattcctcaccctcctcactcagggcacagggtcctgggcccagtctgccctgactcagcctgccctcgtgtctgggtctcctggacagtcgatcatccgccattctcctgccactggaaccagcagtgacgttggtagttaataactagtcgtctccgtaggtactacaacacgaccaaccgaggaccaaaaccgccccaaactctaattaatttancgtatgtactaagtaacgtccggtccttacggtacgggtttactaattcgtcttacgtcgttacggttaacacgttcgtaggaaccaaccgtaccggacccttcccgtagacctactccgtacgtcggcctccggaggtctagggaacgggacgtaggtctagttaacgtttacttctcgacctgtaccttactaagtactaacgaacgnaacgganacggcctaaggttcggggtacctagggaacgttacggaacccgtaaggtccctaaccggtaccctaccgacgtcccgacgtacccggaaccgacccctaacgtccg

SEQ ID NO: 85699 - DNA, 509 bp, Homo sapiens
  misc_feature: GYAE6OF02GUA9J.3.28.C06.1.454.CMB.1.raw
  modified_base (304)..(304): a, c, t, g, unknown or other
  misc_feature (304)..(304): n is a, c, g, or t
tcagagacgcactccacgaccggtgctcgatttagagctcacgtattgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctcctggtatcaacagcacccaggcaaagcccccaaatcataattangatgtcagtaatcggcctcgagggtttctaatcgcttctctgtacagtctgcaacacggcctcctgaccatctctggctcgaggctgaggacgagctgtaattattacgtgcagctacatatacgagcagcagcacgtgggtcttacggaactgggaacaaggtcaccgtcgtacccgacgtcacgcccaaggtcccaccctacg

SEQ ID NO: 85700 - DNA, 659 bp, Homo sapiens
  misc_feature: GYAE6OF02HFM65.3.28.C06.1.454.CMB.1.raw
  modified_base (200)..(200): a, c, t, g, unknown or other
  misc_feature (200)..(200): n is a, c, g, or t
  modified_base (312)..(312): a, c, t, g, unknown or other
  misc_feature (312)..(312): n is a, c, g, or t
tcagagacgcactccacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcatcgcatctcctgcactggaaccagcagtgacgttggtagttataactatgtctcctggtactcaacagccaccaggacaaacgcccccaaactcaataatttanagatgtacaagtactccggtcctcgtagggtttctagtcgtcttctctgttacagtcgtggacaacgccgtcccgggtacctcgacctactccgttcgtcgggtccttcccgacggtcgtagggaacgggtacggacggtacgtagttacgtttaacgttcgtacggactacggtactactataacgtaacaacgacgaacgccgtaacgtaccgtacgggttacgggttaccgttacgggtaaccggttacgggaaacccggtaacgggtacccgtacccggttacccgtcccgtaaccgtaccggaacccgaccccggtaaccgacccccgtaccccgtaaccgg

SEQ ID NO: 85701 - DNA, 670 bp, Homo sapiens
  misc_feature: GYAE6OF02G1R63.3.28.C06.1.454.CMB.1.raw
  modified_base (232)..(232): a, c, t, g, unknown or other
  misc_feature (232)..(232): n is a, c, g, or t
tcagagacgcactccacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacgttggtagttataactatgtctcctggtatcaacagcacccaggacaaacgcccccaaactcattaatttatgatgtcagtaactcggcctcgtagggtttctaactcgtcttctcttaggttacagtcgtggcaacgacggtccctcccgtgaccctatcctcgtcggtcctccgaggtcgtaggacgggacggaaggtccgttaagttacgtttaactttacggtacgcgtaacgtcctactaagttaactaaccgaagtaccgaacgaccgaggtaccgtacgggtttccgggggtaccgttttaccgggaaccggttaccgggggtaaacccgtaaagggttcccctaaccccgggttcccgtacccccgtaccggtacccgtaccggaacccccgtaaaccgggcccctaaaccccccgtaccgg

SEQ ID NO: 85702 - DNA, 537 bp, Homo sapiens
  misc_feature: GYAE6OF02F75K1.3.28.C06.1.454.CMB.1.raw
  modified_base (386)..(386): a, c, t, g, unknown or other
  misc_feature (386)..(386): n is a, c, g, or t
  modified_base (438)..(438): a, c, t, g, unknown or other
  misc_feature (438)..(438): n is a, c, g, or t
tcagagacgcactccacgaccggtgctcgatttagagctcacgtattggggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctcctggtatcaacagcaccaggcaaacgccccaaactcattaattatgatgtacagtaagtccggcctcgtagggtttactaatcgtacttctctaggttacaagtctggacaacgcgccctccngacctatctcgtgggcctccgaggctggaggacgaggctagatttagttacngacagctcatatacaagcagcagctaggtgggtcttacggaacgtgggaacctaggcctaccgtcgtcccacgtcacgacccaacggcccaacccgtcg

SEQ ID NO: 85703 - DNA, 595 bp, Homo sapiens
  misc_feature: GYAE6OF02GXRZI.3.28.C06.1.454.CMB.1.raw
  modified_base (232)..(232): a, c, t, g, unknown or other
  misc_feature (232)..(232): n is a, c, g, or t
  modified_base (472)..(472): a, c, t, g, unknown or other
  misc_feature (472)..(472): n is a, c, g, or t
  modified_base (488)..(488): a, c, t, g, unknown or other
  misc_feature (488)..(488): n is a, c, g, or t
tcagagacgcactccacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacgttggtgttataactatgtctcctggtatcaacagcacccaggcaaacgacccccaaactcaataatttatgatgtcagtaatccggtccctcggtagggtttctaacgtcgtcttctcgtaggttaacaagtctggacaacacggtccctcctacgaccatcctcgtcgggtcctccgaggtcgtaggaacgggacggacggctggtaactttagttacgtgcagtcctanaatatacaacgcgtancgtaacgcgtacggttcgggtaccttacgggaacgtcgggaaccgtacggtccctaacccggttccgacccgtacgtccaacggcccgaacggacccaaccccgtcg

SEQ ID NO: 85704 - DNA, 526 bp, Homo sapiens
  misc_feature: GYAE6OF02IL4TB.3.28.C06.1.454.CMB.1.raw
  modified_base (367)..(367): a, c, t, g, unknown or other
  misc_feature (367)..(367): n is a, c, g, or t
  modified_base (420)..(420): a, c, t, g, unknown or other
  misc_feature (420)..(420): n is a, c, g, or t
  modified_base (425)..(425): a, c, t, g, unknown or other
  misc_feature (425)..(425): n is a, c, g, or t
  modified_base (434)..(434): a, c, t, g, unknown or other
  misc_feature (434)..(434): n is a, c, g, or t
tcagagacgcactccacgaccggtgctcgatttagagctcacgtattggggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttaataactatgtctcctggtatcaacagcacccaggcaaagcccccaaactcataattatgatgtcagtaatcgcctcgagggtttcaagtcgcttctctggtacaagtctggcaacncggcctcctgaccatctcgtggctcaggctgaggacgagctgattatctgacngctanatatacaancagcagcagtgggtcttacggaactcgggaacctacggtccaccgtccgtacccgacgtaccgaccgtacccgaacgtccccaacccgtacg

SEQ ID NO: 85705 - DNA, 270 bp, Homo sapiens
  misc_feature: GYAE6OF02G5GFC.3.28.C06.1.454.CMB.1.raw
  modified_base (265)..(270): a, c, t, g, unknown or other
  misc_feature (265)..(270): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacatggtcctgggcccagtctgccctgactcagcctgcctccgtgtctgggtctcctggacagtcgatcatcgccatctctgcactggaaccagcagtgacgttggtggttataactatgtcttccgnnnnnn

SEQ ID NO: 85706 - DNA, 738 bp, Homo sapiens
  misc_feature: GYAE6OF02HIEWC.3.28.C06.1.454.CMB.1.raw
  modified_base (245)..(245): a, c, t, g, unknown or other
  misc_feature (245)..(245): n is a, c, g, or t
tcagagacgcactccacgaccggtgctcgatttagagctcacgtattgggtttgggggggtcgtcgaggaggcgagcgctcgtcgggacgtctccaccatggcctgggctctgctattcctcacctctcactcagggcacagggtcctgggcccagtccgtgccctggactcgagccctgccctccggtgtccgtgggtctccgtaggacagtcgatcagtcgccattctcctgcactggaaccngcagtgacgtggtagttataactatgtctctgtatacaacagaccaccgagacaaaaccgaccccaaactcaaacttaatttactagtactagtactaagttaaacgtccggtacccgtacgttaacgggggtttaactaacgtaccggtcttttaccgtacgttacggttaactaaacggttccgtagggtaccctaaacgtacccggtacccgtaccccgtaggtaaccctaacttcgttacccgtgggtaccccgtaccgacgggtacgttacggacgggaaccggaagggtccctaaggttaactttaacgttacgtacgtaacgtacgtaccgtacttaaagttaaacctacgtaaacgcttaacgacgtaaacggtcgtaacggttacggggtcttaaccgggacgttacgggaaacctacggtaccgacccggttaccggtccctaacgtcgaaccggtaccgaaccgtaccccgaaacccgtccg

SEQ ID NO: 85707 - DNA, 531 bp, Homo sapiens
  misc_feature: GYAE6OF02FWJE4.3.28.C06.1.454.CMB.1.raw
  modified_base (304)..(304): a, c, t, g, unknown or other
  misc_feature (304)..(304): n is a, c, g, or t
  modified_base (428)..(428): a, c, t, g, unknown or other
  misc_feature (428)..(428): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctcctggtatcaacagcaccaggcaaagcccccaaatcataattangatgtcagtaatcggccctcgagggtttctaagtcgcttctctggttacaagtctggacaacgacggcctcctcgaccatctcgtgggcctccgaggctggacggacgaggctgaattattacngcagctcatagacaagcagcagcgagtcgggtcttacggacgtagggaccaaggtccgaccgtccgtacccgacgtcgaccgcccgaacggacccaccctacg

SEQ ID NO: 85708 - DNA, 606 bp, Homo sapiens
  misc_feature: GYAE6OF02FIKRQ.3.28.C06.1.454.CMB.1.raw
  modified_base (245)..(245): a, c, t, g, unknown or other
  misc_feature (245)..(245): n is a, c, g, or t
  modified_base (457)..(457): a, c, t, g, unknown or other
  misc_feature (457)..(457): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggnggttataactatgtctcctggtattcaacagccaccaggcaaacgccccaaactcaataattatgatgtacagtaatcggccctcgtaggggtttactaacgtcgtcttctcgtaggttactaagtctggtacaacgtaccggcctcccgtagaccactctacgtgggtcctccgaaggtcgtaggacggacgagcttagtacttattacgngccagtcctacgaatataacaagtacaacgtcaagactacggtcgggtaccttacgggaaactcggggaaaccgtaacggtacctaacccggttccggtaccctaccggtaccgaaccgacccgaacggaccccctaacccctaaccgg

SEQ ID NO: 85709 - DNA, 583 bp, Homo sapiens
  misc_feature: GYAE6OF02JUCUX.3.28.C06.1.454.CMB.1.raw
  modified_base (273)..(273): a, c, t, g, unknown or other
  misc_feature (273)..(273): n is a, c, g, or t
  modified_base (307)..(307): a, c, t, g, unknown or other
  misc_feature (307)..(307): n is a, c, g, or t
  modified_base (337)..(337): a, c, t, g, unknown or other
  misc_feature (337)..(337): n is a, c, g, or t
  modified_base (385)..(385): a, c, t, g, unknown or other
  misc_feature (385)..(385): n is a, c, g, or t
  modified_base (422)..(422): a, c, t, g, unknown or other
  misc_feature (422)..(422): n is a, c, g, or t
tcagagacgcactccacgaccggtgctcgatttagagctcacgtattggggtttggggggggtctcaggaggcagcgctctcgggacgtctccaccatggcctgggctctgctattcctcaccctctcactcagggcacagggtcctgggcccagtctgccctgactcagcctgcctccgtgtctgggtctcctggacagtcgatcatccgccatctcctgcacgtggaaccagcagtgacgttggtgtataactatgtctctggtatcaacnaccaccagacaaacgccccaaactcataacttangatgacagtactcgccctagtggttactancgtctactctagttacagtcgtgacaaccgcggccctccgtacgaccntaccgtgtcggtcgtaccgaggcgtacggaggaccgngcgtatacgttatccgtgcacgtcgttcaatacgttaacagtcacgactaagcgtacggtgggttccgtacgggtacgtacgggaacccgtaggtccgtaaccggtcccgtaccgtaccggtccgaaccggttacccgaaccggtaccccacccgttaccg

SEQ ID NO: 85710 - DNA, 570 bp, Homo sapiens
  misc_feature: GYAE6OF02HADIE.3.28.C06.1.454.CMB.1.raw
  modified_base (233)..(233): a, c, t, g, unknown or other
  misc_feature (233)..(233): n is a, c, g, or t
  modified_base (315)..(315): a, c, t, g, unknown or other
  misc_feature (315)..(315): n is a, c, g, or t
  modified_base (418)..(418): a, c, t, g, unknown or other
  misc_feature (418)..(418): n is a, c, g, or t
tcagagacgcactccacgaccggtgctcgatttagagctcacgtattgggtttggggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacgttggtgttaataactatgtctccttggtatcaacagacacccaggacaaacgcccccaaactcaataatttangatgcaagtaatcggcctcgtagggtttctaatcgtcttctctggttactacgtctggcaacgacgtccctccgtacgacctactctcgtggcctccgagtcnggagacggagctagtatttacgttactgacacgtctactataactacaagacagacagactacggtcgggtacgttacggacggtacgggaaccgtaacggtcgtacccgtccgtacccgacgtcgaccgacccgaccgacccaaccctacg

SEQ ID NO: 85711 - DNA, 874 bp, Homo sapiens
  misc_feature: GYAE6OF02JBUZQ.3.28.C06.1.454.CMB.1.raw
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcatcgcatctcctgcactggaaccagcaggtgacgttggtagttataactatgtctcctggtatcaacagcaccaggcaaacgccccaaactcaataattatgatcgtacagttaatccggtccctggtacggggttttactaacgttccggtaccttccgttcgttacggtttaacctaacgttcgtacgggtacctaaaccgtaccggtaccccgttccccgttaacggaacccgttacgttacccggttacccggttccggggtacccgttaccccggtaacggggtccgttacggggtaaacgggaccggggttaaccgggaccgttaacggtttaacttttaacgttttaaacccggtggtaaccctacggtacccttaacgtaaacgttaaacgtaaaccgaaaccgtaccgaaacggttcccgtaacgggtacccgttaaaccggggtttacccggggggttttacccgtttaaacccgggggtaaaccgggtttaccgggggtaaaaaccccgggttaacccgggtttaccccgggtaaacccccgggttttaccccggttaacccccggttaacccgggttacccgggtaaaccccgggttaaacccccccggaaacccggggaaacccccccgttaaaccccccggttaaaccccggg

SEQ ID NO: 85712 - DNA, 661 bp, Homo sapiens
  misc_feature: GYAE6OF02JD5CD.3.28.C06.1.454.CMB.1.raw
  modified_base (231)..(231): a, c, t, g, unknown or other
  misc_feature (231)..(231): n is a, c, g, or t
  modified_base (273)..(273): a, c, t, g, unknown or other
  misc_feature (273)..(273): n is a, c, g, or t
  modified_base (305)..(305): a, c, t, g, unknown or other
  misc_feature (305)..(305): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacgttggtagttataactatgtctctggtatcaacngcaccagacaacgaccccaaactcataattangatgtacaagtaactcggacccttcgtacgggtttactaactcgtacttctctaggttacaagttcgtacggtacaacgccggtacctcccgtacgaccacttcgtcgtcgggcctaccggcggtcgtaggacggacgacggcgttagttaactttacttacgtacgacgtacgtaccttactataacgttacgaacgacgtaacgcctacggtaaccgtacgggttacggggttaccgttaccgggtaaccgtacgggggtaacccgtaaaccgggttaccgtaacccggttacccgtacccggtaacgtcccgaaccggtaccccggaaccgggaccccctaacccgttaaccg

SEQ ID NO: 85713 - DNA, 602 bp, Homo sapiens
  misc_feature: GYAE6OF02IR9PO.3.28.C06.1.454.CMB.1.raw
tcagagacgcactccacgaccggtgctcgatttagagctcacgtattggggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcaccaggacaaacgcccccaaactcataattatgatgtcagtaatcgccctcgtagggtttctaatcgcttctctggttacaagtctggacaacaccggcctccctcgaccatccgtactcggggctccgaggctaggacggacggaggcgttaggtaatttagttacgtcgctagtcctacgtaatacgtaacaagccagcgagacgtacgtcgggttaccgttacgggtaaccgtcggggaaaccgtaacgggtcctaacccggtcccggttacccgaccgtacgtaccgacccggaaaccggtacccgaacccccgtaaccg

SEQ ID NO: 85714 - DNA, 657 bp, Homo sapiens
  misc_feature: GYAE6OF02G2PH3.3.28.C06.1.454.CMB.1.raw
tcagagacgcactccacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactcggaaccagcagtgacgttggtgttataactatgtctctgtatcaacagcaccaggacaaaccgacccccaaactactaattaaatttatagatgtacaagtaacgtccggtaccctacgtaggggtttactaacgtcgtcttcttctaggttaactagttctggacaaccgaccgccctcccgtacgaccctatcctacgtcgggtacctccgacggtcgtagggaacgggacggacggtcgtagttaatttacgtttacgtgacgtactacgtactaattaacgtaacgaacggtccaacgtacgaacgtcgtacgggttcggggttaccgttacgggtaacggtaccgggaaaccgtaacggtaccgtaccggttacccgtacccgtacgtccgaaccggaccccggaacggacccctaacccgtacgg

SEQ ID NO: 85715 - DNA, 540 bp, Homo sapiens
  misc_feature: GYAE6OF02GEML2.3.28.C06.1.454.CMB.1.raw
  modified_base (245)..(245): a, c, t, g, unknown or other
  misc_feature (245)..(245): n is a, c, g, or t
  modified_base (308)..(308): a, c, t, g, unknown or other
  misc_feature (308)..(308): n is a, c, g, or t
  modified_base (329)..(329): a, c, t, g, unknown or other
  misc_feature (329)..(329): n is a, c, g, or t
  modified_base (380)..(380): a, c, t, g, unknown or other
  misc_feature (380)..(380): n is a, c, g, or t
  modified_base (429)..(429): a, c, t, g, unknown or other
  misc_feature (429)..(429): n is a, c, g, or t
  modified_base (447)..(447): a, c, t, g, unknown or other
  misc_feature (447)..(447): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggnggttataactatgtctcctggtatcaacagcacccaggcaaagccccaaactcataatttacngatgtacagtaatcggccctnaggggtttctaatcgcttctctggttacaagtctggcaacacggcctaccngacatctacgtggctcaggctgaggacgaggctgattatactgcagctnaatatacaagcagacgancgacgttggggtaccttcgggaactgggaaaccaagggtcctaccggtccgtacccgacggttccaaccgcccaaacggccccaaccccgtcg

SEQ ID NO: 85716 - DNA, 533 bp, Homo sapiens
  misc_feature: GYAE6OF02FJRM1.3.28.C06.1.454.CMB.1.raw
  modified_base (232)..(232): a, c, t, g, unknown or other
  misc_feature (232)..(232): n is a, c, g, or t
  modified_base (387)..(387): a, c, t, g, unknown or other
  misc_feature (387)..(387): n is a, c, g, or t
  modified_base (426)..(426): a, c, t, g, unknown or other
  misc_feature (426)..(426): n is a, c, g, or t
  modified_base (436)..(436): a, c, t, g, unknown or other
  misc_feature (436)..(436): n is a, c, g, or t
tcagagacgcactccacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacgttggtggttataactatgtctcctggtatcaacagcacccaggcaaagcccccaaactcaataatttatgatgtcagtaatcggccctgtagggtttctaatcgcttctctgttacaagtctaggcacacgcctcctgaccatctntcgggctcgaggctgaggacgaggctagtatagtttacncgcaagtctntaatatacaacgcagcagcacgtgggtcttacggaacgtcgggaaccacggtcacccgtcgtcccacgtcacgacccgaacgaccctaccccgtacg

SEQ ID NO: 85717 - DNA, 575 bp, Homo sapiens
  misc_feature: GYAE6OF02F4NN8.3.28.C06.1.454.CMB.1.raw
  modified_base (273)..(273): a, c, t, g, unknown or other
  misc_feature (273)..(273): n is a, c, g, or t
tcagagacgcactccacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatcctcctgcactggaaccagcagtgacgttggtgttatactatgtctctggtatcaacngcaccaggacaaacgcccccaaactcataatttatgatgtcagtaatcggccctgtagggttctatcgcttctcgtgttacagtctgacaacgccggcctcccgtcgacctatcctcgtcggccgtccgacggcgtgacgggacggacggctgtattatacgtcgctgctcgaatactaacaacgtcgagcgacgcgtaccggtgggttcctacgggaacgtacgggaaccgtaacggtccgtaacccggtccgttacccgaccgtaccgaccggacccgaccggtaccccaacccctaccg

SEQ ID NO: 85718 - DNA, 592 bp, Homo sapiens
  misc_feature: GYAE6OF02IKJ0X.3.28.C06.1.454.CMB.1.raw
tcagagacgcactccacgaccggtgctcgatttagagctcacgtattggggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttaataactatgtctcctggtatcaacagcaccagcaaacgcccccaaactcaattaattatgatgtacagtaactccggtccctcgtaggggttttactaagtccgtcttctctggttactaagtctgacaacgaccgccctcccgtcgacctatcctcgtcgggcctccgacggcgtaggacggacggaggctagtatttatacgtgacagtactcaatataacacgacagcacgacgtacggtcgggttacttacgggaacgtcgggaaccgtaacggtcctacccggttaccgtacccgtacgtaccgaccgacccgaaccggaccccaaccccgtaccg

SEQ ID NO: 85719 - DNA, 682 bp, Homo sapiens
  misc_feature: GYAE6OF02GYBWF.3.28.C06.1.454.CMB.1.raw
  modified_base (231)..(231): a, c, t, g, unknown or other
  misc_feature (231)..(231): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacgttggtgttataactatgtctctgtatcaacagcaccgagacaaacgacccccaaactcaattaacttatagtatgtcaagtaacgtcggtaccctagtacggggtttctaagtcgtcttctcgttggttaactaagttcgtcggactaacgtaccggacctcccgtacgtaacctactccttcgtacgggtcctaccgacgggtcgtacggacgggacggacggtacgttagtaacgttttaacttacgtacgtacgtacgtacttacaattaactaacgaacgtacgaacgaccgtaacgtacgtaaacggttcgggggttaccgttacggggaacggtacggggtaaacccgtaacgggttaccgtaacccggttcccgtaccccgtaccggtaccggaacccgaaccccggtaacggtaccccctaaaccccgtacccg

SEQ ID NO: 85720 - DNA, 571 bp, Homo sapiens
  misc_feature: GYAE6OF02FPUID.3.28.C06.1.454.CMB.1.raw
  modified_base (230)..(230): a, c, t, g, unknown or other
  misc_feature (230)..(230): n is a, c, g, or t
  modified_base (307)..(307): a, c, t, g, unknown or other
  misc_feature (307)..(307): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcatcgccatctcctgcactggaaccngcagtgacgttggtgttataactatgtctcctggtatcaacagcaccaggccaaacgcccccaaactcataatttangatgtcaagtaactcggccctcgtaggggtttctaatcgtacttctctggttaactaagtctggacaacgacgcctcctgaccatctcgtcggctcgaggctaggaggacgaggcctagtaacttattacttgcgtagctacaatagtaacaacgctaacgccaagtccgtacgtgggttaccttacggaacggtcgggaaccgtaacggtccaccgttcgaccctacggtccgaacgacccgaaccggtacccaaccgtaccg

SEQ ID NO: 85721 - DNA, 664 bp, Homo sapiens
  misc_feature: GYAE6OF02H4MXN.3.28.C06.1.454.CMB.1.raw
  modified_base (147)..(147): a, c, t, g, unknown or other
  misc_feature (147)..(147): n is a, c, g, or t
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
  modified_base (225)..(225): a, c, t, g, unknown or other
  misc_feature (225)..(225): n is a, c, g, or t
  modified_base (233)..(233): a, c, t, g, unknown or other
  misc_feature (233)..(233): n is a, c, g, or t
tcagagacgcactccacgaccggtgctcgatttagagctcacgtattgggtttggggggggtctcaggaggcagcgctctcgggacgtctccaccatggcctgggctctgctattcctccaccctcctcactcagggcacaggtccngggcccagtctgccctgactcgagcctgcctccgtgtctgggtctcctggcngtcgatcancgccatctcctgcacgnggaaaccngcgagtgtagttggtagttaactacgtagtcgtcgtcgtagtacacaacgacgaccgaccgaagaaccaaaccgacccctaaactacttaattaagttagtagtagtacgtactaacgtaccgtccgtaccgtacggtacggttactaacgtccgtcgttcgttacgtaggttaacgtaacgtcgtacggtaccgaaccgtacccgtcccgtaccctacgtacctacgttaccgtcggtacggtccgtcgtacggtacgtacggtacggaaggtacgacgttagttaactttacgtacgtcgtacacgtacgtacgtaacgtaactacgaacgacgacgacgacgacgtacggtcggtacgtacgtacggtacggacgtacgtacgtaccgtccgtaccgtacgacgaccgaccgaccgaccgaccgtacg

SEQ ID NO: 85722 - DNA, 635 bp, Homo sapiens
  misc_feature: GYAE6OF02JG4IR.3.28.C06.1.454.CMB.1.raw
  modified_base (199)..(199): a, c, t, g, unknown or other
  misc_feature (199)..(199): n is a, c, g, or t
  modified_base (271)..(271): a, c, t, g, unknown or other
  misc_feature (271)..(271): n is a, c, g, or t
  modified_base (473)..(473): a, c, t, g, unknown or other
  misc_feature (473)..(473): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcatcgccatctcctgcactggaaccagcagtgacgttggtgttaatactatgtctctgtatcaacngcaccaggacaaacgcccccaaactccaattaactttatgatgtacagtaactcggaccctagtacggggtttactaacgtcgtcttcttctaggttaacaaggttctacggactaacgaccggtccctccctcgaacctacttctaccgtgggtcctccgacgtcgtggacggacggtacggtcgtagtatttacttacgngtcgtacgctactataatacgaaacgtcaacgtcgacgaccgtacggtcgggttacgttacggaacggtacgggtaaccgtaacggtccgtaacccgggttcccgtacccgtaccggtaccgacccggtaccccgaaccgggacccctaaacccccgtaccg

SEQ ID NO: 85723 - DNA, 607 bp, Homo sapiens
  misc_feature: GYAE6OF02FQLSD.3.28.C06.1.454.CMB.1.raw
  modified_base (233)..(233): a, c, t, g, unknown or other
  misc_feature (233)..(233): n is a, c, g, or t
  modified_base (279)..(279): a, c, t, g, unknown or other
  misc_feature (279)..(279): n is a, c, g, or t
tcagagacgcactccacgaccggtgctcgatttagagctcacgtattggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatcctcctgcactggaaccngcagtgacggttggtagttataactatgtctcctggtatcaacacncacccgaggaccaaaccgacccccaaactacaattaatttatagtatgtcaagtaatccgccctaggtagggttactaatcgtcttctgttggttaacagtctacgacaacgacggccctccctcgacctatcctgtacggcctaccgtaggcgtagagggacgaggtacgtgtattattacgtagacgatccgtactaagtaactaactagacgacacgacgtcgtaacgtcgggttacgtacggacggtacggtaacgacggtaccgtacccgttccggtaccgtacggtcccaaccggacccggaacggtccccaacccttaccg

SEQ ID NO: 85724 - DNA, 579 bp, Homo sapiens
  misc_feature: GYAE6OF02FL406.3.28.C06.1.454.CMB.1.raw
  modified_base (231)..(231): a, c, t, g, unknown or other
  misc_feature (231)..(231): n is a, c, g, or t
  modified_base (410)..(410): a, c, t, g, unknown or other
  misc_feature (410)..(410): n is a, c, g, or t
  modified_base (426)..(426): a, c, t, g, unknown or other
  misc_feature (426)..(426): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgcatcctcctgcactggaaccngcagtgacgttggtgttatactatgtctctggtatcaacagcaccaggacaaacgacccccaaatcaattaatttatgtatgtacagttaatccggtcctgtagggtttactatccgtcttctctaggttaacagtctgacaacgacgtcctcctcgacctatcctcgtcggctaccgnggctggacggaggcgntagtactttagtactgctagctacgtataacgacagtcgaagcctacgcaggttcgggttaacttcgggtaacgtcgggaaccgtaaggtcccgtaccggttccgtacccggagttacccgaccgaccccggaaccggtaccccacccgtacg

SEQ ID NO: 85725 - DNA, 557 bp, Homo sapiens
  misc_feature: GYAE6OF02IB0ZO.3.28.C06.1.454.CMB.1.raw
tcagagacgcactccacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggtttataactatgtctcctggtatcaacagcacccaggcaaacgacccccaaactcaattaatttatgatgtcagtaatccggcctcgtagggtttctaatcgcttctctggttacaagtctggcaacacggtcctcctgaccatctcgtcgggcctccgaggtctaggaggacgaggcttagtaatttacttacgtgtccgatcctatataatacaagcagacagacgacgttggggttcttacgggaacttgggacctaaggtcacccgtcgtcccgacgtcgaccgtacccacggacccacccgtcg

SEQ ID NO: 85726 - DNA, 625 bp, Homo sapiens
  misc_feature: GYAE6OF02HIKDE.3.28.C06.1.454.CMB.1.raw
  modified_base (467)..(467): a, c, t, g, unknown or other
  misc_feature (467)..(467): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtagttataactatgtctcctggtatcaacagccacccaggaccaaacgacccccaaactcattaacttatgatgtacagtaactcggccctcgtaggggttctaagtcgtcttctcgttacggttacaagttcgtaggacaaccgaccggtccctccctacgacctactcgtcgtcgggctccgaggctcggaggacgaggtctagtatttacttacgtgacngccttacattaactacgaacgcgagacgacgccgacggttggggttaccgttacggggtaacgttaccggggaacggttaacggtaccgtaaccccggttccgtaccccgtaacggttccgaccgtaccccggaaccggtaccccaaccccgtacccg

SEQ ID NO: 85727 - DNA, 685 bp, Homo sapiens
  misc_feature: GYAE6OF02JMPJS.3.28.C06.1.454.CMB.1.raw
  modified_base (233)..(233): a, c, t, g, unknown or other
  misc_feature (233)..(233): n is a, c, g, or t
  modified_base (277)..(277): a, c, t, g, unknown or other
  misc_feature (277)..(277): n is a, c, g, or t
  modified_base (320)..(320): a, c, t, g, unknown or other
  misc_feature (320)..(320): n is a, c, g, or t
tcagagacgcactccacgaccggtgctcgatttagagctcacgtattgggtttgggggggggtctcaggaggcagcgctctcgggacgtctccaccatggcctgggctctgctattcctcaccctctcactcagggcacagggtcctgggcccagtctgccctgactcagcctgcctccgtgtctgggtcctcgtggacagtcgatcatcgaccatctctgctactggaaccngcagtgtacggttggtgttataactatcgtctcgtgtatacacngccaccgtaggaccaaaccgacccctaaatctaattaacttanacgattgtacaagtacgtccggtacccgtaggtacgggttcctaacgtcgtacttccgtgttacggtaactacgtcgtgacctaaccgccgtccctaccgtacgtacctagtctacggtcggcctaccgacggttcgagggacggacgtacggtacctagttaaccgtttagtccgtagaccgtacgtacctagttaaacttacgaacgtacgacgtaaccggctaacggtccgtacgggttacgggttaccgttaccggggacgttaccggggaacccgtaaggttaccccgtacccggttacccgtacccgtaccggtaccgaacccggtaacccgtaacccggaccccctaccccgtaacgg

SEQ ID NO: 85728 - DNA, 688 bp, Homo sapiens
  misc_feature: GYAE6OF02I2UJ2.3.28.C06.1.454.CMB.1.raw
  modified_base (221)..(221): a, c, t, g, unknown or other
  misc_feature (221)..(221): n is a, c, g, or t
  modified_base (232)..(232): a, c, t, g, unknown or other
  misc_feature (232)..(232): n is a, c, g, or t
  modified_base (251)..(251): a, c, t, g, unknown or other
  misc_feature (251)..(251): n is a, c, g, or t
  modified_base (275)..(275): a, c, t, g, unknown or other
  misc_feature (275)..(275): n is a, c, g, or t
tcagagacgcactccacgaccggtgctcgatttagagctcacgtattgggtttgggggggtctcaggaggcagcgctctcgggacgtctccaccatggcctgggctctggctattcctcaccctcctcactcagggcacagggtcctgggcccagtctgccctgactcacgcctgcctcgtgtctgggtctccgtggaccagtcgatcatcgcatctcctncactggaaccngcagtgacgttggtgttanaactatgtctccgtgtatctaacncgaccaccgaggaccaaacgaccccctaaactacaataactttatgatcgactagtaacgtcgtcctacgtacgggtttctaactcgtacttctccttacgggtttaacacgttcgtacgacgaaaccgtaccggtccctacccgtcgaaccctatccgtacgtcgggcttaccggaggcttgggaacggaccggtacggcgttacgtaacgtttcgtaaccgtgtacccgatccgacttaacttaacggtaaccctaaagggcccaggtacgtaacgttcccgttaacgggttcgggggtttaccctacgggttaaacccgtacgggtaaccgaaccgggttacccaaccggttcccgtaccccgtagtacccgtaccggacccctaaaccgggtccccaaccccctacggg

SEQ ID NO: 85729 - DNA, 781 bp, Homo sapiens
  misc_feature: GYAE6OF02J29AJ.3.28.C06.1.454.CMB.1.raw
  modified_base (269)..(269): a, c, t, g, unknown or other
  misc_feature (269)..(269): n is a, c, g, or t
  modified_base (290)..(290): a, c, t, g, unknown or other
  misc_feature (290)..(290): n is a, c, g, or t
  modified_base (330)..(330): a, c, t, g, unknown or other
  misc_feature (330)..(330): n is a, c, g, or t
  modified_base (525)..(525): a, c, t, g, unknown or other
  misc_feature (525)..(525): n is a, c, g, or t
tcagagacgcactccacgaccggtgctcgatttagagctcacgtattgggtttggggggggtctcaggaggcagcgctctcgggacgtctccaccatggcctgggctctgctatcctcaccctcctcactcagggcacgagggtcctgggcccagtctcgccctgactcagcctgcctccgtgtctgggtctcgtggacagtcgatcatcgccatccgtcctgacacgtaggaaccagctagtcgtacggtttggtagttactaacttntcgtctctagtactacaacgnaccaccgacggaaccaaccgaccccaaatctaattattanagtatacgtacgtaacgttacgccgtccgttacggtggtttactactccgtacttcgtcgtaaggtactacgtacgtacggacaacccggtccgtacccttccacggtacctatccggttacgcggtcctacgcggtacgtacgggacggtaacggtacgtcgttaagtactttacgttacgtctaccggtaacnccgttaatacggtttaaactaccggtaaacgtcggtaacccggttaaccgaacgggttaccccggttaacggggttttccgggtaacccgggtttaaaccgggttacccggggttaaacgggtaaacccccgggttaaaccgggttaccccgttaccccgggtaacccccgggtttacccgtaacccgggttaaccccggaaccccgggttaaccccctaaacccgggaaccccccgttaacccgttaaccccggg

SEQ ID NO: 85730 - DNA, 564 bp, Homo sapiens
  misc_feature: GYAE6OF02FK5HI.3.28.C06.1.454.CMB.1.raw
tcagagacgcactccacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctcctggtatcaacagcacccaggcaaacgcccccaaactcataatttatgatgtcagtaatcggcctcgagggtttctaatcgtcttctctgttacagtctggacacacggcctcctgaccactctcgtggcctccaggctcggaggacgaggctgtaactttattactgtacagtctacgatatacaagtcagcacgcacggttgggtccttacgggaacgtacgggaacctaacggttcccgtacccgttacggtccccgtacgtccgaccgtaccccgaacgggaccccaacccctaccgg

SEQ ID NO: 85731 - DNA, 748 bp, Homo sapiens
  misc_feature: GYAE6OF02I6I5T.3.28.C06.1.454.CMB.1.raw
  modified_base (274)..(274): a, c, t, g, unknown or other
  misc_feature (274)..(274): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggctcagtctgccctgactcagcctgcctcgtgtctgggtctcctggacagtcgatcatccgccatctcctgcactggaaccagcagtgacggttggtagttatactatgtctctggtatacaacngacaccgagacaaacgccccaactcaattaattatgtatgtacagttaactccgtaccgtcgtaggggtttactaacgttccgtctttccgtacgttacggttaacgtaacggttacgtacgggtacctaaaccggtacccgggtccccttaccccgtacggaacccttacgttcccgtttacggtacggggttcccctacccggtacgggtccgttacgggaaccgggtaacgggtacgggtccgttagttaacgttttaacgtttaccgtacgtaccgtacggtaccttacgtaataacgtaacctaacggacctaagaccgaacggtaccgtaccgggtttacggggttaccgtttaccgggtaacggtacggggtaaacccgttaacgggttacccgtacccggttacccggtaccccgtaccggttacccgaaccggtaccccggaacccggtaccccgtaacccccgg

SEQ ID NO: 85732 - DNA, 847 bp, Homo sapiens
  misc_feature: GYAE6OF02I4R41.3.28.C06.1.454.CMB.1.raw
tcagagacgcactccacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatacgccactctcctgcacctcggaaccagcagtgtacgttggtggttataactatgtctcctgtatacaacacgcacccaggacaaacgaccccaaaccacataactttatgatcggtacaagttaactccggtcccgtacgtacggggtttactaacgtcgtaccttcttccgttacgggtttaactaagttccggttacggaccaaacccgtaacccgggtccccgttaccccgttaccggtaaccctaacgtttcccgttaccgggtccgggtaccccggtttaccccggacggtacccggttacgggaacggggtaaaccggggaccggtaccggttttcgggtaaactttttaaccggttaccgttacggccctaaagggtcccttacctaaatttaaacggttaaacctaaacggggtccaacggtaaccgaacggttaccccggtaaaggggttttcggggggttaaccccggttttaccggggaaaaccggtttaccgggggtaaacccggtaacgggtttacccgtaacccccggggtttaccccggttaaccccggtttacccggttaacccgaacccgggtaacccccggtaaacccggggtaccccccaaacccccgggtttaaccc

SEQ ID NO: 85733 - DNA, 809 bp, Homo sapiens
  misc_feature: GYAE6OF02IWT6E.3.28.C06.1.454.CMB.1.raw
tcagagacgcactccacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtaggttaataactatgtctccttggtatacaaacacgccacccgaaggacaaaaccgacccccaaaactctaattaactttagtagatgtacaagtaagtccggtcctaccggtaaggggtttacctaaagttccgtactttctaccgttggtttaaactaacggttcgtaggtacaaaccgtacccgggtcccttacccgtacgtaacctacgtaccttcggtacgggaccctaccggtacggtacgtggaaacgggtaccggaacgggtacttaacggtaattttaaccgtttaacgtcggtaaccgtactaccgttaactaaagtttaacgtaaacgtaacggaccgtaacgtaccgtaacggacgtaacccggggtttacgggggttacccggtttaaccggggaacccggttacggggggtaaaaccccgtaaacggggtttaccccggtaaccccgggtttaccccgttaacccccggtaaccgggttcccggaaaacccggttaaccccccggggaaaacccggttaccccccccgaaaccccccggtttaacccgg

SEQ ID NO: 85734 - DNA, 256 bp, Homo sapiens
  misc_feature: GYAE6OF02IKY2C.3.28.C06.1.454.CMB.1.raw
  modified_base (250)..(256): a, c, t, g, unknown or other
  misc_feature (250)..(256): n is a, c, g, or t
tcagagacgcactccacgaccggtgctcgatttagagctcacgtattgggtttggggggtttggtggtctccactcccgccttgacgaggctgattattactgcagctcatatacaagcagcagcactggggtcttcggaactgggaccaaggtcaccgtcgtcccacgtcagcccaaggccaaccccactgtcactctgttcccgccctcctcgagtgcgtctctgagcgggctggcaaggcgcatagnnnnnnn

SEQ ID NO: 85735 - DNA, 644 bp, Homo sapiens
  misc_feature: GYAE6OF02JOZTT.3.28.C06.1.454.CMB.1.raw
  modified_base (231)..(231): a, c, t, g, unknown or other
  misc_feature (231)..(231): n is a, c, g, or t
  modified_base (271)..(272): a, c, t, g, unknown or other
  misc_feature (271)..(272): n is a, c, g, or t
  modified_base (305)..(305): a, c, t, g, unknown or other
  misc_feature (305)..(305): n is a, c, g, or t
tcagagacgcactccacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcatcgccatctctgcactgaaccngcagtgacgttggtgttaatactatgtctctgtatcaacnncaccaggacaaacgccccaaatcaattaattangatgtacagtactcgcctgtaggttacaagtcgtcttctgtgtacagtctagcaactccgcctaccagacatcctacgtcggcctaccgaggtctaggacgggtacgtaggtaccttaggttaacttttacgttaaccggtacggtcctaacggtcccttaattaagttaacctaaacgtaaacggcaacgggctaacggtccggtaacggttccgggtaccgtttaccggggtaaaccggtacggggtaaacctaacgggttcccgtaacccggttcccgtacccgtaccggacccggaacggtacccccggaaccgtacccccgtaaacccgtaccg

SEQ ID NO: 85736 - DNA, 701 bp, Homo sapiens
  misc_feature: GYAE6OF02GXFCX.3.28.C06.1.454.CMB.1.raw
  modified_base (196)..(196): a, c, t, g, unknown or other
  misc_feature (196)..(196): n is a, c, g, or t
  modified_base (228)..(228): a, c, t, g, unknown or other
  misc_feature (228)..(228): n is a, c, g, or t
  modified_base (254)..(254): a, c, t, g, unknown or other
  misc_feature (254)..(254): n is a, c, g, or t
tcagagacgcactccacgaccggtgctcgatttagagctcacgtattggtttggggggggtctcaggaggcagcgctctcgggacgtctcaccatggcctgggctctgctattcctcaccctctcactcagggcacagggtcctgggcccagtctgccctgactcagcctgcctccgtgtctgggtctcctggacngtcgatcatcgcatctcctgcacgtggaaccngtcagtcgacgttggtagttatactntcgtctcgtgtactacaacgcgccaccgagaccaaccgacccaacgtactaacttaacgttacgtgtactacgtacgtaacgtacgtccggtaccgttacggtacggttactaacgtcgtacgttacgtacgttacgttacgtacgttcgtacggtacctaaccgtaccgtaccttaccgtacgtaccgtacgttccgtacggtcggtacctacggtacggtacgtacggtacggtacgtacggtcgtacgttacttacgtacgtcgtacgtacgtacctacgtaacgttacgtaccgtacgtacgtacgtacgtacgtacgttacgggttacgggttaccgtaccggtacggttaccggtaaccgtaccggttacccgtaccggttaccgtacccgtacggttacccggaccgtacccggtaacccggtaccccgtaacccgtacg

SEQ ID NO: 85737 - DNA, 861 bp, Homo sapiens
  misc_feature: GYAE6OF02JV28U.3.28.C06.1.454.CMB.1.raw
  modified_base (127)..(127): a, c, t, g, unknown or other
  misc_feature (127)..(127): n is a, c, g, or t
  modified_base (175)..(175): a, c, t, g, unknown or other
  misc_feature (175)..(175): n is a, c, g, or t
  modified_base (266)..(266): a, c, t, g, unknown or other
  misc_feature (266)..(266): n is a, c, g, or t
  modified_base (423)..(423): a, c, t, g, unknown or other
  misc_feature (423)..(423): n is a, c, g, or t
  modified_base (498)..(498): a, c, t, g, unknown or other
  misc_feature (498)..(498): n is a, c, g, or t
  modified_base (770)..(771): a, c, t, g, unknown or other
  misc_feature (770)..(771): n is a, c, g, or t
  modified_base (781)..(781): a, c, t, g, unknown or other
  misc_feature (781)..(781): n is a, c, g, or t
tcagagacgcactccacgaccggtgctcgatttagagctcacgtattgggtttggggggggtctcaggaggcagcgctctcgggacgtctccaccatacggccgtgggctactgtcctatccctccnccctcctcacgtcacggcgacgagggtcctggcccagtcctgccctcngggacctcgcctccgtcggttcctcggttcgtccgtcgtccgaagtcgacgtcatccgcccgtaactcctcgcccaacgttcggaaacccnggcctaggtcggtaaccggtttgggttaggtttaactaaaccttagttcgttccgttccgttaggttaactacgaaaccgacttttaccccgaaccggaacccgaaaccggaaccccccgtaaacccgtaaccctaacttaaacttcccgtaattanaacggtttaaactcggggtttacccctacgggtttttaccgtaccggttacgttaccgttaccgttactttacgncgtaaaccgtacggttaccggttcaaaccgtaaccgggtacccgttacccgtccgtaacccgtaaccgtacccttacccgttacgggtaccgtacccgtacggtacggtacgaaacccttcggggaccggtacggtacggttaacgttaacgttacgtacgtacgcccgaacgttaccgtacgtacgtaacgtaacgtacgacgtacgtacgacgtacggtacggtaccggttaccgaacgttcgggaaccgtaacgggtaccgacccgggnngaaccggttntaccctaaccggttacccgtacccggaccccgtaaccggtaccccgtaacccccgtacccgtacccgtaccccgtacccg

SEQ ID NO: 85738 - DNA, 648 bp, Homo sapiens
  misc_feature: GYAE6OF02F23E1.3.28.C06.1.454.CMB.1.raw
  modified_base (231)..(231): a, c, t, g, unknown or other
  misc_feature (231)..(231): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacgttggtgttataactatgtctctgtactacacagcaccaggacaaaccgaccccaaatcattaattatgatgtacagtaactccggcctagtagggttactaagtcgtcttcttctaggttaacaagttctagacaacgaccgccctaccgtcgacctattcctcgtacgggcctccgaggtcgtaggaacgggacggtacggcttaagttaactttacttacgtgactacgacttacaaatactaacaacggtaccaggtacgaagccgtaacgggttcggggttacgtaccggtaacgggtacgggtaaacccgtaaacggttcccggtaaccccggttccggtaaccccgtacgtaaccggaacccgggtaaccccaacccgggtaccccctaaaccccggttacg

SEQ ID NO: 85739 - DNA, 857 bp, Homo sapiens
  misc_feature: GYAE6OF02GXFU4.3.28.C06.1.454.CMB.1.raw
  modified_base (239)..(239): a, c, t, g, unknown or other
  misc_feature (239)..(239): n is a, c, g, or t
tcagagacgcactccacgaccggtgctcgatttagagctcacgtattggggtttgggggggtctcgaggaggcagcgctctcgggacgtctccaccatggcctgggctctcgctattcctcacccctcctcactcagggcacaggtcctgggcccagtctgccctgactcagcctgcctccgtgtcgtgggtctccgtggaccagtccgatcagtcgccatctcctagcactggaaccngcagtagacgttggtagttaataactatgtctcctaggtatcaacagtccacctaggacaaaccgacccccaaacgtacctaacgttaaactttagtacgtaagtacgttaccgtaaggttaaacgtcccggtaccccgttacggtaacgggggttttacctaaacgttccgttccgttacccgtttcttaacgggtttaacctaacgttccgtacgggtaaccgtaaacccggtacccgggtacccccttaccccgttacgtaaccccgtaacttacccgtccgggtaccgggtaccccggtcccggtaacgggtaccgttaacggggaacggggaacggtaaccgggtacgttaaggtaaacgtttttacgtttaaacccgtcggtacccgtaacgtaccgtaacgttaacgttaacggttaaccgtaaaccgtaaccgggaacggtaccgtacgggtaaacccgttaccggggtacgggggtttacccttaacggggtaacccggttacggggtaaaccccgttaacgggtcccgtaacccgggttacccgttacccgaccggtccccgtaaccggccccggtaaacccggccccgtaaaccccgttaaccccgg

SEQ ID NO: 85740 - DNA, 662 bp, Homo sapiens
  misc_feature: GYAE6OF02JB0YJ.3.28.C06.1.454.CMB.1.raw
  modified_base (202)..(202): a, c, t, g, unknown or other
  misc_feature (202)..(202): n is a, c, g, or t
  modified_base (236)..(236): a, c, t, g, unknown or other
  misc_feature (236)..(236): n is a, c, g, or t
  modified_base (277)..(277): a, c, t, g, unknown or other
  misc_feature (277)..(277): n is a, c, g, or t
tcagagacgcactccacgaccggtgctcgatttagagctcacgtattggggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacngtcgatcatccgccatctcctgcactcggaaccngcaggtgacggttggtgttataactatgtctctggtatcanagcaccgagacaacgaccccaaactcattaattatgtaatgtacaagtaactcggccttgtacgggtttctaagtcgtcttctcttgtacagtctggacaacgacgccctcctcgactatcctcgtcggtcctcgacgtcgtcggacgggacggacggtcgtacggttacgtttaacttacgtgacgtacggtacctacgtaattaacgtaacgacgacgtacgacgacgtaccgtaacgggttacgggggttacctacgggtaaccggttaccgggaaacccgggttaaccggtacccgtaacccgggttacccgtaccccgtaccgggttacccgaacccgggttaccccgaacccgggttacccccaacccccggtaacccg

SEQ ID NO: 85741 - DNA, 586 bp, Homo sapiens
  misc_feature: GYAE6OF02IJ7EB.3.28.C06.1.454.CMB.1.raw
  modified_base (232)..(232): a, c, t, g, unknown or other
  misc_feature (232)..(232): n is a, c, g, or t
  modified_base (303)..(303): a, c, t, g, unknown or other
  misc_feature (303)..(303): n is a, c, g, or t
  modified_base (307)..(307): a, c, t, g, unknown or other
  misc_feature (307)..(307): n is a, c, g, or t
  modified_base (406)..(406): a, c, t, g, unknown or other
  misc_feature (406)..(406): n is a, c, g, or t
  modified_base (453)..(453): a, c, t, g, unknown or other
  misc_feature (453)..(453): n is a, c, g, or t
tcagagacgcactccacgaccggtgctcgatttagagctcacgtattggggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgcatctcctgcactggaaccngcagtgacgttggtagtataactatgtctctggtatcaacagcaccaggcaacgccccaactcataattangatntcataactcgcctcgtagggtttcaatcgtcttctcgttagttactaagtcgtacgacaacgccgtcctcctacgactactcgtcgtacggcctaccgnggtctaggacggacgaggctagtatttattacgtcgactacgtctanacttaacacgaacgcacgacacgacgtacgtagggttccgtacgggtaacgtcgggaaccgtaacggtccgaccggttacccgaacccgtacgttaccggaccgaccccgaaccggaccccaacccctaaccg

SEQ ID NO: 85742 - DNA, 643 bp, Homo sapiens
  misc_feature: GYAE6OF02J1TWQ.3.28.C06.1.454.CMB.1.raw
  modified_base (294)..(294): a, c, t, g, unknown or other
  misc_feature (294)..(294): n is a, c, g, or t
  modified_base (304)..(304): a, c, t, g, unknown or other
  misc_feature (304)..(304): n is a, c, g, or t
tcagagacgcactccacgaccggtgctcgatttagagctcacgtattgggtttgggggggggtctcgggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcacgtcggaaccagcagtgacgtggtgttatactatgtctctgtatcaacagcaccagacaaccgacccaacncataacttangatgtacagtactcggtcctcgtagggttactatcgtcttctcgtcgtactagtcgtcggaccaacgtaccgtccctccgtcgtaacctctcgtcgtcggcctccgacggtcgtaggacggtacgtagtcgtagttattacgttacgtagtccacgtactactaagtaactactaacgacgaacgactacggtcgttaaccgggtcgggttaaccgttaccgggaacgtaccgggtaaccggtaacccgggttacccttacccggtaccccgtaccgtacccggtaccgtaacccggaccccgtaaccggaacccccttaaccccgtaaccggttcccg

SEQ ID NO: 85743 - DNA, 765 bp, Homo sapiens
  misc_feature: GYAE6OF02GQLX0.3.28.C06.1.454.CMB.1.raw
  modified_base (233)..(233): a, c, t, g, unknown or other
  misc_feature (233)..(233): n is a, c, g, or t
tcagagacgcactccacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcatcgccatctcctgcactggaaccngcagtgacgttggtagttataactatgtctcctgtatcaacagcaccaggacaaacgacccccaaactcaattaatttatgatgtacagttaactccggccctacgtacggggttttactaacgttcgtcctttcttacgttacggttaacgtaaacgttcgtacgggtacctaaaccgtaccccgggtacccttacccctacggtaaccctacgtttacccgttaccggttacgggtccccgttaaccccgacggggtcccgttacggggaaaccggggtaacgggtaacgggtacccgttaagggttaacttttaacgttttaccggtacggtacctacggtccttacgtaacttaacgtaaaccgtaacgcgtaacgccgaacggtccgtaacgggttcgggggttacctttacggggtaaccggtacggggtaacccggttaaacgggtcccgtaacccggttcccgtaccccgtaacggtacccgaaccggtacccccgaaccgggtacccccctaacccgtacccg

SEQ ID NO: 85744 - DNA, 622 bp, Homo sapiens
  misc_feature: GYAE6OF02JN9NM.3.28.C06.1.454.CMB.1.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
  modified_base (335)..(335): a, c, t, g, unknown or other
  misc_feature (335)..(335): n is a, c, g, or t
  modified_base (371)..(371): a, c, t, g, unknown or other
  misc_feature (371)..(371): n is a, c, g, or t
  modified_base (448)..(448): a, c, t, g, unknown or other
  misc_feature (448)..(448): n is a, c, g, or t
  modified_base (515)..(515): a, c, t, g, unknown or other
  misc_feature (515)..(515): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctcgccctgactcagcctgcctccgtgtctcggtctcctaggacngtcatcatccgcctatcctccgtagcctactcggaaaccgngtcctaggtcgacggtttggtagttaataacttatcgtctccgtgtatcaacagcctaaccagacaaccgacccccaaatacaattaacttanactatgtacagtactacgcctcgtacggttactacncgtctcttcgtacgttataatccgtagctaaaccgccggtccctccgtaccgactactcgtacggtcgtacctaccncggtactacggacgacggtagtcgtacgtatttaaacctcgtagactaacgctacctaatacaacgngtacaacgtacacgtctaacggtcgggttccgttacgacggtacggtaacaccggtacctcgtacccgtccacggttaccaccgtaccgaccgaacccaccgtaccg

SEQ ID NO: 85745 - DNA, 768 bp, Homo sapiens
  misc_feature: GYAE6OF02G1P5J.3.28.C06.1.454.CMB.1.raw
  modified_base (228)..(228): a, c, t, g, unknown or other
  misc_feature (228)..(228): n is a, c, g, or t
  modified_base (271)..(271): a, c, t, g, unknown or other
  misc_feature (271)..(271): n is a, c, g, or t
tcagagacgcactccacgaccggtgctcgatttagagctcacgtattgggtttgggggggggtctcaggaggcagcgctctcgggacgtctccaccatggcctgggctctgctattcctcaccctctcactcaggcacagggtcctgggcccagtctgccctgactcagcctgcctccgtgtctgggtctcctggacagtcgatcatcgccatctctgcatggaaccngcagtgacgttggtgtataactatgtctccgtggtactcaacngcacccagggaccaaacgacccccaaactccattaaatttataggattcgtcagtaactccggtccccttacgtaggggtttctaaacgtccgtccttcgtcttaggttactaagttccggtaggtaccaaaccgtaccggcccttaccccgtacgtaaccctaacgtcctttaccggtcggggtccctaccggtacgggtaccgttgggaacggggaacggtacgggtacttaggttaactttaactttacgtcgtaccgtacgtacctacgttattaaattaaccgaacgtccgtaacggaccgtaagggtacctaaaccgggtttccgggggggtttacccgtttaccggggttaacccggtacggggtaaaccccggttaaacgggttacccccgttaacccggggttacccccgtaaccccgtaccggtttaacccggaacccggtaacccccgggtaaaccgggtaccccccctaaacccccggtacccgg

SEQ ID NO: 85746 - DNA, 814 bp, Homo sapiens
  misc_feature: GYAE6OF02H0Y2U.3.28.C06.1.454.CMB.1.raw
  modified_base (233)..(233): a, c, t, g, unknown or other
  misc_feature (233)..(233): n is a, c, g, or t
  modified_base (276)..(276): a, c, t, g, unknown or other
  misc_feature (276)..(276): n is a, c, g, or t
tcagagacgcactccacgaccggtgctcgatttagagctcacgtattgggtttgggggggggtctcaggaggcagcgctctcgggacgtctccaccatggcctgggctctgctattcctcaccctctcactcagggcacagggtcctgggcccagtctgccctgactcagcctgcctccgtgtcgtgggtctccgtggacagtcgatcatcgcatctcctgcacgtggaaccngcagtgacgtttggagttataactatcgtctcgtgtatcaacngcaccgaggacaagtcctaccaaactctaattaacttatgacttagtactaaggtaactccggccgtaggttagggttactaacgtccgtactttcgtacgttacggtttaacaacgttcgtacggtaactaaaccggtaccgggtcccttaccgtacgtaaccctacgttccggtccggttacggggtccctaccggtaacgggttccgtaacgggtacgggtaaccggtagggtaccttaagggttaacttttaacgttacgtacggtaccgtaacggttaccttaacgtaaacgtttacgtaaacgtaaccggtaccgtaaccgggtacctaaaccgggtaccgggttaaccgggtttaaccggggggttaccgttttaaacccgggggaaaccgggtttccggggaaaaaccccggttaccgggttaccccggttaaccccggttaccccgggttaaccccggtaaccgggttaaccccggtaaccccggggtaaccccgtaaacccccgggtaacccccttaaaacccccggg

SEQ ID NO: 85747 - DNA, 662 bp, Homo sapiens
  misc_feature: GYAE6OF02JOD06.3.28.C06.1.454.CMB.1.raw
  modified_base (237)..(237): a, c, t, g, unknown or other
  misc_feature (237)..(237): n is a, c, g, or t
  modified_base (318)..(318): a, c, t, g, unknown or other
  misc_feature (318)..(318): n is a, c, g, or t
  modified_base (446)..(446): a, c, t, g, unknown or other
  misc_feature (446)..(446): n is a, c, g, or t
  modified_base (508)..(508): a, c, t, g, unknown or other
  misc_feature (508)..(508): n is a, c, g, or t
tcagagacgcactccacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtcctcctgggacaggttcgatcatcgccatctcctgcactcggaaccngctagtgtacgttggtagttatactatgtctcctggtatcactagcaccaggaccaacgaccccaaactcaattaatttanagtactgtcaagtactcggcctagtacgggttactaacgtcgtacttcttacgttggttaacctagttcgtacggtactaaccgtaccgtccctaccgtcgacctacttccgtcgtcgggcctaccgnggtaccgttggaacggacgtaacggtctagggtacttttacgtacgtcgcctaggtacctanaacttagtaaccgtaacgctacgagtaaccgacgttacgggtcgggttaccgtacggtaaccgtcggggtaaacctaacgggtccgtaaccgtcccgttaccggaaccgttcggaacccgtaacccggacggtaacccccgtacccgtaaccgg

SEQ ID NO: 85748 - DNA, 770 bp, Homo sapiens
  misc_feature: GYAE6OF02I46WN.3.28.C06.1.454.CMB.1.raw
  modified_base (234)..(234): a, c, t, g, unknown or other
  misc_feature (234)..(234): n is a, c, g, or t
tcagagacgcactccacgaccggtgctcgatttagagctcacgtattggggtttgggggggggtctcaggaggcagcgctctcgggacgtctccaccatggcctgggctctgctattcctcaccctcctcactcagggcacagggtcctgggcccagtctgccctgactcagcctgcctcgtgtctgggtctccgtggacagtcgatcatcgcatctcctagcactaggaaccngctagtgtacggttgggtagttaataactatcgtcttccgtaggtactacaacgcgaccaccgaggtaccaaaaccgaccccctaaaactcctaatttaaactttatagtaagttacgtacgaaggttaaacgtcccggtacccgtaggttaacggggttttactaacgttccggtctttaccgttccgttagggtttaaaccgtaacgttacggtacgtaaccgtaaaccgaccggttaccccttacccgtccgaacctacgttcccgtacggtacgggtaccctaccggtaacgggtcgtaggggaaccgggtacggtaacgggtacttaggttaactttaacgttcgtacgtacgtactacgtacttaacgttaactaacgtaacgtacgacgtaccgacgtaccggtacgggtacgggttaccgttacgggaaccgtacggggtaaacctacggttacccgtacccgggttccgtaacccgtcggttaaccgacccggtaaccccaacccggtcccccaaacgttaccccgg

SEQ ID NO: 85749 - DNA, 804 bp, Homo sapiens
  misc_feature: GYAE6OF02I54IT.3.28.C06.1.454.CMB.1.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
  modified_base (620)..(620): a, c, t, g, unknown or other
  misc_feature (620)..(620): n is a, c, g, or t
  modified_base (660)..(660): a, c, t, g, unknown or other
  misc_feature (660)..(660): n is a, c, g, or t
tcagagacgcactccacgaccggtgctcgatttagagctcacgtattggggtttgggggggggtctcaggaggcagcgctctcgggacgtctccaccatggcctgggctctgctattcctcaccctcctcactcagggcacagggtcctgggcccagtctgccctgactcagcctgcctcgtgtcgtggtctccgtgacngtcgatcatcgccatccgtccngactacgtacggaaccagcgagtcggtacggtttgggttagttaacttaacgttagttcgttaccgttccgtaggtttaactaccaaaccggacgaccctaacccgtaagggaacccaaaacccgacccccctaaaacttacttaaactttaactttaatagtacgttacgttactaaacggtaaacctccgggtacccgttaccggttaggggttttacctaaacgttccgttactttccgtaacgtttacgttaaccggttaacgttcgacggtaaccgtaaccctaccgggtccctaccgtacgtaacctaccgtttcgtaccgggtccgtccctaccggtcggttacggtagggaccggacggtacgggtcaagtttaacggtttcttaaccgngacgtaaccgtgtaacctaataacgtaagacgtccggtanacgtaccgtaacggtacggtttaccgggttaacgtacccgggttaggtaacccggtaacccggtaacgtacccgggtaaccttccccgtaacgtacccgtaccgtaacccggccgaaaaccccggtaccctacccgtaacccgg

SEQ ID NO: 85750 - DNA, 577 bp, Homo sapiens
  misc_feature: GYAE6OF02HNA92.3.28.C06.1.454.CMB.1.raw
  modified_base (265)..(265): a, c, t, g, unknown or other
  misc_feature (265)..(265): n is a, c, g, or t
  modified_base (270)..(270): a, c, t, g, unknown or other
  misc_feature (270)..(270): n is a, c, g, or t
  modified_base (298)..(298): a, c, t, g, unknown or other
  misc_feature (298)..(298): n is a, c, g, or t
  modified_base (312)..(312): a, c, t, g, unknown or other
  misc_feature (312)..(312): n is a, c, g, or t
  modified_base (330)..(330): a, c, t, g, unknown or other
  misc_feature (330)..(330): n is a, c, g, or t
  modified_base (334)..(334): a, c, t, g, unknown or other
  misc_feature (334)..(334): n is a, c, g, or t
  modified_base (392)..(392): a, c, t, g, unknown or other
  misc_feature (392)..(392): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcatcatcgccatctcctgcactggaaccagcagtgacgttggtgttaatactatgtctctgtancaacngcaccagacaacgccccaatcataattntagatgtctagtanccgcctgtaggttcatcncttntctagtacagtctgacacgacgcctccagcctatctcgtcggctcgcgcgtgagacgngtctgtacttacttacgtcgcacggggtctactactaactacaacgacacgactagtaccgtcggttacgggttcgttaccgggtaacggtacgggtaaccgaaccgggttaccgaccggttacccgtacccggtacccgttaccgaaccggtacccgtaacccggtaccccgaacccgtacccg

SEQ ID NO: 85751 - DNA, 706 bp, Homo sapiens
  misc_feature: GYAE6OF02FW8XF.3.28.C06.1.454.CMB.1.raw
tcagagacgcactccacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatacaacagcacccgaggacaaacgcccccaaactcaataattatgatgtcagtaatcggccctgtagggtttcaatcgtctctcgttgtaacagtctggacaacgacggtcctcctacgaccactctcgtgggcctcgagcgtaggacgaccggaggtccgtaggttaactttactttacgtcgacgtacggtaccttaccgtaaagttaacgttaaccgtaaaacggaccgttaaaggacccgtaacggaacccgttaaccgggggttccggggggttttacctttaccgggggtaaacccggttacgggggtaaaaccccgtaacggggttaccccgtaaccccgggtttaccccgtaacccccgtaaccgggttacccggaaccccgggtaaccccaacccggggtaaccccccgaaaccccccgttaacccgg

SEQ ID NO: 85752 - DNA, 773 bp, Homo sapiens
  misc_feature: GYAE6OF02JR00R.3.28.C06.1.454.CMB.1.raw
  modified_base (256)..(256): a, c, t, g, unknown or other
  misc_feature (256)..(256): n is a, c, g, or t
tcagagacgcactccacgaccggtgctcgatttagagctcacgtattgggtttggggggggtcgtcaggaggcagcgctctcgggacgtctccaccatggcctggctctgctattcctcaccctcctcactcagggcacgacgggtcctcgggcccagtctcggcccctggacctcacgcctcgcctccgtgtcgtcgggtcctcgtggactagtcgatcgactccgccactctccgtgacctacgtacggaaccngacgagtacggtacggttgggttaggttaacttaacgtattcgtcttccgtaggttactacgaacacgaccgaacccgaggacccaaaaccgtacccccaaaacttctaaacttaaactttaagcgtaattcggtaactaacggttaaccgtccggtcccgttacgggtacgggttttacctaacgtccgttaccttccgttacggttacggtttaaacgtaacggttcgtaccggaaacctaacgtacccggtcccttaaccccggtagtaaacccttccgttaccgtcggttcgggtaccttccgacgggttacggacggtaacgggaccggtaagtcgtacggtaatttacgttacgttacgcgaactgtaactaacgtaatacgaactacgagactcgacgtacggggttcgggttacgtacgggtaaccgtcgggaaaccgtaccgtcggtaacccgttccgtaacccgcgtaacccgaccggtaacccaacggttaccccaaccccgtacg

SEQ ID NO: 85753 - DNA, 606 bp, Homo sapiens
  misc_feature: GYAE6OF02JFWK6.3.28.C06.1.454.CMB.1.raw
  modified_base (273)..(273): a, c, t, g, unknown or other
  misc_feature (273)..(273): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctctggtactcaacngccaccaggaccaaacgccccaaactcaattaattatgatgtacagtaactcggccctcgtagggtttactaagttcgtacttcgtctggttacaacgtcgtgacaacgaccggtccctccctacgacctatcctcgtcgggtcctaccgcggtcgtcggaacgggacgtacggcgttagtaactttacttacgtgcctagccttacaattacaacaagcaagcagtcgtacggtcgggtaccgttacggaacggtcgggaaccgtacggtaccgtaccgttacccgtacccgtacgtccgaccggacccgaaccggacccctaaccctaccg

SEQ ID NO: 85754 - DNA, 713 bp, Homo sapiens
  misc_feature: GYAE6OF02H8RPU.3.28.C06.1.454.CMB.1.raw
  modified_base (241)..(241): a, c, t, g, unknown or other
  misc_feature (241)..(241): n is a, c, g, or t
  modified_base (549)..(549): a, c, t, g, unknown or other
  misc_feature (549)..(549): n is a, c, g, or t
tcagagacgcactccacgaccggtgctcgatttagagctcacgtattggggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtcctctggacagtcgatcactcgacctatccgtcctgcctagtacggaacngacgtagtcggtaggtttcggtaggttaactaacgtatcgttcctaccgtaggttaactaccgtaacgacgcccgtaacccgaacggaaccgaaaaccgtaccccctaaactactaaacttaattaactagtatgtactaagtaaccgtcgtaccgtaggttacgggttactaacgtcgtaccgttctacgtacgttactacgtacggtacgcgtaacgaccgtaccctccgtagtacccacttcgtacgtcggtccgtacgacggtacgtagggacgacggtgtacgtacgttaatttacgtacgtntacgtatctataacgtacgtacacgtacgacgacgtacgtacgtacgggttacggtacgttacgggaacggtacccggtaacggtaccgtacccggtacccggttacccgtacccgtaacggtccgaaccggtaaccccggaaccgtaccccaaccgttaccgg

SEQ ID NO: 85755 - DNA, 698 bp, Homo sapiens
  misc_feature: GYAE6OF02JVN9N.3.28.C06.1.454.CMB.1.raw
tcagagacgcactccacgaccggtgctcgatttagagctcacgtattggggtttggggggggtctcaggaggcagcgctctcgggacgtctccaccatggcctgggctctgctattcctcaccctcctcactcagggcacagggtcctgggcccagtctgccctgactcacgcctgcctccgtgtcgtgggtctcctggacagtcgatccatccgccatctcctgacactggaaccagcagtcgacgttggtagttataactagtcgtctctaggtatacgaacacgcaaccgtaggaccaaacgaccccaaactctaacttaattataggtactacgtactaacgttaacgtccggtcctacggttacgggttactaagtccgtacttcgttcgttacggttacgtaacgttcggtacggtaacaaccgtaccggtacccgttacccgtacgaccctaacgtccgttcggtaccgggtctaccggtacggtcctagggtacgggacgtacggtcgtagttaactttacgtacgtacgacgtacgccttagtactaacgtacgtaacgacgtaacgactagaccgtaaggtacgggttacctacgggaagtaaccggggaccgtaacggttacccgtaccggtacccgttaccgaacgtcccgaaacgtccccggaacccgtaacccgtaccctaacg

SEQ ID NO: 85756 - DNA, 629 bp, Homo sapiens
  misc_feature: GYAE6OF02G48J3.3.28.C06.1.454.CMB.1.raw
  modified_base (231)..(231): a, c, t, g, unknown or other
  misc_feature (231)..(231): n is a, c, g, or t
  modified_base (312)..(312): a, c, t, g, unknown or other
  misc_feature (312)..(312): n is a, c, g, or t
  modified_base (324)..(324): a, c, t, g, unknown or other
  misc_feature (324)..(324): n is a, c, g, or t
  modified_base (385)..(385): a, c, t, g, unknown or other
  misc_feature (385)..(385): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacgttggtgttataactatgtctcctggtatcaacagcacccgaggaccaaacgcccccaaactcaattaattangatgcagtaacncggccctgagggtttctagtcgtcttctcgtggttacagtcgtggacacgacgccctcccngacctatctcgtgggcctccgaggtctggacgggacgacggtcttaggtaactttacgttacgtgaccgtacgtccgttactaagtaacgtaacgaaacgtccaacggcaggccgtacggttggggttacccgttacgggtaacggtcggggtaaaccctacgggttacccgtacccggttcccggttacccgacccgttaccgaaccggtaccccgaaccgggtaccccctaaccccgtaccg

SEQ ID NO: 85757 - DNA, 533 bp, Homo sapiens
  misc_feature: GYAE6OF02JEA6V.3.28.C06.1.454.CMB.1.raw
  modified_base (273)..(273): a, c, t, g, unknown or other
  misc_feature (273)..(273): n is a, c, g, or t
  modified_base (306)..(306): a, c, t, g, unknown or other
  misc_feature (306)..(306): n is a, c, g, or t
  modified_base (344)..(344): a, c, t, g, unknown or other
  misc_feature (344)..(344): n is a, c, g, or t
  modified_base (401)..(401): a, c, t, g, unknown or other
  misc_feature (401)..(401): n is a, c, g, or t
  modified_base (444)..(444): a, c, t, g, unknown or other
  misc_feature (444)..(444): n is a, c, g, or t
  modified_base (450)..(450): a, c, t, g, unknown or other
  misc_feature (450)..(450): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcatcgccatctcctgcacgtggaaccagcagtgacgttggtgttataactatgtctcctggtatcaacngcaccaggacaacgccccaaactcataattatnatgtcagtatcgcctcgtagggttctaatcgtcttctntacgtacagtctggacaacgccggtcctccgtgacccatcctcggtcggcctaccgnggtctggacggacgacggtctgtaatttacttctgctagctanacttanacgaagcagcagcacgtgggtctacgtacgacggacaggtccaccgtccgtacccgacgtcaccgaccaacgacccacctacg

SEQ ID NO: 85758 - DNA, 856 bp, Homo sapiens
  misc_feature: GYAE6OF02JXWMJ.3.28.C06.1.454.CMB.1.raw
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcatcgccatcctccgtgacctacgtcggaacccaggcctaaggtggtacggtttggtaggttaataactatgtcctccgttaggtactcaagacgccacccgaaggacaaaccgacccccctaaaactacctaattaacgtttacgtacgtacgttacggtacctaaaggtaacgtccccgggtaccccgttacggttaaccgggggttttaacctaaacgtcccggttccttttccggtttaccgtttacgggtttaaaaccgtaacggtttccggtacggtaaaccggtaaacccgtaaccccgggtttcccccgttacccccgtaacggtaaccccttaacgtttaccccgtacccgggtttaccgggtccccgttacccggtaacggggtcgttaacggggaaccggggtaacggtaaccgggttccgttaacggttaaagttttacccgttaacgtaccgggtactacggtacccttactaacgttaacgtacgaacgggtacacgtacgtaacgcggtacggttacgggttaccgtacgggttaacggtaccgggtaacccgtaacggttcccgtaacccggttcccgtacccgtaccggttaccgacccggtaacccgtacccggacccgaaccccgttaaccgg

SEQ ID NO: 85759 - DNA, 778 bp, Homo sapiens
  misc_feature: GYAE6OF02G5QUG.3.28.C06.1.454.CMB.1.raw
  modified_base (244)..(244): a, c, t, g, unknown or other
  misc_feature (244)..(244): n is a, c, g, or t
tcagagacgcactccacgaccggtgctcgatttagagctcacgtattggggtttgggggggggtctcagggaggcagcgctctcgggacgtctccaccatggcctgggctctgctattcctcaccctcctcactcagggcacgagggtcctgggcccagtctggccctgactcacgcctgcctccgtgtcgtgggtctccgtggacagtcatcactcgccatcctcctgctacgtacggaaccngcagtgtacgttggtagttaatactagtcgtctcgtggtactacgaacacgccaccgacggaaccaaaccggacccccctaaactactaacttaactttagtgtaagtgtactaacgtaacgtcccggtacccgttacggtacgggttttactaacgttccgttcttcgttacgttacgttaacgtaacgttacggtacgaccgtaaccgtcccggtccctacccgtacgtaccctacgtccgtacggtccgggtacccgaccggtacggtacggtacgggaaccggggtacggtacggtacgtttaagttaacgttttacgttaacggcgtacgtactaccttaataacgttaaactaccgaacgacgacggtaccgtaacggtccgttaaccgggggttacggtttaacccggtaccggggtacgggtaccgggttaaacccggtaccgggtaaccccgtcccggtaccccgttaccggaccgttaacccgacccggaaccccggtaacccggtaccccgaccccgttaccg

SEQ ID NO: 85760 - DNA, 751 bp, Homo sapiens
  misc_feature: GYAE6OF02GFC11.3.28.C06.1.454.CMB.1.raw
  modified_base (234)..(234): a, c, t, g, unknown or other
  misc_feature (234)..(234): n is a, c, g, or t
tcagagacgcactccacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcagcctgcctccgtgtctggggtctccgtggacagtcgatcatcgccatctcctgcactggaaccngcaggtgacggttggtagttataactatcgtactccgtaggtactacaactacgccaaccgacggactaaaccgacccccaaacgttcaattaatttactaggtatgtacaacggttaacgtccggtccctacggttaaggggtttacctaaacgttccggttctttaccgttacgttacgggtttaactaaggttccgtacgggtacctaaaccgtacccgggtcccttacccgtacgaccgtaacttcccgtacgtcgggtccttccgacgggtacgtaggaacgggtacggacggtaccttaggttaactttacgttacgtacgtcgacgtctacgtaagtaacgttaacgaacggtctaagacgtaaccgtaccgttaacgggttacggggtttaccgtacgggtaaccggttacggggaacccggttaacggtaccccgtacccggttaccggtaccccgtacccggttacgaaccccggacccgtaacccggtacccctaacccgtacccg

SEQ ID NO: 85761 - DNA, 744 bp, Homo sapiens
  misc_feature: GYAE6OF02ID5WA.3.28.C06.1.454.CMB.1.raw
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccgcagtgacgttggtgttatactatgtctctggtactcaacagccacccaggacaaacgccccccaaatcaattaattatgatgtacaagttaactccggtaccttagtacggggtttactaagttccgtcttcgtacgtaggttacaacgttcgtacggacaaccgtaccggtcccttccgtacgaaccctacgtccgttccgtcggggtaccccttaccggaggtccgtagggaaccggtacggtacggtcgttaaggttaactttacgttaaccttcgggactacggtacctactaacgttaaacgtaaccgtaacgccgtaacggaccctaaggtacccgttaccgggttaaccgggggtttccttaacccgggggtaaccggttcggggtaaacccggttaaccggttaccccggtaaccccggtttaccccgtaccccgggtaccgttaaccggaaccccgtaacccccgggttaaaccggaccccccctaaacccccttaaccccggg

SEQ ID NO: 85762 - DNA, 703 bp, Homo sapiens
  misc_feature: GYAE6OF02G2QVU.3.28.C06.1.454.CMB.1.raw
tcagagacgcactccacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcagcctgccctccgtgtctgggtctcctggacagtcgatcatcgccatctcctgcactggaaccagcagtgacggttggtaggttaataactatgtctccgtggtactacacagcacccgaggacaaaccgacccccaaactctaacttaatttatcgtaatcgtacgaagtaacgtccggacctcggtagggtttactaactccgtcttctcgttacggtaacgtacgttcgtacggactaaccgacccggtcccttacccgtacgaccctaactccgtcggtcgggtcccgttaccgacgggtccttagggaacgggtacggtacggtcttaaggtatttacgttactagcgtacgtctacacgttacaaccgaacgaccgtagaccgtagtaccgtacggggttacgggttaccggttaccggtaacgggtacgggtaacccgtaacgggttcccggtaacccggtacccgttacccgtaccggtacccgcccggtaaccccgaaccgggtaccccctaaccccgtaacccg

SEQ ID NO: 85763 - DNA, 709 bp, Homo sapiens
  misc_feature: GYAE6OF02F4L9B.3.28.C06.1.454.CMB.1.raw
  modified_base (199)..(199): a, c, t, g, unknown or other
  misc_feature (199)..(199): n is a, c, g, or t
  modified_base (590)..(590): a, c, t, g, unknown or other
  misc_feature (590)..(590): n is a, c, g, or t
tcagagacgcactccacgaccggtgctcgatttagagctcacgtattggggtttggggggggtctcaggaggcagcgctctcgggacgtctccaccatggcctgggctctgctattcctcaccctctcactcgaggcacagggtcctgggcccagtctgccctgactcagcctgcctccgtgtctgggtctccgtgacngtcgatcatccgcctatccgtctgctacgtcggaaccaggtccaggtctacgggtttggtagttaactaactatcgtctccgtggtactacaacgagtccaaccgacggaactaacccgacccctaaactcaactttaattacgtgtaacgtgtacgaacgttaacgtcccgtacccgttacggtaacgggttttacctaacgttccgtcgttacctacggtttcggtaacgtaacgttcgtacggaccaaaccgtcccgtaccctcccgtaccgactacttaccgtcgtcggtaccctacggacgtcgtaggtaacgacggtacgtacgtggttaactacgtttacggagtccgacgtaccgaacttaacgtacgtaacgaacgtccganacgtccgattaccgggttgggtacctacggtaacgtaccggaacggttacggcccgttaacccggccgttacccgtccgtacggaaccctacccggtaaccgacccaacccgttacccg

SEQ ID NO: 85764 - DNA, 755 bp, Homo sapiens
  misc_feature: GYAE6OF02ID60N.3.28.C06.1.454.CMB.1.raw
  modified_base (245)..(245): a, c, t, g, unknown or other
  misc_feature (245)..(245): n is a, c, g, or t
tcagagacgcactccacgaccggtgctcgatttagagctcacgtattggggtttgggggggggtctcaggaggcagcgctctcgggacgtctccaccatggcctgggctctgctattcctcaccctcctcactcagggcacgagggtcctgggcccagtctcgccctgactcacgctgcctccgtgtcgtgggtcctccgtggacacgttcgatacatccgcatcctctagctacgcggaaaccngcgagtcggtacggttggtagttactaacgtgtcgtccgtcgtagtactacacgacgaccgaccgagaaccaaacccgtacccaaacttactaatttaaacttgtagtaacgtcggtaactaacggttacgtcccggtaccgttagggttaacggttactacgttccgttaccgtttaccgttacggttaacgttaactacggtacgtaccggtaaccgtaaaccgcccgttaccctacccgtacgtaacctacgttccgtaccggtaccggtacccgtacggtacggtacggtacgggtacgggtaacggtacgtacgttacgttaacgtttactacggtacctacgtacgtactaacgttaacgtaacgttaaacgacgacaacgacgaacgtacggttcgggtacggttacggtaccggtacggtaacggtaaccggaaccgtacccgtaccggtacccgtacggtacccgaccgacccgaacccgtacccgacccgtacccgtacg

SEQ ID NO: 85765 - DNA, 691 bp, Homo sapiens
  misc_feature: GYAE6OF02HIXIE.3.28.C06.1.454.CMB.1.raw
  modified_base (171)..(171): a, c, t, g, unknown or other
  misc_feature (171)..(171): n is a, c, g, or t
  modified_base (234)..(234): a, c, t, g, unknown or other
  misc_feature (234)..(234): n is a, c, g, or t
  modified_base (275)..(275): a, c, t, g, unknown or other
  misc_feature (275)..(275): n is a, c, g, or t
tcagagacgcactccacgaccggtgctcgatttagagctcacgtattgggtttgggggggggtctcaggaggcagcgctctcgggacgtctccaccatggcctgggctctgctattcctcaccctcctcactcagggcacgagggtcctgggtccagtctgccctgactcngaaaacctgcctcgtgtctgggtctcctggacagtcgatcatcgccatctctgcactggaacngcagtgacgttggtgttatactatgtctctggtatacaacngccaccaggaccaaccgacccccaaatcaattaattatgatgtacagtaacgccggtccctaggttacggggtttactaagttccgtcttccgttacgttacggttaactaacgttcgtcggacctaacgtacccggcccttcccgtacgtaccctacgttccgtcggtcggtccctccggacggtacgtaggaacgggtacggacgtacgtagttaactttattaccgtagccgtaggtcctacgttaatacgtaacaacgtcgaacgaccgtagacccgtaacgggttccgggtttacgttaccggggtaacggtaccgggtaacccggtaacggttcccggtaaccggttccccgtaacccggtaccgtaccgtacccgaacccggtaacccgtaccccgaaccccttaccgg

SEQ ID NO: 85766 - DNA, 839 bp, Homo sapiens
  misc_feature: GYAE6OF02IEFQF.3.28.C06.1.454.CMB.1.raw
  modified_base (236)..(236): a, c, t, g, unknown or other
  misc_feature (236)..(236): n is a, c, g, or t
  modified_base (278)..(278): a, c, t, g, unknown or other
  misc_feature (278)..(278): n is a, c, g, or t
tcagagacgcactccacgaccggtgctcgatttagagctcacgtattgggtttgggggggggtctcaggaggcagcgctctcgggacgtctccaccatggcctgggctctgctattcctcaccctcctcactcagggcacgagggtcctgggcccagtctgccctgactcagcctgcctccgtgtctgggtcctcctggacagtcgatcatcgccatctcctgcactggaaccagnagtgacgttggtacgttaataactatgtctcctggtatcaanacgcaccgaggacaaaacgcccccaaactacaactaatttaactgatgtacaacgtaactcggacccttacgtaacggggtttactaaactccggtctttccgttacgttacggtttaacgtaaacgttcgtacgggaacctaaaccgtaacccggtaccccttaccccgttaccggaaccccgttaacttacccgttaccgtttacggggtacctttaccccgaacgggaccggtttaaccggggaacggggtaaaaccggtaccgggttaccgttaacggtttaaacgtttaactttttaaaaccgtcgggttaaccgtacggggtaacccttacccggtaaactttaaaaccttaacgggaaaacgtaccgtaacgtacgaaccggtaccgtaaccgggttacggggggtttaccgtttaccggggtaaaccggttacggggtaaacccgttaaccgggtacccggttaaccccggttacccggttaaccccggtaccggttaaccggtaacccgtaacccccgggtaaacggtaccccccgaaacccgtaaccccgg

SEQ ID NO: 85767 - DNA, 932 bp, Homo sapiens
  misc_feature: GYAE6OF02G0CH9.3.28.C06.1.454.CMB.1.raw
  modified_base (210)..(210): a, c, t, g, unknown or other
  misc_feature (210)..(210): n is a, c, g, or t
  modified_base (240)..(240): a, c, t, g, unknown or other
  misc_feature (240)..(240): n is a, c, g, or t
tcagagacgcactccacgaccggtgctcgatttagagctcacgtattggggtttgggggggggtctcaggaggcagcgctcgtcgggacgtctccaccatggccgtgggctctgctattcctcaccctctcactcagggcacagggtcctgggcccagtctcgccctgactcacgcctcgcctcgtgtctgggtctcgtggacagtcgancatcgccatcctcctcgcactacggaaccngcgaggttcgtacggttggttaggttaacttaaactagtcgttctccgtaggtacactaacgacgaccaaccgaggaccaaaaccgaacccctaaatacgaaatttaacgtttacgtacgtagtcgtaacgtaacgttaacgttcccgggtacccttacgggggttaaccggtttttactaaaccggtttcgtacccgttttaccggttacggtttaagggttttaaaccccgtaaacggtttccggtaacgggtaacccgttaaacccggtaacccggggttacccttacccggttacccgtaacccttaccggtttccgtaccgggttacccgggtaccgtttaacccgaccggggtaccgttaccgggggaaggtaaccggggtaacgttaccggttacgtttaaacgtttaaccgtttaaacgtcggtacccggtaattaacccgttagttaaaaccgtaacggtaacgttaaaccggaggttaaccggtaacgtccgggtaaacctttaacccggggggtttaccgggtttaaaccgggttacccggttaaacggggttaaccgggtaacccggttaacccgggtaacccggtaaccccgggttacccgtacccgggttaacccgtacccggttaaaccggtaaccccccggaaccggttaacccccggtaacccgttaaccccggg

SEQ ID NO: 85768 - DNA, 696 bp, Homo sapiens
  misc_feature: GYAE6OF02GD5SJ.3.28.C06.1.454.CMB.1.raw
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcatcgcatctcctgcactggaaccagcagtgacggttggtggttaataactatgttctcctggtatcaacagcaccgacggacaaaccgtacccccaaactcaacttaatttatcgtatgtctaagtaacgtcccggtccctacgtaggggttttactaaggttactcctttctcgttacggttaactagttctaggactaaacgtaccgggtcccttacccgtcgtaaccctcttaccgtccgtcgggtacctccgacggtcgttaggaacgggtacgaaggtcctaggttaactttaacgttaccgtagcgtaccggtactactaactataacgtaacgacgacgtaccgagaccgttacgggttaccggggttaccgttacgggtaaccggtacgggtaacccgggtaacggtcccggtaacccggttccgacccgtacggtaaccgtacccgaaccccgaacccggacccctaacccggttacccg

SEQ ID NO: 85769 - DNA, 801 bp, Homo sapiens
  misc_feature: GYAE6OF02HZLG8.3.28.C06.1.454.CMB.1.raw
  modified_base (608)..(608): a, c, t, g, unknown or other
  misc_feature (608)..(608): n is a, c, g, or t
tcagagacgcactccacgaccggtgctcgatttagagctcacgtattgggtttgggggggggtctcaggaggcagcgctctcgggacgtctccaccatggcctgggctctgctattcctcaccctcctcactccgaggcaacgagggtccgtcgggcccagtctcgccctgactcgagcctgccttccggtgtcgtcgggtcctccgtggacaggtcgatcgactccgacctattcgtcctcggcctacgtacggaaccagcctaggtcggtaacggtttgggttaggttaaactaacgttaagtcgttaccttccgttaggttactaccgaacgacgacccaaccgtacggaacccaaaccgaaccccctaaactactaaatttaactttagtagtacgtgtaacgtagtaaccgtcccggtccgttacgggtagggttttactaacgttccgttctttcgttacgttacggttaacgtacggtacgtacgaccgtaacgcccgtccctcctacgcctagttcccggtcgtcgggtacctcggtaacggtcgtaacgggacggacggacggttacgttaacgttaacttttcgtaacgttacgccgntaaccgtactaataacgtaacgacgtacgacgacgtaccgtacggtaaccgggttcgggttaccggttaccgggacgggttaaccggggtaaccggttaacccgggtacgttaaccccggtaccccgttaccggtacccggtacggtaaccccgaaccccgggtaacccgacccccggtacccggttaaccgg

SEQ ID NO: 85770 - DNA, 709 bp, Homo sapiens
  misc_feature: GYAE6OF02GTI29.3.28.C06.1.454.CMB.1.raw
  modified_base (275)..(275): a, c, t, g, unknown or other
  misc_feature (275)..(275): n is a, c, g, or t
tcagagacgcactccacgaccggtgctcgatttagagctcacgtattggggtttgggggggggtctcaggaggcagcgctctcgggacgtctccaccatggcctgggctctgctattcctcaccctcctcactcagggcacagggtcctgggcccagtctgccctgactcagcctgcctccgtgtcgtgggtctcctggacagtcgatcatcgcatctctgcactaggaaccagcagtgacgttggtgttaataactatgtctctggtatcaacngacaccaggacaaacgaccccaaactcaataactttatgatgtacataacgtccggtacctacgtaggggtttactaacttcgtcttactcgttacgttaactagtcgttaggacctaaacgtaccgtccctacccgtacgtaaccctattaccgtccgtacggggccttaccggacggtaccgttaagggacgggtacgggtacggtcgttaaggttaattttacgttaacgttcgacgtacgtactacgtaactaacttaaaccggaataccgtaagtaccgtaacgtaccggtaaccggtttacgggggttaccttaaccgggaacggttacggggaaaccccttaaagggttcccgtaaccccggttaccgtacccgtaccggtaccgaacccggtacccgaaaccgggtacccccaacccgttaaccgg

SEQ ID NO: 85771 - DNA, 607 bp, Homo sapiens
  misc_feature: GYAE6OF02HUOUW.3.28.C06.1.454.CMB.1.raw
  modified_base (238)..(238): a, c, t, g, unknown or other
  misc_feature (238)..(238): n is a, c, g, or t
  modified_base (241)..(241): a, c, t, g, unknown or other
  misc_feature (241)..(241): n is a, c, g, or t
  modified_base (285)..(285): a, c, t, g, unknown or other
  misc_feature (285)..(285): n is a, c, g, or t
  modified_base (431)..(431): a, c, t, g, unknown or other
  misc_feature (431)..(431): n is a, c, g, or t
  modified_base (456)..(456): a, c, t, g, unknown or other
  misc_feature (456)..(456): n is a, c, g, or t
  modified_base (497)..(497): a, c, t, g, unknown or other
  misc_feature (497)..(497): n is a, c, g, or t
  modified_base (576)..(576): a, c, t, g, unknown or other
  misc_feature (576)..(576): n is a, c, g, or t
tcagagacgcactccacgaccggtgctcgatttagagctcacgtattgggtttgggggggggtctcaggaggcagcgctctcgggacgtctccaccatggcctgggctctgctattcctccaccctcctcactcgaggcacgagggtcctggggcccagtcctcgccctgactcagcctgcctccgtgtctgggtctcctggacagtcgatcatcgcctatctcctgccactgaaccngcngtgacgttggtagttaatactatcgtctccgtgtactacaacgngaccaccgaggaccaaccgaccccaaatctaagttaatttatgtatgtaacgtagtaacctccggtcctaggtagggtttcctaagtccgtctttctcggttgttacagttcgtacggacaaccgcccgtcctcccgtacaccctnttcgtccggtggtacctacggtcgngtacgggacggacggtggtctaagttatttacacgtcgacncttctataactaacgacagcagcgacgtcgtacgtcggtgtacggaacggtcggaacgtaccgtccgacgtcccgtacncgacgaaccgtaccgaaccgtcccacccgtg

SEQ ID NO: 85772 - DNA, 677 bp, Homo sapiens
  misc_feature: GYAE6OF02HO6PQ.3.28.C06.1.454.CMB.1.raw
  modified_base (228)..(228): a, c, t, g, unknown or other
  misc_feature (228)..(228): n is a, c, g, or t
  modified_base (304)..(304): a, c, t, g, unknown or other
  misc_feature (304)..(304): n is a, c, g, or t
  modified_base (461)..(461): a, c, t, g, unknown or other
  misc_feature (461)..(461): n is a, c, g, or t
  modified_base (497)..(497): a, c, t, g, unknown or other
  misc_feature (497)..(497): n is a, c, g, or t
  modified_base (515)..(515): a, c, t, g, unknown or other
  misc_feature (515)..(515): n is a, c, g, or t
tcagagacgcactccacgaccggtgctcgatttagagctcacgtattggggtttgggggggggtctcaggaggcagcgctctcgggacgtctccaccatggcctgggctctgctattcctcaccctcctcactcagggcacgagggtcctcgggcccagtctgccctgactcagcctgcctccgtgtcgtgggtctccgtggacagtcgatcactcgacctatctccngcctacgtacggaaccagcgtagtcggtacggttgggttagttaacttaacttagtcgtcctcgtgtactacaacncgaccaccgtaggaaccaaaccgacccctaaacgtactaatttaattatagtatcgtacgtaagtaccgtccgtccgttacggtacgggtttactaacgtccgttcttacgtcgttagtaactacgtcgtaggacctacgccgtccgtccacacctntcgtcgtcggtccgtcaggcgtacgaggacggtgtntaacgttatttacgtcgntacgatccgtactaagtactacgaatacgacgacgcggtacgtacgggtcggttacccggtacggaaccgtccgggtaacggtacccggtaccgtcccggtacccgtaccggcccgtaaccgggaaccgtacccggaacccgaccccttacccggtaacccg

SEQ ID NO: 85773 - DNA, 592 bp, Homo sapiens
  misc_feature: GYAE6OF02JPG57.3.28.C06.1.454.CMB.1.raw
  modified_base (219)..(219): a, c, t, g, unknown or other
  misc_feature (219)..(219): n is a, c, g, or t
  modified_base (257)..(257): a, c, t, g, unknown or other
  misc_feature (257)..(257): n is a, c, g, or t
  modified_base (269)..(269): a, c, t, g, unknown or other
  misc_feature (269)..(269): n is a, c, g, or t
  modified_base (271)..(271): a, c, t, g, unknown or other
  misc_feature (271)..(271): n is a, c, g, or t
  modified_base (351)..(351): a, c, t, g, unknown or other
  misc_feature (351)..(351): n is a, c, g, or t
tcagagacgcactccacgaccggtgctcgatttagagctcacgtattgggtttggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcngcactggaaccagcagtgacgttggtgttaatactatntctctgtatcanancaccagacaacgaccccaatcaataacttatagatatcagtaacgtccgtacctcgtacgggttactaagtctcttcttntggttaactagtctgacaacgaccgtccctcctacgacctactactcgtcggtctaccgcgtcgtacggaacggtacgacggtactaggttaattacgttactcgctactccgtactaacgtaacgttaaccagacctagacctagtaccgtaggttcgggttacgttaccggacggtaccgggaacgtacggtccgtaccgtccgtaccacggtccaccgaccgaccgacccaccctacg

SEQ ID NO: 85774 - DNA, 694 bp, Homo sapiens
  misc_feature: GYAE6OF02I0YB9.3.28.C06.1.454.CMB.1.raw
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtcctgggtctccgtggacagtcgatcatcgccatctcctgcacgtcgaaccagctaggtgtacgttggtggttataactagtcgtctccgtgtactcaacagaccacccgagaccaaaccgccccctaaatctaattaattatagtatgtctaacgttaactccggtcctacggtagggttactaagtcgtcttctcgttagttactagttcgtcgacaaccgtaccggtcctacccgtacgtacctactccgtcggtacggtccctacggaccggtcgtacgggaggtaccgggtaggtacttaggtacttttaagttaccgtcgaacctacgttactacgtaagttaacgtaaccgaaggtcgaacgacgtacggcgtaaccgggttgggttaccccgtacggtaaccggtacgggaaaccgtacggtaccgtaccccggttaccgtaccccgtaccgggttacccaccgggtaaccccgtaacccggtaccccctaacccggttcccgg

SEQ ID NO: 85775 - DNA, 647 bp, Homo sapiens
  misc_feature: GYAE6OF02HDWYQ.3.28.C06.1.454.CMB.1.raw
  modified_base (287)..(287): a, c, t, g, unknown or other
  misc_feature (287)..(287): n is a, c, g, or t
  modified_base (320)..(320): a, c, t, g, unknown or other
  misc_feature (320)..(320): n is a, c, g, or t
  modified_base (421)..(421): a, c, t, g, unknown or other
  misc_feature (421)..(421): n is a, c, g, or t
  modified_base (442)..(442): a, c, t, g, unknown or other
  misc_feature (442)..(442): n is a, c, g, or t
tcagagacgcactccacgaccggtgctcgatttagagctcacgtattggggtttggggggggggtctcaggaggcagcgctctcgggacgtctccaccatggcctgggctctgctattcctcaccctcctcactcagggcacagggtcctgggcccagtctgccctgactcagcctgcctccgtgtcgtgggtctccgtggacagtcgatcatccgccatcctcctgccacgtcggaaccagcagtcgacggttggtagttaataactatgtctctgtatacaacanccaccagacaaaccgccccaaatcaattaattntagtatgtactaagtacgtccggcctagtagggtttctaatcgtcttcgtcgttaggttaactagtcgtacggacaaccgtaccgtcctacctacgacctntcctcgtcggcctacgcggtntacggaggaccgtaggtctagtaatttactacgtgacgactactacattaacgtaacaagtacgagacgaacggtccgtacgggttcgggttacgtaccgggtaacggtacgggaacccggttacggtacccgtaccggttacccgtacccgtaccggttaccgacccggtaacccgaaccccggtacccctaacccgtacccgg

SEQ ID NO: 85776 - DNA, 591 bp, Homo sapiens
  misc_feature: GYAE6OF02FLTYE.3.28.C06.1.454.CMB.1.raw
  modified_base (231)..(231): a, c, t, g, unknown or other
  misc_feature (231)..(231): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacgttggtggttataactagtcgtctcctggtatcaacgagccacccaggccaaacgcccccgtaaactcaattaatttatagattagtcagtaacgtcggaccctcgtaggggtttctaatcgtcttctcgtaggttacagtctgacaacgcgtccctcccgtgacccatcctgtcggtcctccgaggtcgtgacggacggtacggtcgtagttattagttacgtgcgtagctacatataacaagtccagtacgacgcacggtgggtacttacggacgtggaaccgaacggttccgacccggttccgaccgtaccgtaccgtaccgacccgtaaccggccccgtaacccgtcg

SEQ ID NO: 85777 - DNA, 699 bp, Homo sapiens
  misc_feature: GYAE6OF02JENN1.3.28.C06.1.454.CMB.1.raw
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatccgccatctcctgcatggaaccagcagtgacgttggtagttaatactatgtctcctggtatcaacagccacccaggaccaaaccgaccccctaaaatccaattaatttactagtatacgtcaaggttactccggtcccttacggtacggggtttactaacgtccgtacgttctccgttagttaacgtacgttcgtggacctaaccgtaccgggtccccttaccgtacgtaccctaacgtcccgttcggtcgggtaccctacggtacggtccgtagggaacgggacggacggtacttagttaactttacgtttaacgcgaccgtaagtcctaacgtaattaacgaacgtaacgtaccgagtaccgacgtacggtaacggtttccggggttaaccgttacggtaacgtccgggaaccgtaaccggtacgtaccccgttccgtacccgacggtacccgaccggtacccgaaccggtacccctacccgttaaccg

SEQ ID NO: 85778 - DNA, 749 bp, Homo sapiens
  misc_feature: GYAE6OF02H6LR9.3.28.C06.1.454.CMB.1.raw
  modified_base (215)..(215): a, c, t, g, unknown or other
  misc_feature (215)..(215): n is a, c, g, or t
  modified_base (279)..(279): a, c, t, g, unknown or other
  misc_feature (279)..(279): n is a, c, g, or t
  modified_base (439)..(439): a, c, t, g, unknown or other
  misc_feature (439)..(439): n is a, c, g, or t
  modified_base (506)..(506): a, c, t, g, unknown or other
  misc_feature (506)..(506): n is a, c, g, or t
tcagagacgcactccacgaccggtgctcgatttagagctcacgtattgggtttgggggggggtctcaggaggcagcgctctcgggacgtctccaccatggcctgggctctgctattcctcaccctcctcactcagggcacgaggtcctgggcccagtctcgccctgacctcagcctgcctccgtgtctggtctcctggacagtcgatcatcgccntctctgcagtggaaccagcagtgtacggttggtgttaataactattcgtctctggtatcaacgngaccaccgaggaccaaccgacccccaaactcctaattaattagtgtatgtacgtagtaacgtccgtacctacggttagggtttactaacgtccgttccttcttcgttaacgttacgtacgttcgacgtaccgaacgtaccgtccctaccgtcgtaacctnttccgtgtacggtccctcgacggtcgagaacgggacgtcggtcgttagttaagtttaccgttacggngtaaccgtacgcctttaacgtaacttaacgtaaccgtacgaacgacccgtacgttaaccggtccgttaaacgggggtttccggggtttaacccgttaccgggggttaacccgttaacggggtaacccggttaacccggtaccccgtttaaccccggttacccccgttaccccggtaaacccggtacccggtaaccccggaacccccggtaacccggtaacccccccctaaacccggtacccgg

SEQ ID NO: 85779 - DNA, 737 bp, Homo sapiens
  misc_feature: GYAE6OF02HTCSM.3.28.C06.1.454.CMB.1.raw
  modified_base (181)..(181): a, c, t, g, unknown or other
  misc_feature (181)..(181): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcaggcacgagggtcctgggcccagtctgcctgactcagcctgcctccgtntcgtggtcctccgtggacagtcgatcatccgccatccgtcctgctacgtacggaaccagcctaagtgattggttggttagttaattactagttgtcctcgtagtatacaacgtacgaccaccgagaccaaaccgaccccctaaagtctaattaatttatagtactcgtacaacggtaactccggtaccttaggttacgggtttactaacgttccgtactttccgtacgttaggttaaactacggttcgtacgaaccgtaaccgtacccgtcccgttaccgtacgacccgttacttcccgtacggttcggggtaccctaccggtcgggtacgttacgggaacgggaaccggtaacggtcttaaacggtttaacgtttaacttaacggtccgtaacgtacgtaccttacgtaactaaacgtaacgaacgaccgtaagaccgacgttaacgtcgggttacgggtaccgttaacggtaaccggtacggaaccgtaacgtcccgtacccgtaccggtaccgtaacgtaccgaaccctaaccggacccgtaccctaaccccg

SEQ ID NO: 85780 - DNA, 733 bp, Homo sapiens
  misc_feature: GYAE6OF02JD2ZC.3.28.C06.1.454.CMB.1.raw
  modified_base (244)..(244): a, c, t, g, unknown or other
  misc_feature (244)..(244): n is a, c, g, or t
  modified_base (363)..(363): a, c, t, g, unknown or other
  misc_feature (363)..(363): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctcgcctgactcagcctgcctcgtgtcgttgggtcctccgtggacacggtcgatcatcgacctactctcctcgctacgtacggaaccngtcagtcgtacggttggtacggttataactagtctctccgttaggttactaccaactaccggcctaacccgaggacccaaaacccggaccccctaaaacttccgttaattaacgtttanacggtatttacggtacgtaaacgttaacgtcccggtacccgttacgggttacgggtttaacttacttccggttacttcctttacgtacgttaacgtacgtcgtacgaaccgtaaccgtccgtcccttacccgtacgtactaccgtacgtcggtcgtactccggacgtagacggaggtacgtggcgttagttacttagttacgtcgactacgcttactaacttaacgactaagccgtaacgtacgaaccgtaccggttacgggtacgggttaccgttaacgggtaccggacgggtaaacggtccggtaccggtaccgttccgtaccccgtacggacctccggaacccgtaaccgaccccctaagttacccg

SEQ ID NO: 85781 - DNA, 788 bp, Homo sapiens
  misc_feature: GYAE6OF02F6W1R.3.28.C06.1.454.CMB.1.raw
tcagagacgcactccacgaccggtgctcgatttagagctcacgtattgggtttggggggggtcgtcaggaggcagcgctctcgggacgtctccaccatggcctgggctctgctattcctcaccctcctcactcagggcacaggtcctgggcccaggtctcgccctgactcacgcctgccctcgtgtcgtgggtctccgtggacagtcgatcatccgccattcctcctgaccacgtcggaaccagtcgaagttgtaaccggtttggtacggttaactaacttacgtcgtactccgttagttaacttcgaaacgacgacctaacccgacggaaccgaaaaccgacccccctaaaacgtacctaaatttaaaactttacgttacgtaaagtttcgttactaaacggttaaacgtttcccggacccgtttacggtttaacgggggttttaccttaaacggttccgttccttttacggtacctttacgggtttaaccgaaacgtttccgttacggacccaaaccggtacccgggtacccttacccgttacggtaaccctaacgtccgttcggtttaccgggacccgttacccgtaccgggtacgtaacgggtacggtaaccggaagtccgttaggtaacttttacgtacgtcgattaccgctaactataacgtaccaaggcacgtacgacgacgtacggttacgggccttacgggtaagaccgggtaaccctacgggacctacccgttacggacccttcgggaacaccgtaacccgcggaccccaacccgtcg

SEQ ID NO: 85782 - DNA, 742 bp, Homo sapiens
  misc_feature: GYAE6OF02GIYL9.3.28.C06.1.454.CMB.1.raw
  modified_base (232)..(232): a, c, t, g, unknown or other
  misc_feature (232)..(232): n is a, c, g, or t
  modified_base (250)..(250): a, c, t, g, unknown or other
  misc_feature (250)..(250): n is a, c, g, or t
  modified_base (316)..(316): a, c, t, g, unknown or other
  misc_feature (316)..(316): n is a, c, g, or t
tcagagacgcactccacgaccggtgctcgatttagagctcacgtattgggtttgggggggggtctcaggaggcagcgctctcgggacgtctccaccatggcctgggctctgctattcctcacctcctcactcgagggcacgacgggtccgtcgggcccagtctgccctgactcagcctgcctcggtgtcgtggtcctcgtggactagtcgatcacgtcgacctatccgtccncgacaccgtacggaaccngacgtaggtcgtacggttggtagttaacgtaactagttcggtacctccgtaggtaactacaacgtnaccaaccgacgaaccaaacccgaacccgtaaatacgtaatttaacttgacgtagtacgtagtaacgtaccgtccgtacccgttaggttaacggttacacgttcgtcttacggtacgttagtaacgtacgttacgacgggaaacctacggtaccccggtccctttaaccgaaccggaacttaccgtttacggtaaccggtccggtaccgtaccgggtaaccggtacgtacgggaaacggtacggtaacgtccgttaagttaacgtacgttacggcgtaactcgtacttataaagtaactacgtaaggctaagcgtacgtcgtacggttgggttacgttacggaaccggtcggtaaacggtaccggtactccgggttaaccgtaccgtacggaccaaccggtaccccaacggtaaccctacggtaccg

SEQ ID NO: 85783 - DNA, 697 bp, Homo sapiens
  misc_feature: GYAE6OF02HKD2E.3.28.C06.1.454.CMB.1.raw
  modified_base (245)..(245): a, c, t, g, unknown or other
  misc_feature (245)..(245): n is a, c, g, or t
  modified_base (253)..(253): a, c, t, g, unknown or other
  misc_feature (253)..(253): n is a, c, g, or t
  modified_base (274)..(274): a, c, t, g, unknown or other
  misc_feature (274)..(274): n is a, c, g, or t
tcagagacgcactccacgaccggtgctcgatttagagctcacgtattgggtttgggggggtctcaggaggcagcgctctcgggacgtctccaccatggcctgggctctgctattcctcaccctctcgactcagggcacgagggtcctagggcccaggtctgccctgacctcgacgcctgcctccgtagtctgggtctccgtggacagtcgatcatcgcctatccgtctgcactggaaccgcagtnacggttgngttatactatgtctcgtagtntacgacagcaccgtaggcaacgccccaaactcgtaattaacgttacagtactacgtacaagttacgccggtacctcggtacgggtttcaacgttcgtaccttcttagttcggttatacggtcgtagtacccaaccgtaccggtccctacccgtacgtacctacgttcgtcgttacgggtcaccgtacgggtacgtcggaacgggtacggtaaccggcgttaaggttaactttaacggttactaccgtcgtactacgtaaccgtaactaacgaccggtaacgaacgttcggaaacctaaccggtcgtacggttacggggtacccgttacggtaaccgggtaaccgggtaaccgtaacgggtaccgtaacccgggtcctacccggacgtaccgaaccggtacccgaaccgtacccacccctacgg

SEQ ID NO: 85784 - DNA, 278 bp, Homo sapiens
  misc_feature: GYAE6OF02JKLT3.3.28.C06.1.454.CMB.1.raw
  modified_base (255)..(278): a, c, t, g, unknown or other
  misc_feature (255)..(278): n is a, c, g, or t
tcagagacgcactccacgaccggtgctcgatttagagctcacgtattgggtttggggggtttggtggtctccactcccgccttgacgaggctgattattactgcagctcatatacaagcagcagcactggggtcttcggaactgggaccaaggtcaccgtcgtcccacgtcagcccaaggcccaaccccactgtcactctgttcccaccctcctcgagtcgcgtctctgacggcggctggcaacggcgcatacgnnnnnnnnnnnnnnnnnnnnnnnn

SEQ ID NO: 85785 - DNA, 765 bp, Homo sapiens
  misc_feature: GYAE6OF02JF7WU.3.28.C06.1.454.CMB.1.raw
  modified_base (142)..(142): a, c, t, g, unknown or other
  misc_feature (142)..(142): n is a, c, g, or t
  modified_base (243)..(243): a, c, t, g, unknown or other
  misc_feature (243)..(243): n is a, c, g, or t
  modified_base (274)..(274): a, c, t, g, unknown or other
  misc_feature (274)..(274): n is a, c, g, or t
  modified_base (353)..(353): a, c, t, g, unknown or other
  misc_feature (353)..(353): n is a, c, g, or t
  modified_base (538)..(538): a, c, t, g, unknown or other
  misc_feature (538)..(538): n is a, c, g, or t
tcagagacgcactccacgaccggtgctcgatttagagctcacgtattggggtttgggggggggtctcaggaggcagcgctctcgggacgtctccaccatggcctgggctctgctattcctcaccctctcactcagggcacgngggtcctgggccctagtctcgccctgacctcagcctgcctcgtgtctgggtctccgtggactggtctatcatccgccattcctcctgcctacgaggaaccngctagtcggtacgttggttagttaataactntcgtcctacgttagtactacaacacgacctaaccgacggaaccaaaaccacccccgtaaactactaaatttaaactttnaacggtactttacgtaacctaaacgggttacgtcccggtaccccgttagggttaacgggttttactaaacgttccgttactttcgttcgttaacggtacgttaacgtcggtacgacccgtaaccgtacggtcccctaccgtaacgaccgttctccggttcgtaccggtccttaacggaccgggtntacggggacggtacggtacggaccgttattaaccggtttacgttaccgtacggcgttacgttcctattaacgtaaccggactacggaactcggtaaactccggtagtaacccggggttgttaccgggtaccggtaggtaacccggtaacggttaaccggtacgtaaccccggttccgtaccggtacggacctacccgggaccgtaacccggaccccttacgtaccgg

SEQ ID NO: 85786 - DNA, 668 bp, Homo sapiens
  misc_feature: GYAE6OF02JIMQ6.3.28.C06.1.454.CMB.1.raw
  modified_base (268)..(268): a, c, t, g, unknown or other
  misc_feature (268)..(268): n is a, c, g, or t
  modified_base (437)..(437): a, c, t, g, unknown or other
  misc_feature (437)..(437): n is a, c, g, or t
  modified_base (474)..(474): a, c, t, g, unknown or other
  misc_feature (474)..(474): n is a, c, g, or t
  modified_base (510)..(510): a, c, t, g, unknown or other
  misc_feature (510)..(510): n is a, c, g, or t
tcagagacgcactccacgaccggtgctcgatttagagctcacgtattgggtttgggggggggtctcaggaggcagcgctctcgggacgtctccaccatggcctgggctctgctattcctcaccctcctcactcagggcacgagggtcctgggcccagtctgccctgactcagcctgccctccgtgtctgggtctccgtggacagtcgatcatccgcctatctcctgccacgtaggaacccagctagtgtacggttgttagttataatntgtcctctaggtataaccaacacgcaccctaggacaaccgacccccaaatctaataatttcgtagagtgtacagttacgaccgttaccgttagggttctaatccgtcttctgttcgtatagtcgtgacacgaccgcctccagacctatccgtacgtcgtacctcggacnccgtagggaaccggtagcggttagacgtttaaacttntttacgtagacgaccgttaccacttattaaaaccgntaacgaccgtagaacacggttaccgtagggtttaccggttcgtacggtaaccggggtcgggtaaacccgttacgggtacccttcccggtaacccgtaccccggttaacgccccgaaacggccccggtaaaccaacccccggttaccctacttacccgg

SEQ ID NO: 85787 - DNA, 607 bp, Homo sapiens
  misc_feature: GYAE6OF02FL8KL.3.28.C06.1.454.CMB.1.raw
  modified_base (196)..(196): a, c, t, g, unknown or other
  misc_feature (196)..(196): n is a, c, g, or t
  modified_base (201)..(201): a, c, t, g, unknown or other
  misc_feature (201)..(201): n is a, c, g, or t
  modified_base (315)..(315): a, c, t, g, unknown or other
  misc_feature (315)..(315): n is a, c, g, or t
  modified_base (346)..(346): a, c, t, g, unknown or other
  misc_feature (346)..(346): n is a, c, g, or t
  modified_base (406)..(406): a, c, t, g, unknown or other
  misc_feature (406)..(406): n is a, c, g, or t
  modified_base (467)..(467): a, c, t, g, unknown or other
  misc_feature (467)..(467): n is a, c, g, or t
tcagagacgcactccacgaccggtgctcgatttagagctcacgtattggggtttgggggggggtctcaggaggcagcgctctcgggacgtctccaccatggcctgggctctgctattcctcacccctcctcactcagggcacgagggtcctgggcccagtctgccctgactcagcctgcctcgtgtctggtctcgnggacngtcgatcatcgcatctcctgcactcggaaccgcagtcgacggttggtagttaatactatgtctcgttggtatacacacgccaccgaggacaaccgccccaaatcaattaattgnagtgtacagtactcgctgtacgttcatcgtntctcgtagtactgtcgcgactacgcgtccctcgtacgctctcgtcgtcgtcctgcgtcgnggacggacgagtcgttacgttaatacgttcgtagctacgtctataaccgttacgaacgtanccgacgtacgaaccggttcgtaacgggttcgggttaccgtaccgggaaccgtacgggaaccgttacggttaccgtcccggtaccgttaccccggacgttcccgaacccggtacccgaacccgggtaccctaccgttaccg

SEQ ID NO: 85788 - DNA, 778 bp, Homo sapiens
  misc_feature: GYAE6OF02ILVK3.3.28.C06.1.454.CMB.1.raw
  modified_base (232)..(232): a, c, t, g, unknown or other
  misc_feature (232)..(232): n is a, c, g, or t
  modified_base (276)..(276): a, c, t, g, unknown or other
  misc_feature (276)..(276): n is a, c, g, or t
tcagagacgcactccacgaccggtgctcgatttagagctcacgtattggggtttggggggggtctcaggaggcagcgctctcgggacgtctcccaccatggcctgggctctgctattcctcaccctcctcactcagggcacagggtcctgggcccagtctgccctgactcagcctgcctccgtgtctgggtctcctggacagtcgatcatcgcatctcctgcactggaaccngcagtgacgttggtgttataactatgtctccgtggtactcaacngcaaccgagaccaaaaccgaccccctaaactcctaattaactttatacgtattgtacaagtaaacgttccggacccttacggtaggggttttacctaacgttccgtacttccttcgttacggttaacgtaacgttccgtagggtaccaaaccgaccggggtccccttcccgtacgaacccgtattcccgtcggttcgggcccttccgacgggcgttacggaacgggtaccgacggtcccttaaggttaagttttaacgtacgttaaccgctaacggtacctaacgtaacgttaactaacccggaaagaccgtaacgacgtaacggtaccggttaccgggggtttacggggttaccggttaccggggtaacccgggttacggggaaaccccggttaaccggtccccggttaacccggttaccccggtaaccccggtaacccggtacccggtaaaccccggaacccccgggaaaccccggtacccccctaaaccccggtaccgg

SEQ ID NO: 85789 - DNA, 567 bp, Homo sapiens
  misc_feature: GYAE6OF02GTI1F.3.28.C06.1.454.CMB.1.raw
  modified_base (232)..(232): a, c, t, g, unknown or other
  misc_feature (232)..(232): n is a, c, g, or t
  modified_base (274)..(274): a, c, t, g, unknown or other
  misc_feature (274)..(274): n is a, c, g, or t
  modified_base (302)..(302): a, c, t, g, unknown or other
  misc_feature (302)..(302): n is a, c, g, or t
  modified_base (308)..(308): a, c, t, g, unknown or other
  misc_feature (308)..(308): n is a, c, g, or t
  modified_base (313)..(313): a, c, t, g, unknown or other
  misc_feature (313)..(313): n is a, c, g, or t
  modified_base (328)..(328): a, c, t, g, unknown or other
  misc_feature (328)..(328): n is a, c, g, or t
  modified_base (340)..(340): a, c, t, g, unknown or other
  misc_feature (340)..(340): n is a, c, g, or t
  modified_base (449)..(449): a, c, t, g, unknown or other
  misc_feature (449)..(449): n is a, c, g, or t
  modified_base (462)..(462): a, c, t, g, unknown or other
  misc_feature (462)..(462): n is a, c, g, or t
tcagagacgcactccacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcagcctgcctccgtgtcgtgggtctcctggacagtcgatcatcgcatctcctgcactggaaccngcagtgacgttggtagttataactatgtctcctgtatcaacngcaccagacaacgccccaatcataattngatgtnagtancgtcctagtaggttnatcgtcttcgtntacgtactagtcgtacggacaacgtaccgtccctcccgtacgacctagtcctcgtcggtcctccgaggtctaggacgggacgaggtcctagtatttatcgtgactgctntaactatacgaancgagtccagtctacggtcgggttacgttacggaccggtacgggaccgtaacggtcctacccgtccgtaccacggtacacccgacccgaccgtaccccaccctccg

SEQ ID NO: 85790 - DNA, 1062 bp, Homo sapiens
  misc_feature: GYAE6OF02HTIZJ.3.28.C06.1.454.CMB.1.raw
  modified_base (169)..(169): a, c, t, g, unknown or other
  misc_feature (169)..(169): n is a, c, g, or t
tcagagacgcactccacgaccggtgctcgatttagagctcacgtattgggtttggggggggtctcaggaggcagcgctctcgggacgtctccaccagtggcctgggctctgctattcctcaccctctcactcaggcacagggtcctgggcccagtctcgccctagactnagcctgccctcgtgtctggtctctggacagtcgatcatcgaccagtcctactgactacgtggaacctagctaggtcgtacggtttgggagttaacgtaactaagtcggttaccttccgtaggttaactacctaaaccgacgtaccaaccccgaagggaccaaaacggaccccccctaaaattacctaaacggttaaattttacgtacgtagtcgtacctaaggtaaactccgggcccctacggtaaggggtttactaaacgtccggtacctttcgtttaccgtacgggtttaaaactaacgttccgttaggggtaacctaaaaccgtacccggtaccccgtttaacccgaccgtaaacccggttacctttaccgttaccggtttacccggggggtacccctttaaccccggaaccggggttaaccggtttacgggtaaaccgggggaaacccgggtaaaccggggtaacccggttttaacccggttttaaaaggtttttaaacccgttttaaaacccggtttaccgggttaaaccctaaaccggggtacccctttaaacgggttaaacccgtttaaaacccgggttaaaacccgtaaaaaccgggtacccccgttaaacgggaacccgtaaaccggttaaccccgggttaaacccggggttttaccgggggggtttaacccgggttttaaccccgggggttaaaacccggtttaacccggggggtaaaaccccggtttaaaaacccggggttaccccggttaaaccccgggttttaaaccccgggttacccccccggggtaaaccgttttaccccggggaaaacccccggtttaccccccggggaaaaacccccggtaccccccggtaaaacccccccggtttaaacccgggg

SEQ ID NO: 85791 - DNA, 678 bp, Homo sapiens
  misc_feature: GYAE6OF02HF4JR.3.28.C06.1.454.CMB.1.raw
  modified_base (233)..(233): a, c, t, g, unknown or other
  misc_feature (233)..(233): n is a, c, g, or t
  modified_base (248)..(248): a, c, t, g, unknown or other
  misc_feature (248)..(248): n is a, c, g, or t
  modified_base (274)..(274): a, c, t, g, unknown or other
  misc_feature (274)..(274): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtcctcctggacagtcgatcatcgccatctcctgcacgtggaaccngcagtcgacgttggngttatactatgtctcgtgtatcaacncgcacccaggacaaaccgacccccaaacgtacaattaacttagtagtatcgttacgtaagtaacgtccggtcccgtacgtacggggtttctaacgtcgtcttactcgttaggttaactaacgttcgtcggacaaccgtaccggtccctaccgtacacctcgttacctcggtcggtcctccgaggtcctagggacgcggtacgtccgttatacgtttaacttacgtgcgtacgtctacgtataacgtaacgtacgaccacgacctacgaccgtacggttacggggttaccgttaccgggtaacggtaccggggtaaccggtaccggttaccggtacccggtcccgtaacccggtaccgttcccgaacccggtacccggaacccggttacccaaccccgttaccgg

SEQ ID NO: 85792 - DNA, 752 bp, Homo sapiens
  misc_feature: GYAE6OF02IBY4N.3.28.C06.1.454.CMB.1.raw
  modified_base (162)..(162): a, c, t, g, unknown or other
  misc_feature (162)..(162): n is a, c, g, or t
  modified_base (205)..(205): a, c, t, g, unknown or other
  misc_feature (205)..(205): n is a, c, g, or t
  modified_base (631)..(631): a, c, t, g, unknown or other
  misc_feature (631)..(631): n is a, c, g, or t
  modified_base (636)..(636): a, c, t, g, unknown or other
  misc_feature (636)..(636): n is a, c, g, or t
  modified_base (640)..(640): a, c, t, g, unknown or other
  misc_feature (640)..(640): n is a, c, g, or t
  modified_base (654)..(654): a, c, t, g, unknown or other
  misc_feature (654)..(654): n is a, c, g, or t
tcagagacgcactccacgaccggtgctcgatttagagctcacgtattggggtttgggggggggtctcaggaggcagcgctctcgggacgtctccaccatggcctgggctctgctattcctcaccctctcactcagggcacgacgggtcctcgggcccagtcngccctgactcacgctcgcctcgtgtcgtcgggtctcgtggacncgtcgactcactcgacctagtcctaccgtcgacctacgtacggaacctcggactacggttcggttacggtttgggttacggtttaaacttaacttacgttcggttacctacggttacggtacgtacctaacgacgaccgaaccgacggaacctaaaccaccccgtaaacctacttaaactttaacttacgtacggtacttacggtacgtaacgttaacggtcccggttaccgttacgggtttacggggtttaactaccggtacgttaccgtttcgttacttacgggttaacgtaccgttacggtaacgtaccgaaccgtcccgtcccgttaccgtacgtaccttacgttccttaccggtcgggtacccgttacggacggttacgaacgggtaacgacggtacggtattacgttatacttcggtacnctacnctanactaacgcgtaacncagtcacggtgaaccggttgtacctacgggtacgacgtaaccggtcaccggtacttccgcttaacggacgtaccgaacccgaccttaaccgactaccg

SEQ ID NO: 85793 - DNA, 740 bp, Homo sapiens
  misc_feature: GYAE6OF02HS1IL.3.28.C06.1.454.CMB.1.raw
  modified_base (142)..(142): a, c, t, g, unknown or other
  misc_feature (142)..(142): n is a, c, g, or t
  modified_base (203)..(203): a, c, t, g, unknown or other
  misc_feature (203)..(203): n is a, c, g, or t
  modified_base (210)..(210): a, c, t, g, unknown or other
  misc_feature (210)..(210): n is a, c, g, or t
  modified_base (239)..(239): a, c, t, g, unknown or other
  misc_feature (239)..(239): n is a, c, g, or t
tcagagacgcactccacgaccggtgctcgatttagagctcacgtattgggtttggggggggtcgtcgaggaggcgagcgctcgtcgggacgtctccaccatggcctggctctgctattcctcaccctcctcactcaggcagnggtcctggcccagtctgccctgactcagcctgacctccgtgtccgtgggtctccgtggacngtcgatnatcgcctatctccgtgctacgtggaaccngcgtagtggtaccgttgggttagttaataacgttagtgttacctccgttggttatacctaaagacgtccaacccgtacggaaccgaaacccggtaaccccccaaaataccaagttaaacttagtcgtaactgtactaagtaacgtccggtccttacggtgggtttaactaacgtcgtaccttcgttaccttaggtaacctacggtcgtcgggtaacctacgtacccggtaccttcccgttacgacccgtaacttccgtccggttcgggtacccgttccgtaacgggtacgttaccggggaaacggtccgggtaaacgtcgtaaacgttaccgttttaacgtacctagtacgtctaccttacgattaaccgactaaggccagacctacgacgtacgtcgggttacctacggttacggtaccggaaacggttaccgtaccgtacccggttaccacccgtacggtaccaaccgggtacccgtaaccgcccgtaaaccccgtccg

SEQ ID NO: 85794 - DNA, 803 bp, Homo sapiens
  misc_feature: GYAE6OF02JLXI6.3.28.C06.1.454.CMB.1.raw
  modified_base (612)..(612): a, c, t, g, unknown or other
  misc_feature (612)..(612): n is a, c, g, or t
tcagagacgcactccacgaccggtgctcgatttagagctcacgtattggggtttgggggggggtctcaggaggcagcgctctcgggacgtctccaccatggcctgggctctgctattcctcaccctcctcactcagggcacgagggtcctgggcccagtcctgccctgactcgagtcctgcctccgtgtccgtgggtcctccgtaggactaggtcgacttcacgtccgacctagttccctcctcgccgtaccgtacggggaaaccacggcgtaacggtggtaccgggtttggggttacgtttaaagttaacgttaagttcgttccgttaccggtaggttaactaccgaaccgtaccggaacccaacccggaacgggaaccaaaacccccggtaacccccctaaacctacctaaaagttttaaactttaacgtacggtaacgttcggtaaacctacggtaaccgttccccgggtaccgtttaccgggttagggttaaccttaacgtcccgttacgttccgttacgttacggttaactacggttcgtacgtaccgaaccgtacccgttccctacgtaccgactcgtcgtcgtacgcgtacggcggtgtaacggnggtacgagtcaggttactacgttcaacgtcgtactccgtaacgagttaccaaggtacacggtacaccgtcgtacggtaacggtcggttacgaccgggacgttaccggggaaacgttaccgtcccgtaacccggtccgtacccggacgtacccgggaacccgtacccggaacccggaccctaccccggtaac

SEQ ID NO: 85795 - DNA, 623 bp, Homo sapiens
  misc_feature: GYAE6OF02G34HP.3.28.C06.1.454.CMB.1.raw
  modified_base (141)..(141): a, c, t, g, unknown or other
  misc_feature (141)..(141): n is a, c, g, or t
  modified_base (213)..(213): a, c, t, g, unknown or other
  misc_feature (213)..(213): n is a, c, g, or t
  modified_base (233)..(233): a, c, t, g, unknown or other
  misc_feature (233)..(233): n is a, c, g, or t
  modified_base (254)..(254): a, c, t, g, unknown or other
  misc_feature (254)..(254): n is a, c, g, or t
  modified_base (258)..(258): a, c, t, g, unknown or other
  misc_feature (258)..(258): n is a, c, g, or t
  modified_base (270)..(270): a, c, t, g, unknown or other
  misc_feature (270)..(270): n is a, c, g, or t
  modified_base (274)..(274): a, c, t, g, unknown or other
  misc_feature (274)..(274): n is a, c, g, or t
  modified_base (444)..(444): a, c, t, g, unknown or other
  misc_feature (444)..(444): n is a, c, g, or t
  modified_base (496)..(496): a, c, t, g, unknown or other
  misc_feature (496)..(496): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacgngggtccgtgggcccagtctcgccctgactcacgcctgcctccgtgtctgggtctccgtgacagtcatcatcncatctcctgcacgtggaacncgcagtgacgttggtgttaanattntgtctcgtgtanacangccacgacgacaaccacccaatctaatattactagctgtactaagtacgccgtacgttacggtacggtttacactcgtacttacttcgttagtaacagtgttacgaccaccgtccggtacctaccgacacctgttcgccgtcgggaccttacgcggtgacggaggtacgnggttacagttacttttaggtcagtacacgtacttagtaaacgtacacggtancgtaacgcttacggccgttaacggcgggttaaccgttacgggaccggtacgtaaaccgtacggcccttaccggtcccgacccgttacgacccgttaccgacccggaaacccgccctaaacccgttcg

SEQ ID NO: 85796 - DNA, 806 bp, Homo sapiens
  misc_feature: GYAE6OF02HE0UW.3.28.C06.1.454.CMB.1.raw
  modified_base (634)..(634): a, c, t, g, unknown or other
  misc_feature (634)..(634): n is a, c, g, or t
tcagagacgcactccacgaccggtgctcgatttagagctcacgtattgggtttgggggggggtctcaggaggcagcgctctcgggacgtctccacatggcctgggctctgctattcctcaccctctcactcgaggcacgagggtcctgggcccagtctcgccctgactcacgtcctgcccgtccgtgtcgtgggtactccgtggacagtcgatcgacgtccgacctagtcctccgtcgacaacgtacggaaaccagccaggttcgtacggttgggttagtttaactaacgtacgtagtccttccgttaggtactaacaacgacgacccgacccgtaaggaaccaaaaccgaccccctaaaactcctaaattaaactttacgagtacgttacgtacgtaagttaccgtacccggtcccgttacgggttaacgggtttaccttaacggtccgtttacgttaccgtttcgttaacgggttaagtaaccggttacgtacggaccgtaaaccgacccgggtaccccttaccgaccgtacctacgttcgtccggtaccggtccgtacggtaccggtggtacggacgggtacggtacggacgttagttaactttacgttacgacgacgttagacccttaanacgttaaacaacgtacaccgattaacggacgtaccgggttagtacccggggttacgtaccgggtcgtaacccggggaaccggtaaacggttccggtaacccggttacccggttaccgaccgttaacccggaacctaaccccgggaaccgtacccccgaacccgttaacccgg

SEQ ID NO: 85797 - DNA, 690 bp, Homo sapiens
  misc_feature: GYAE6OF02J2194.3.28.C06.1.454.CMB.1.raw
  modified_base (233)..(233): a, c, t, g, unknown or other
  misc_feature (233)..(233): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacagggtcctgggcccagtctgccctgactcacgcctgcctccgtgtctgggtcctccgtggacagtcgatcatcgccatctcctgcactggaccngcagtgacgttggtgttataactatgtctcgtggtatacaacagacacccgaggacaaccgacccctaactctaactaattatagattacgtacgtaacgttaacgtccggtacccgttacggtacggggtttacctaaacgtccggtaccttcgtaccgttacggttaacgaacgttccgtaggtaccgtaaccggtaccgggtaccccttcccgtaacgtaccctaaccgttccgttacgtaccgggtccttacccggacggttcgacgggtaacgggacggtacggtccgtagtaacgtttacttacgtcgtacagtacctacgtaactatacgaacgtacacgtactcgtaccgtacgtcgggttacttacggaacgtacgggtaacccaggttaccgaccggttaccgtaccgtcgaaccgtccgacccggtaacgacccctacccgtaccg

SEQ ID NO: 85798 - DNA, 714 bp, Homo sapiens
  misc_feature: GYAE6OF02FME6R.3.28.C06.1.454.CMB.1.raw
  modified_base (246)..(246): a, c, t, g, unknown or other
  misc_feature (246)..(246): n is a, c, g, or t
tcagagacgcactccacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcagcctgccctccgtgtcgtgggtcctccgtggacagtcgatcagtccgcctatcctcctgccacgtacggaaacccngacctaggtcgtacggttggttaggttaactaactatcgtcttccgtggtactcaactacgccacccaggacaaaccgacccccaaactctaattaattagtacgtatagtactaagtaacgtccggtccctacggtacggttactaactcgtcttcgtcttaggttacacgttcgtcgacaaccgtccgccctccgtacgacctacgtaccgtcgtcgggtcctcgacggtcgaggacggtacggaggtcgtaggttaacttagttactgaccgagtcctaacttaacgtaaacgaacgtacgaacgtaacggacctaacggtccggtaacgggttccggggttaaccgttaccgggaaccgggtaccgggaaacggttaacccggtaccgtacccgggttcccgtaacccggaccggtaccgaacccgggtaccccgaaaccccggtacccccaacccggttaccg

SEQ ID NO: 85799 - DNA, 850 bp, Homo sapiens
  misc_feature: GYAE6OF02HVFPO.3.28.C06.1.454.CMB.1.raw
tcagagacgcactccacgaccggtgctcgatttagagctcacgtattggggtttgggggggggtctcaggaggcagcgctctcgggacgtctccaccatggcctgggctctgctattcctcacctcctcactcagggcacgacgggtctcgggcccagtctcgcctgactcacgcctgcctcgtgtcgtggtcctcgtaggacagtcgactcagtccgactacttcctcctcgtactacgtacggaaccagacgtaggtcggttacgggtttgggttacgttaacttaacttcgttcgttaccttacgttacgggttaactaccgtaaaccgacgaaccccgaaccggaacggtaaccccaaaaacccgtaccccctaaaacttacgttaaaactttaaagttacgtagttaacgtacgttaactaaacggtttaacgtacccggtttacggtaccgggttaacgggttttaacctaacgttccgttccgtttaacgtcggttaagttaaccgtacgttacgacggacgtaacccgtcgtacccttccggacttacgtaccggtttcctcgggtccgtaacgtaccggtacggttacgaacgggaccggtacggtacgttactttaaaggttactttacggtacgttacgaccgtaacctacttaaacgttagtaaacgttaaccgaacggaccttacggaaccgtaaccggtcggtaaaccggggtttcgggttaacgtaccgggtacgggtaaccgggtaacggtacccggttaaaccggttcccggtaccgtacccggttacgacccgaaccgggaacccgtaacccggaaccctttacccgaacgg

SEQ ID NO: 85800 - DNA, 696 bp, Homo sapiens
  misc_feature: GYAE6OF02HPPC3.3.28.C06.1.454.CMB.1.raw
  modified_base (119)..(119): a, c, t, g, unknown or other
  misc_feature (119)..(119): n is a, c, g, or t
  modified_base (164)..(164): a, c, t, g, unknown or other
  misc_feature (164)..(164): n is a, c, g, or t
  modified_base (206)..(206): a, c, t, g, unknown or other
  misc_feature (206)..(206): n is a, c, g, or t
  modified_base (224)..(225): a, c, t, g, unknown or other
  misc_feature (224)..(225): n is a, c, g, or t
  modified_base (235)..(235): a, c, t, g, unknown or other
  misc_feature (235)..(235): n is a, c, g, or t
  modified_base (243)..(243): a, c, t, g, unknown or other
  misc_feature (243)..(243): n is a, c, g, or t
  modified_base (262)..(262): a, c, t, g, unknown or other
  misc_feature (262)..(262): n is a, c, g, or t
  modified_base (269)..(269): a, c, t, g, unknown or other
  misc_feature (269)..(269): n is a, c, g, or t
tcagagacgcactccacgaccggtgctcgatttagagctcacgtattgggtttggggggggtctcagggaggcagcgctctcgggacgtctccaccatggcctgggctctgctattccncacctcctcactcagggtcacgtacgggtccgtcgggcccagtcncgccctgactcagcctgcctccgtgcgtggtctccgtggacngtcgatcatcgcatctcnncacgtcgacngcagtcgngttggtagttactatagtntctcgtntacgtacactaggcctaccgagacaaccgacccctaaactctaattaattactagtactacggtactaacgttaacgtccgaccgttacggtttacgggtttaactacgtaccgttacgttcttacgttacggttaaacgtacgttacggtaccggactaaccctcggttacccgtccgtacgtacctaccttcgtccggtacggtcctacccgaggttcgaggtaaccgggcggtaacgttcagttaaccgtttagtacgtcgtaacgcggtctagtactttaacggacctacgtacgaaccgtcaacggtgtaccggttagggtaccggtacgtacgggttccgggaacgttaccggtaccgtaccggttaccctaccgggtacctaccgaccgggtaacccgaacgtacccccgaacccttacg

SEQ ID NO: 85801 - DNA, 732 bp, Homo sapiens
  misc_feature: GYAE6OF02FRJ16.3.28.C06.1.454.CMB.1.raw
  modified_base (202)..(202): a, c, t, g, unknown or other
  misc_feature (202)..(202): n is a, c, g, or t
  modified_base (284)..(284): a, c, t, g, unknown or other
  misc_feature (284)..(284): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacgagggtcctgggcccagtctcgccctgactcacgcctgcctccgtgtctgggtctcctggacngtcgatcagtcgccatcctcctgactactgaaccagcagtgtacgttgggtgttaataactatcgtctcctggtatacaacngaccaccgacggaccgaaaccgacccccgtaaaactactaaactttaaagtttactagtaacttacgtacgaacggttaaaccgtccggtaccccgttacggttaacggggttttaccttaaacgttccgtacgtttcctttaccggttacggtttaaacgtacgttacgttaccggaacgtaaccgtaccgggtcccttacccgtcgaaccttacgtccgttccgtacggtcctacccggcggtcgtacggtacgggacgtacggtacgttcgttattacgtttacgcgacgactccgtactacgtaactacgactacgacgtaccgaggtaccgtacggtacgggttccgttacggtaccggtacgggtacccgtaacggtacccgtcccgtaccgtcccgtacggtaccggtaccgacccgtacccggaccccgtaaccctaccg

SEQ ID NO: 85802 - DNA, 729 bp, Homo sapiens
  misc_feature: GYAE6OF02H25W6.3.28.C06.1.454.CMB.1.raw
  modified_base (597)..(597): a, c, t, g, unknown or other
  misc_feature (597)..(597): n is a, c, g, or t
tcagagacgcactccacgaccggtgctcgatttagagctcacgtattgggtttgggggggggtctcaggaggcagcgctctcgggacgtctccaccatgcctgggctctgctattcctcaccctctcactcagggcacgagggtcctgggcccagtctcgccctagactcagcctcgccctcgtgtcgtgggtcctccgtggactagtcgatcactccgacacttctcctgacacgtacggacctagcaggtcgtacggttggtagttaactaagttatcgttccgttaccgtggtaactacctaacgacgaccgacccgtaacgaaccgtaaaccgaccccctaactactaacttaagttaacgttagtactacgttaacgtaggttaacgtccgggtacccgtacggtttaccggggtttactaacgtccgttacttccgttacgttacggttacgaacgtcgtacgactaaccggtcccgtacctaccggtacaccgtactcgttacgtcggtaccgtaccgcgtacggtacggaacgggcgtaacggtacgttattaacgtttacttacggtcgacgttactcctaacgttanaactaagtacgacaacgtagaccgtaacgtccgggtttcggttacgtaccgggttacgacggtaaccgaccgttacccggacgtacccgtaccgtacgccgtaaccgacccgaaccgtaccctaccgtaccg

SEQ ID NO: 85803 - DNA, 756 bp, Homo sapiens
  misc_feature: GYAE6OF02H9EMC.3.28.C06.1.454.CMB.1.raw
  modified_base (202)..(202): a, c, t, g, unknown or other
  misc_feature (202)..(202): n is a, c, g, or t
  modified_base (225)..(225): a, c, t, g, unknown or other
  misc_feature (225)..(225): n is a, c, g, or t
  modified_base (241)..(241): a, c, t, g, unknown or other
  misc_feature (241)..(241): n is a, c, g, or t
tcagagacgcactccacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctcgccctgactcagcctgcctccgtgtctgggtctccgtggacngtcgatcatccgcatcctccgtncctacgtaggaaaccngcagtcgtaggttggtagttatactatcgtctcgtagtatacaacgtcgaccaccgacggaaccaaacgtacccccaaatactaattaattatagtagtagtactaacgtacgccgtaccgtcgtacgggttactacgtacctcttactacgttaggtactacgtcgtacggtaccctaacgtacccggtccctacccgtacgtaacccgtcgttccgtaccgggtcccgggtacccgtaccgggtacggtacgtaacggggtacggtaaccggtcggtaacggtttccgttaaagtttaccgttacggtacgtaccgacgttcctaacgttaaacttaacgaacgacggtacgtacgaaccgttcggtaccggtaacgggttaccggggttaccgtaacgggtccggtaaccgggaaccgttaccggtaacccggtaccccggtttacccgtacccggtacccgtaacccggtacccggaaccccggtaacgtacccccccgtaagtaccccgg

SEQ ID NO: 85804 - DNA, 794 bp, Homo sapiens
  misc_feature: GYAE6OF02J0RHT.3.28.C06.1.454.CMB.1.raw
  modified_base (242)..(242): a, c, t, g, unknown or other
  misc_feature (242)..(242): n is a, c, g, or t
  modified_base (255)..(255): a, c, t, g, unknown or other
  misc_feature (255)..(255): n is a, c, g, or t
  modified_base (574)..(574): a, c, t, g, unknown or other
  misc_feature (574)..(574): n is a, c, g, or t
  modified_base (693)..(693): a, c, t, g, unknown or other
  misc_feature (693)..(693): n is a, c, g, or t
tcagagacgcactccacgaccggtgctcgatttagagctcacgtattggggtttgggggggggtctcaggaggcagcgctcgtcgggacgtctccaccgatggcctgggctcgtgctacttcctcacccgtcctcactcgagggccacgagggttcctcgggccctaggtctcgccctgactcgacgcctgcctcggtcgtcgtcggtcctcgcggactagtcgatcactacgccatcctcngcacgtcggaccngcgtacggtaggtacgttggttattaactaacgtgtacgtccgtacgttacgactaaccgacgtacgcccgtaacccggaaggaacccaaaacccgtaccccgtaaagttacgtaaatttaaaccgtttaggtagacttaaccgggtaactaaaacgggttcccggtcccggttaacccgttagggggttaaccggttactaacggtcctttacgtccgttttacgtaacggtaacgttacggtaccggtacggtaaccgaacgttccccgggtacctacccggtatacccgtacggtttccgtccggtacggttaccncgggtacgcggttaaacggcgggtaaacgtcgtagttaacgtattttaccggcgtaccagtccctacggtactaacgttaccgaacgactccggaacgcgttaggacgttaccggggtntaacccgggaggtccggtaaccggaccgttacggtacccctccgggttaacgacccgtagggtacccacccgaacccgggtaccctaaccgttccgtacgg

SEQ ID NO: 85805 - DNA, 750 bp, Homo sapiens
  misc_feature: GYAE6OF02FP5OR.3.28.C06.1.454.CMB.1.raw
  modified_base (494)..(494): a, c, t, g, unknown or other
  misc_feature (494)..(494): n is a, c, g, or t
  modified_base (566)..(566): a, c, t, g, unknown or other
  misc_feature (566)..(566): n is a, c, g, or t
tcagagacgcactccacgaccggtgctcgatttagagctcacgtattgggtttgggggggggtctcaggaggcagcgctctcgggacgtctccaccatggcctgggctctgctattcctcaccctcctcactcagggcacgagggtcctgggcccagtctcgccctgactcgagcctgcctccgtgtctgggtctctggactagtcgatcactcgctactctccgtgctacgtcggaaccagcgagtacggtacggtttggtaggttaataacgttatcgttacctaccgtaggtactacaaacgtacgaccgaccgacggtaccaaaccggtacccccaaacgttacctaattaaactttactaggtacttacggtagtaacgttaaccgtccggtaccccttgggttaacggggtttactaacgtccgttcttcgttcgtacgttaacgtagttcgtacggtacgaaccgtcggacccttccgtacaccgtntccgtcggtcggtacgccgtaggtcccgtagggtaccgacgggtacggtcgttaagttaacttacggttacncggtaccacgggttcctaagtacttaaccgaagtaacgaacgtaccggataaccggccgtaacggggttcgggttaccgttaccggaaccgggtacgggaaaccggtccggtaaccgttccccggttaacggtccctaccggtacgacccggacccggaaccggtacccctaaccccgtaccgg

SEQ ID NO: 85806 - DNA, 699 bp, Homo sapiens
  misc_feature: GYAE6OF02FU2H5.3.28.C06.1.454.CMB.1.raw
  modified_base (240)..(240): a, c, t, g, unknown or other
  misc_feature (240)..(240): n is a, c, g, or t
  modified_base (534)..(534): a, c, t, g, unknown or other
  misc_feature (534)..(534): n is a, c, g, or t
  modified_base (556)..(556): a, c, t, g, unknown or other
  misc_feature (556)..(556): n is a, c, g, or t
  modified_base (578)..(578): a, c, t, g, unknown or other
  misc_feature (578)..(578): n is a, c, g, or t
tcagagacgcactccacgaccggtgctcgatttagagctcacgtattgggtttggggggggtctcaggaggcagcgctctcgggacgtctccaccatggcctgggctctgctattcctcaccctcctcactcagggcacacgggtcctgggcccagtctgccctgactcagcctgccctcgtgtctgggtcctcctggactagtcgatcatccgccatccgtcctgctacgtcggaaccngacagtggacggttggtaggttaataacgtagttcgtcttccgtaggtactaccaacgtacgacccgaacccgaggtaacccgaaacccggtacccccctaaaactccgtaacttaaatttacctagtacgttagtacgtaacgttaacgtcccgggtacccttacggtaacgggttttactaacgttccgttcttcgttacgtacggttaaccacgttcgtcgaactaacgaccgtccctacctcgaactactccgtacgtcggtccgtacgcgtcggagtacggacggtcgngtagtaacttactacgcggacncgtacctagactaacaccacgngtacgacgtacgacgtcgtaccggttagtaccggaccggtacggtacgaaccggtccctaacccgtaccgtccggtaccgtaaccaccggtaacccgtaccgaaccccctccgttaacccg

SEQ ID NO: 85807 - DNA, 535 bp, Homo sapiens
  misc_feature: GYAE6OF01ENVHW.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggatccaccgtcacagatggttccttcgtggggctgggtccgcagtccccagagaaggtctggagtggattgggagtgtctagtaagtacggggagtcaatatcgtggtgacactccctactacaacccgtctttaagagtcgagtcactatatcagtgcgtctcgtccacgaaccaggtcctccctgaggatgagatcgtgtgacggccgcagacgacggccaagtattctgtgcgagacgacccggagtacgcgacgctggagcgacgtggtacttcgatgccgtggggccgtggccgcccgtggtaccg

SEQ ID NO: 85808 - DNA, 533 bp, Homo sapiens
  misc_feature: GYAE6OF01DGCYR.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggtttttcctcctgctggtggcagctccagatgggtcctgtcccaggtccacctgcaggagtcggtcccaggactggtgaagccctcggagaccctgtccctcatttgcactgtgtctggatccacgtcacagatggttcctctggggctgggtccgcagtcccagagaaggtctggagtggattgggagtgtctagtaagtacggggatacaatatcgtggtgacactcctactacaaccgttctttaagagtcgagtcactatatcagtgcgctcgtaccacgaaccaggtctcctgacggatgagatcgtgtacgacggtccgcgagacgacgcaagtatttctgtcgcgagacgacccgtagttacgcgacgccgtaggacgcgacgtggtactcgatgacgtcgggactggccgccgtggtccg

SEQ ID NO: 85809 - DNA, 530 bp, Homo sapiens
  misc_feature: GYAE6OF01E2OEG.21.45.E01.1.454.CMB.1.raw
  modified_base (352)..(352): a, c, t, g, unknown or other
  misc_feature (352)..(352): n is a, c, g, or t
  modified_base (359)..(359): a, c, t, g, unknown or other
  misc_feature (359)..(359): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggatccaccgtcacagatggttccttctggggctgggtccgcagtccccagagaagggtctggagtggattgggagtgtctagtaatacggggatcaatatcgtgtgacactccctactacaacccgtntttaagngtcgagtcactatatcagtgcgctcgtccacgaaccaggtctccctgaggatgagatctgtgacggccgcagacacggccaagtattctgtgcgagacgacccggagttagcgacgccgtggaggcgacgtggtacttcgatgccgtggggcccgtggccgcccgtggtcc

SEQ ID NO: 85810 - DNA, 548 bp, Homo sapiens
  misc_feature: GYAE6OF01EE2VN.21.45.E01.1.454.CMB.1.raw
  modified_base (356)..(356): a, c, t, g, unknown or other
  misc_feature (356)..(356): n is a, c, g, or t
  modified_base (455)..(455): a, c, t, g, unknown or other
  misc_feature (455)..(455): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggatccaccgtcacagatggttccttcgtggggctgggtccggcagtccccagagaagggtctggagtggattgggagtgtctataagtacgggggatcaatatcgtggtgacactccctactacaacccgtntttaagagtcgagtcactatatcagtgcgctcgtccacgaaccaggtcctccctgagatgagatctgtcgacggccgcagacacggccaagtatttcgngtgacgagacgaccccggagttacgcgacgccgtgggacggctacgtggtacttcgagtcggccgtggggacccgtgggccgtccgtggtacc

SEQ ID NO: 85811 - DNA, 551 bp, Homo sapiens
  misc_feature: GYAE6OF01BILBF.21.45.E01.1.454.CMB.1.raw
  modified_base (405)..(405): a, c, t, g, unknown or other
  misc_feature (405)..(405): n is a, c, g, or t
  modified_base (423)..(423): a, c, t, g, unknown or other
  misc_feature (423)..(423): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggatccaccgtcacagatggttccttcgtggggctgggtccggcacgtccccagagaagggtctggagtggattgggagtgtctagtaagtacgggggagtcaatatcggtggtgacactccctactacaacccgttctttaagagtcgagtcactatatcagtgcgctcgtccacgaaccnggtctccctgagatgagntcgtgtgaccggcgcgagacaccggaccaagttatttcgtggtcgcgaggacgacccggagtacgcgacgccgtggacgcgacgtggtaccttgacgtcgccgtggggcctgggcccgcccgtggtcc

SEQ ID NO: 85812 - DNA, 546 bp, Homo sapiens
  misc_feature: GYAE6OF01ARO47.21.45.E01.1.454.CMB.1.raw
  modified_base (360)..(360): a, c, t, g, unknown or other
  misc_feature (360)..(360): n is a, c, g, or t
  modified_base (368)..(368): a, c, t, g, unknown or other
  misc_feature (368)..(368): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcggcccaggactggtgaagccctcggagaccctgtccctcatttgcactgtgtctggatccaccgtcacagatggttccttcgtggggctgggtccggcagtccccagagaagggtctggagtggagttgggagtgtctagtaagtacggggagtcaatatcggtggtgacactccctactaccaacccgttnttttaagngtacgagtcactatatcagtgcgctcgtccacgaccaggtctacccgtgacgatgagtatctggtcgacggccgacagacacggccaagttactttctaggtgcgagacgacccggagttacgcgacgctggacgctacgtggtactcgatgccgtgggccgtggccgtccgtggtcc

SEQ ID NO: 85813 - DNA, 571 bp, Homo sapiens
  misc_feature: GYAE6OF01CX14N.21.45.E01.1.454.CMB.1.raw
  modified_base (466)..(466): a, c, t, g, unknown or other
  misc_feature (466)..(466): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggatccaccgtcacagatggttccttcgtgggggctgggtccggcagtccccagagaagggtctggagtggattgggagtgtctataagtacggggagtcaatatcgtggtgacactccctactaccaacccgttctttaagagtcgagtcactatatcagtgcgctcgtccacgaaccaggtcctcccgtgacggatgagatcgtgtcgacggccgcacgaccacggccaagttactttcgnggtcgcgtagacggaccccggtagttacgcggtacgccgtgggacggccgtacgtggttaccttcggacgtcggccgtggggcccgtagggccgtccgtgggtcc

SEQ ID NO: 85814 - DNA, 583 bp, Homo sapiens
  misc_feature: GYAE6OF01CX18L.21.45.E01.1.454.CMB.1.raw
  modified_base (424)..(424): a, c, t, g, unknown or other
  misc_feature (424)..(424): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggatccaccgtcacagatggttccttcgtggggctgggtccggcagtccccagagaagggtctggagtggagttggggagtggtctagtaatacgggggagtcgaatagtcggtggtgactacctccctaactaccaacccgttcttttaagagtcgagtcactaatatcagtcgcgctcgtccacgaccaggtcctcccngagatgagatcgtgtcgacggccgacgagaccgacggacctaagtactttcgtgtcgcgagacgaccccggagttagccggtaccgccgtgggaggccgacgtagggttacttcgacgttcggccgtcgggggccgtgggcccgtcccgttggtacccg

SEQ ID NO: 85815 - DNA, 748 bp, Homo sapiens
  misc_feature: GYAE6OF01B8L19.21.45.E01.1.454.CMB.1.raw
  modified_base (258)..(258): a, c, t, g, unknown or other
  misc_feature (258)..(258): n is a, c, g, or t
  modified_base (346)..(346): a, c, t, g, unknown or other
  misc_feature (346)..(346): n is a, c, g, or t
tcagtcgtcgctcgcacgaccggtgctcgatttagtgagtcagtaagggaaaggggctttcagagagtcatggacctcctgtgcaagaacatgagcacctgtggtttttcctcctgctggtggcagctcccagatgggtcctgtcccaggtccacctgcaggagtcgggcccaggactggtgaacgcccgtcggacgacccctgtcccctcatttgctactgtgtctggactccaccgtcacagattcggttccttgnggggtctgggtccgcgacgtcccaggagaaggtctggagtggattgggatggtactagtaagtacgggatacaagtagtcgtaggtanacgaccttacccgtaactaaccgtaacccgtttacttttaaagacgtacgtaagtaccaacttaatactctaagtcgaccgctcgtaccaaccgtaacccgaggttccctacccgtaggaaggtactggtaacgtacgttcgtaggtcgaacccggtcccggacaacggaacccgtaccgggtaaccgtaaagtttacgttttaccgtggttacggacccggtaaagggacccggtaaacccccggggttagttaaccgggcccggtaacccggtacccgttagggggaaccggtaccgtaaccggtttacgggttacccgttaccgggtaacgttccgggaccccgggttacgggggtccccggttcgggggaccccgttcccccgggttaggttccccgg

SEQ ID NO: 85816 - DNA, 593 bp, Homo sapiens
  misc_feature: GYAE6OF01CWJMM.21.45.E01.1.454.CMB.1.raw
  modified_base (395)..(395): a, c, t, g, unknown or other
  misc_feature (395)..(395): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggatccaccgtcacagtatcggttcctcgtggggctgggtccggcagtccccagagaaggtctggagtggatgggagtgtctagtaagtacggggagtcaaatagtcgtggtacgactactccctaactaccaacccgttcttttaagagtcgagtcactatatcagtcgcnctcgtccaacgaaccaggtacctccgtgagatgagtatcgtgtcgacggccgcgagaccgacggccaagttattcgtgtcgcgagacgaccccggtagttacgaccggaccgccgtgggacggacgtacggttaggttacgttcggaacgtcggacccggtcgggggtacccgtgggacccgtcccgtcgggtacccg

SEQ ID NO: 85817 - DNA, 545 bp, Homo sapiens
  misc_feature: GYAE6OF01BN01X.21.45.E01.1.454.CMB.1.raw
  modified_base (458)..(458): a, c, t, g, unknown or other
  misc_feature (458)..(458): n is a, c, g, or t
  modified_base (465)..(465): a, c, t, g, unknown or other
  misc_feature (465)..(465): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggatccaccgtcacagatggttcctcgtggggctgggtccgcagtcccagagagggtctggagtggagttgggagtgtctagtaagtacgggggagtacgaatagtcggtggtgactactcccgtactaccgtaacccgttcttttaagacgtcgagtcactatatcagtcgcgctcgtccacgaaccaggtctccctgagatgagatctggtcgacggcgcagacacgcaagtnttcgtgngcgagacgacccggtagtacgcgacgccgtggacgcacgtgtacgtcgatcggccgtgggccgtggccgtccgtggtccg

SEQ ID NO: 85818 - DNA, 754 bp, Homo sapiens
  misc_feature: GYAE6OF01CZ65E.21.45.E01.1.454.CMB.1.raw
  modified_base (164)..(164): a, c, t, g, unknown or other
  misc_feature (164)..(164): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctccagatgggtcctgtcccaggtccacctgcaggngtcgggcccaggactggtgaagcccctcggacgaccctgtccctctatttgcctactgtgtcgttggactcccacgtcaacagacttcggttccttcgtgggggcttcggggttcccgcaaggtccccgagaggaagggtctgggagtgggattggggagtgtactagtaagtacggggatcaatagtgtggtgacctactcccgtaactaccgaaccgttactttaagagtacggtatcgtactatatcgaagttgcgtctcggtccaacgaaccctacgggtcctacccgtaggaacgtagtaggtaagtacgtcgttagggtacgaaccggtcccgaacgtacgaacccggtaccggaacccgtaaagttaacgtttttcgtacgggtttacggtaccgggaaacggtacccgggtaaccccggttacggggtttaccggaccgggtaacccggtaccccgggtaggggtaaccggaaccgttaccgggttagggtttaacccgtttcgggaaccgtttcgggtacccgggttccggggggggtaccttccgggggtccccggtcccggttccgggtttaaccccgg

SEQ ID NO: 85819 - DNA, 803 bp, Homo sapiens
  misc_feature: GYAE6OF01D5JRD.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtccgggcccagggactgggtgaacgccctcggacgaccctgtccctcatttgcactgtgtctggactccaccgtcacagatcggttccttgtggggctgggtccgcacgtcccagaggaggtctggagtggagttgggagttgtactagtaaggtacggggagtactaagttagtcggtggtacgtaacctaccttaccccgtaaacttaacccgtaaaccccgtttacgttttaaacggacgttaccggtaacgttacctaaccttaagttaactacgtaaggttcggaccgtccttaccggtacccaaccggtaaacccgtacgggttacccttaccccgtagggtaacgggtaattacggaacgtacgttacgtacgggtacgggaacccgggtcccgacgtaaaccggaacccgtaacccgggtaaccttaaaacggtttcttttaccgtacggttaccggacgggtaaccggtaaccgggtaacccccgggtaaggttaccggaccggtaaccggccggttacgggaaccgggtaccgtaccggttacgggttacccgttcggacgttaccgggtccccgggttacggggggtcccgttaccggggacccggttccccggttgggttacccg

SEQ ID NO: 85820 - DNA, 763 bp, Homo sapiens
  misc_feature: GYAE6OF01BVSOE.21.45.E01.1.454.CMB.1.raw
  modified_base (114)..(114): a, c, t, g, unknown or other
  misc_feature (114)..(114): n is a, c, g, or t
  modified_base (226)..(226): a, c, t, g, unknown or other
  misc_feature (226)..(226): n is a, c, g, or t
  modified_base (249)..(249): a, c, t, g, unknown or other
  misc_feature (249)..(249): n is a, c, g, or t
tcagtcgtcgctcgcacgaccggtgctcgatttagtgagtcagtaagggaaagggggctttcagagagtcatggacctcctgtgcaagaacatgaggcacctgtggtttttccnctgctggtgcagctccagatgggtcctgtcccaggtccacctgcagggagtcgggcccaggactgggtacgaacgccctcgggaacgccctggtccctcatttcgccatgtntctggactcccacgtcacgagtnttcggttccttcgtgggggcttcgggtccggctacgtcccgaggaggaagggtctgggaaggtgggtagttggggagttggtactaagtaaggttaccggggatacaagttaatccggtggtagaccgtacctaccctaataacctaacccggttacttttaaacggagtacggaacgtaccaacttaacttacgtacaagttcgtccgcgttacgtaccctaacggaaacctcgggtcccttacccgaggtaacgggtattaccggaagtacgttccgttagggtacggaccgggtcccgacgaacggacccgaaccggtacccgtaaacgtttcgttttacgtaggttcggaaccgggacgtaaacccgggtaccccgggtaacggtttacggaccccggacggttaccccgtggggaaccggtccgtaaccggttagggttaaacccgttcggacgttaccggccggttcggggggccccggtagggcccgtccccggttgggtaacccgg

SEQ ID NO: 85821 - DNA, 544 bp, Homo sapiens
  misc_feature: GYAE6OF01BJJHU.21.45.E01.1.454.CMB.1.raw
  modified_base (356)..(356): a, c, t, g, unknown or other
  misc_feature (356)..(356): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggatccacgtcacagatggttccttcgtggggctgggtccgcagtccccagagaagggtctggagtggattgggagtgtctagtaagtacgggggatcaagtatcggtggtgacactcctactacaacccgtntttaagagtcgagtcatatatcagtgcgctcgtccacgaaccaggtctccctgacgatgagatcgtgtgacggccgacagaccacggacctaagttcttctaggtcgacgtagacgacccggagtacgacgacgcgtggacgcacgtggtacttcgatcgccgtggggccgtggccgccgtggtcccg

SEQ ID NO: 85822 - DNA, 598 bp, Homo sapiens
  misc_feature: GYAE6OF01BXRF0.21.45.E01.1.454.CMB.1.raw
  modified_base (195)..(195): a, c, t, g, unknown or other
  misc_feature (195)..(195): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctgganaccctgtccctcatttgcactgtgtctggatccaccgtcacagattggttccttcgtggggctgggtccggcacgtcccagagaagggtctggagtggagttgggagtgtctagtaagtacggggatcaatagtcgtggtagacacgtccctaactaacctaacccgttactttaagacgtcgagtcactatatcagtgcgctcgtaccacgaacctaggtcctccgtagaggatgagtatcgtggtacgacggccgacacgaccgacggacctaagttactttcgtaggtcggacgtaggaccggaccccgggtagttacgccggaccggtccgtagggacggctaacgtggtaccttcggacgtcggccggttcgggggccgtgggcccgtccgtgggtcc

SEQ ID NO: 85823 - DNA, 604 bp, Homo sapiens
  misc_feature: GYAE6OF01CCW95.21.45.E01.1.454.CMB.1.raw
  modified_base (240)..(240): a, c, t, g, unknown or other
  misc_feature (240)..(240): n is a, c, g, or t
  modified_base (252)..(252): a, c, t, g, unknown or other
  misc_feature (252)..(252): n is a, c, g, or t
  modified_base (333)..(333): a, c, t, g, unknown or other
  misc_feature (333)..(333): n is a, c, g, or t
  modified_base (413)..(413): a, c, t, g, unknown or other
  misc_feature (413)..(413): n is a, c, g, or t
  modified_base (435)..(435): a, c, t, g, unknown or other
  misc_feature (435)..(435): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctccagatgggtcctgtcccaggtccacctgcaggagtccgggcccaggactggtgaagccctcggacgaccctgtcccctcatttgcactgtgtctggatccaccgtcacngatcgttcctgnggggctgggtccgcagtccccagaggaaggtctggagtggattgggagtgtctagtaagtacgggatcaagtatcgtggtnacactccctaactaccaaccgtctttaagagtctaagtcactatatcagtgcgctcgtccacgactaggtcctccagagntagagtatctgcgtaccggccncagtaccgacgacctaagttatttcgtggtacgccggtaacgggacccggtaccggttagtaccggaccggaccgttaccgggaggaccgtaccgtacggttaccggttactcggtcgtaccggtccggggcccgggtacggccgggtccccgtcgggttcgtacccgg

SEQ ID NO: 85824 - DNA, 867 bp, Homo sapiens
  misc_feature: GYAE6OF01CJFKC.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggtttttcctcctgctggtggcagctccagatgggtcctgtccaggtccacctgcaggagtcggccaggactggtgaagccctcggacgaccctgtccctcatttcgctactgtgtctggatccaccgtcacagtattcggttccttggtgggggctcgggtccggcacgtcccgaggacgaagggtctaggagtggagtgggagtgtacgtaagtaaggtacggggagtacaagttagtcggtaggtacgtaacacctaccctaacttaaccgaaccgtttacgttttaaacgacgttacgtaacgttacctaacttaagttactacgtaaggtcgtaccggtccttacccggttaacccaaacccggtaaacccgtaacggtttacccctaccccgtaagggtaacgggtaacgttacggtaaacggtacgtttacgtacggttacgggaaccgggtacccggaccgtaacggaacccggtaaaccgggtaacccgttaaaggttttacgttttaccggtagggttaccggaaccggggttaacggaacccggggttaacccccggggttaaggtttaaccgggaacccgggtaacccgggtacccgggtacgggggtaacccggtaccggttaaaccgggtttacggggttaaccccgttttacgggtaaccgggttccggggtaccccgggttaccggggggggtaccccgggttaccggggtcccccgggttaccccgggttacggggtttaacccgg

SEQ ID NO: 85825 - DNA, 740 bp, Homo sapiens
  misc_feature: GYAE6OF01AN5VU.21.45.E01.1.454.CMB.1.raw
tcagtcgtcgctcgcacgaccggtgctcgatttagtgagtcagtaaggaaagggggacgtttcgagagagtcatggacctcctgtgcaagaacatgaggcacctgtggtttttccttcctgtctggtggcagctcccagatgggtcctgtcccaggtccactgcagagtcggcccaggctggtgaacgccctcggacaccctgtccctcatttcgctactgtgtctaggactccgacgtcactgactcggttccttcggtcggggtctcgggttaccggcgtacgtccccgtaggacggtaacgggttcgtgggtacgtgggtaagttggggtaagtcggtacgttacgtaacgtacggggtagtacaagttagtccgggttagtcggtacctactaccccttaacgtacctaacccggtttacttttaaacgaggtttacgaacggttacctactttaagtactcgaaggtttcgccgtccgttcgaccgtaaccgtaaccgtacgtccgtacccgtcgtaacggtacgtagtaacgtacgtaggttcgacggttaaccggccggtaacacccggtaacggtaccgaccgtaagttacgttcgttacgtcggacgtacgaccggtaccgacggttacgaccggtcgacggtcgacggcgtaccgttaggtaccgttccggtacgtcgggtaacccgtcggggaccggttacgggcccggtaacccgttcgggtaacccg

SEQ ID NO: 85826 - DNA, 641 bp, Homo sapiens
  misc_feature: GYAE6OF01BWDQF.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggtttttcctcctgctggtggtagctcccagatgggtcctgtcccaggtccacctgcaggagtcgggcccaggactggtgaagccctcggagaccctgtccctcatttgcactgtgtctggatccaccgtcacagattggttccttcgtggggctggggtccgcagtccccagagaagggtctggagtggattgggagtgtctataagtacggggagtcaagtatcggtggtgacactccctactaccaacccgttctttaagagtcgagtcactatatcagtcgcgtctcgtaccacggaacctacgggtcctcccgtggacggtatgagtatcgtgtcggacggccgacacggtacaccggacctaagttctttcgtggtagccggtaacgggtaccggaaccccgggtaagttacggccggtaccggtccgtagggacggaccgtaccggttcgggttaccttacggacgttcgggtaccccggttggggggccccgttacggggcccgtcccccggttggggtcccttaccgg

SEQ ID NO: 85827 - DNA, 557 bp, Homo sapiens
  misc_feature: GYAE6OF01ELZYI.21.45.E01.1.454.CMB.1.raw
  modified_base (359)..(359): a, c, t, g, unknown or other
  misc_feature (359)..(359): n is a, c, g, or t
  modified_base (366)..(366): a, c, t, g, unknown or other
  misc_feature (366)..(366): n is a, c, g, or t
  modified_base (404)..(404): a, c, t, g, unknown or other
  misc_feature (404)..(404): n is a, c, g, or t
  modified_base (441)..(441): a, c, t, g, unknown or other
  misc_feature (441)..(441): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcggcccaggactggtgaagccctcggagaccctgtccctcatttgcactgtgtctggatccaccgtcacagatcggttccttcgtggggctgggtccgcacgtccccgagagaagggtctggagtggattgggagtgtctagtaagtacggggatcaatagtcgtggtgacactccctactacaacccgttntttaagngtcgagtcaactatatcagtgcgctcgtaccacgaccngtcctccgtagaggatgagtatcgtgtcgaccggccncgacgaccacggacctaagttactttcgtgtggcgagacggacccgagttacgcgacgccgtggacgtcgacttggtactcgatcgccggtggggcccgtggccgtccgtggtacc

SEQ ID NO: 85828 - DNA, 884 bp, Homo sapiens
  misc_feature: GYAE6OF01DJ4F3.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagagtcgggtcctgtcccaggtccacctgcgaggacggtccgggcccaggacgtggtacgaacgcccgtcggacgaccctcgtccctctactttgctactgtgtcgtggactcccaccgtcacgagtacgttcggttccttcggtggggcgttcggggtccggaccgtaccggtaccccgaagggaacgggtaacgggttcgtaggggaggttagggtagttcggggtagttaggttacgtaaaggttaacggtaacgggggtagttaacgtaagttaggtacggttgggtacgaacctaccgttaccccgtaaacgttaaccctaacccgtttacgttttaaacggacggttaccgaacgttactaacgtaagttacgtaccgtaggttcgaccgtccgttacccggttaccgaaccggtaacccgtacggttaccccttacccggtagggaacggtacgttacggtaaacgtcgttaccggtagggaccgggtaccggggacccgaaccgaacccggtaaccggacccgggtaaccttaaaggtttaccgttttccggacggttcggaaccggtaacggaacccgggtaccccggttaagggttacccgaccgggtacccgtaccggttacggggaacgtaccgttaccgggtttaccgggtacccgtttggtaacccggttccgggtacccggggttcggggggtccccggttccggggtcccccgttcccgggttaggtacccccgg

SEQ ID NO: 85829 - DNA, 594 bp, Homo sapiens
  misc_feature: GYAE6OF01DVWLJ.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaacgccctcggagaccctgtccctcatttgcactgtgtctggactccaccgtcacagatcggttcctcgtggggctgggtccggcagtccccagagaaggtctggagtggagttgggagtgtctagtaagtacgggggatcgaatagtcgtggtgacactccctaactacaaccgttctttaagagtcgagtcactatatcagtcgcgtctcgtaccacgaaccaggtcctcccgtaggacggatacggagactcgtgtacggaccggccgacacgaccgacggactaagttacttccgtagtcgacggtacgaccggtacccggtagttacggcgacggccgtagggacgtcgtacgtcggttactcgagtcgaccggtcggggtacccgtgggcccgtccgtggtccg

SEQ ID NO: 85830 - DNA, 762 bp, Homo sapiens
  misc_feature: GYAE6OF01C48P1.21.45.E01.1.454.CMB.1.raw
  modified_base (457)..(457): a, c, t, g, unknown or other
  misc_feature (457)..(457): n is a, c, g, or t
tcagtcgtcgctcgcacgaccggtgctcgatttagtgagtcagtaagggaaagggggtctttcagagagtcattggacctcctgtgtacaagaacatgaggcacctgtggtttttcctccgtgctgggtggctaggtctcccgagaggtcgggtcctgtcccaggtccacctgcaggagtcgggccaggtactggtgaagccctggacaccctgtccctcagtttcgccacgtgtgtcgtagggactccgaccgtcgaccagtattcggttaccttggtgggggtcgtcgggtccggcacgtcccgaggtacggaacggtcgtggtacggtgggtagttgggagtgtccgtaagtaaaggtacgggaacgtactaagtagtcggtcggtacgtaactacctccctaacgtaaccaaccgttacgtttaacgagtacgtacgtacaacgttagtaacncgtaagtcggacgtccgttacgttaccacggaaccgtacggttccgtacccgtaggtaacggagtacgtacgtaacttcggtaggttcggtaaccgggtccgtacgacggaaccggaccggtaaccgtaagtttacgttcgtacggtacggtccgtaacgtaccgggtaaccccggtaggtaccgaccggtaacccggtccgtacgggaccggtacccgtaccgggttcggttaacccgttccggtacgttccggtcccgggtacgggggtccctaccgggtcccgtaccccggttggtaacccg

SEQ ID NO: 85831 - DNA, 601 bp, Homo sapiens
  misc_feature: GYAE6OF01C8YDN.21.45.E01.1.454.CMB.1.raw
  modified_base (234)..(234): a, c, t, g, unknown or other
  misc_feature (234)..(234): n is a, c, g, or t
  modified_base (483)..(483): a, c, t, g, unknown or other
  misc_feature (483)..(483): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctccagatgggtcctgtcccaggtccacctgcaggagtcgggcccaggactggtgaagccctggacgaccctgtccctcatttgcactgtgtctggatccaccgtnacagatggttccttcgtggggctgggtccggcacgtccccagagaagggtctggagtggattggggagtgtactagtaacgtacggggagtacaagtagtcgtggtagacacgtcccctactacctaacccgttctttaaagagtacgagtacactaatatcagttcgcgtctccgtaccacgaaccaggtcctccctgaaggatagagatcgtgtcgacggccgcaagacacggccaagtactttcgngtgcgtagacgacccggtaagttacgccgacgccgtagggacgaccgtagtggtaccttcggacgtccggtacccggtcgggggcccgtaggggccccgtcccggttcgggttacccg

SEQ ID NO: 85832 - DNA, 547 bp, Homo sapiens
  misc_feature: GYAE6OF01AH55U.21.45.E01.1.454.CMB.1.raw
  modified_base (355)..(355): a, c, t, g, unknown or other
  misc_feature (355)..(355): n is a, c, g, or t
  modified_base (362)..(362): a, c, t, g, unknown or other
  misc_feature (362)..(362): n is a, c, g, or t
  modified_base (431)..(431): a, c, t, g, unknown or other
  misc_feature (431)..(431): n is a, c, g, or t
  modified_base (447)..(447): a, c, t, g, unknown or other
  misc_feature (447)..(447): n is a, c, g, or t
  modified_base (451)..(451): a, c, t, g, unknown or other
  misc_feature (451)..(451): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggatccaccgtcacagatggttccttcgtggggctgggtccgcagtccccagagaagggtctggagtggattgggagtgtctagtaagtacggggagtcaatatcgtggtgacactcctactacacccgttntttaagngtcgagtcactatatcagtgcgtctcgtccacgaccaggtcctccgtgagatgagatctgtgacgccgnacgacacggctaagtnttcngtcgcgagacggacccggtagtacgcgacgccgtgggacgcgtacgtggtacttcgacgtcggccgtggggtcccgtgggcccgtcccgtggtccg

SEQ ID NO: 85833 - DNA, 684 bp, Homo sapiens
  misc_feature: GYAE6OF01BVSBT.21.45.E01.1.454.CMB.1.raw
  modified_base (211)..(211): a, c, t, g, unknown or other
  misc_feature (211)..(211): n is a, c, g, or t
  modified_base (395)..(395): a, c, t, g, unknown or other
  misc_feature (395)..(395): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcagggagtcgggcccaggactggtgaagcccctggacgacccctgtccctntatttgcactgtgtctggactcccaccgtcacagattcggttccttggtgggggcgttcggggtccggcacgtccccgaggaggtaagggtctgggagtggagttggggagtgtactagtaagtacggggatacaatagtcggtggtcgacactccctaactacctaacccgttatttaaacgngtcgtagtacactatactcagtcgccgtctacgtcccaaccggaaccgtacggtccttccccgtaggacggtagtaggagtacttacgttcggtacggtacccgggcccgacgtacggaacccgaacggtacctaaagtttacgtttcgtaggtcggaccggaacggtaccggtaccccgggttagttaccggccgtaccggccgtagggacggtacgaccgttaggtaccgttcggacgtccggtaccgggtcggggtaccgggtcgggcccgtccggtccggtaccg

SEQ ID NO: 85834 - DNA, 772 bp, Homo sapiens
  misc_feature: GYAE6OF01C5DRC.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtccgggcccaggactggtgaacgccctcggacgaccctgtcccctcatttgcactgtcgtctggactcccaccgtcacagtactcggttccttcgtgggggtcgttgggtcccggctacggtccccgaggaaggaagggtcgtggagtggagttgggagtgtactaagtaaggtacggggagtcaagttagtcggtggtacgactaccttaccctaactaacccgtaacccgtttacttttaaacggacgttacgtaacgtacctaacttaactactacgtagtcgtacgtcctccgtacccaaccgtaaccctacgggttccctcccgtacggacggtattcggaacgtagttaccgttacggtcgggaccggtcccgacgacgaccgaaccggaacctaaggtttactttcgtacggtacggtaccggtaacggaacccgggtaaccccggttaggttaccggaccggacccggtacccgggtaggggtaccggtccccgtaaccggttacgggttaacccgtttcggtaaccggttccggtacccggggttccgggggtaccccgggttccgggcccccggttccccgggttgggttaccccg

SEQ ID NO: 85835 - DNA, 980 bp, Homo sapiens
  misc_feature: GYAE6OF01BS368.21.45.E01.1.454.CMB.1.raw
tcagtcgtcgctcgcacgaccggtgctcgatttagtgagtcagtaagggaaagggggctttcagagagtcatggacctccgtgtgcaagaacatgaggcacctgtggttttcctcctgctggtggcagctccagagtgggtcctgtcccgaggtcccaccttgcgaggagtcgggtacccaggactggtagaacgcccgtacggacgaccctcgtccctctagtttcggccgtacgtgtcgtcgtagggaccgtccctaccgtcaacgtacgtacgtttcggttcccgttcggtcgggggtccgttcggggtcccggaccgtaccggttacccccgtaaggaacgggtaaacgggttccgtaggggtacggttagggtacggtttcggggtaggttcggttaccgtaaaggttaaacgggttaccgggggtaacggttacggtaaaggtacggttacgggtacgggttacggtaaaccgtaacccgttacccccgttaaacctaaacccgttaaacccggttttaaccgtttttaaacgggaacggtttaccggtaaacggttaaccttaaaccgtttaacgttaaccgtaccggtaacggttaccggtcccggttaccgttaccccggttaaccccgtaaacccggtaaacccggttaccggttaccccttaccccggtaacggaacgggtaacttacggtaaacgtacgttaccggttacgggtaccggtaacccgggtacccggtaaccgaaacggtaacccgaaccgggttaacccgtaaacgtttacgtttacggtacgttaccgggaaccgggtaaacgtacccggggtaacccggttaggttaccggaccggtaaaccggtccggtaacggggaacgtccgtaaacggtttcgggtaaccgtttcgggtaaccgttcgggaccggggttcgggtcccgggttacgggtcccggttcccggtcggggttacccg

SEQ ID NO: 85836 - DNA, 677 bp, Homo sapiens
  misc_feature: GYAE6OF01CQA3S.21.45.E01.1.454.CMB.1.raw
  modified_base (285)..(285): a, c, t, g, unknown or other
  misc_feature (285)..(285): n is a, c, g, or t
  modified_base (393)..(393): a, c, t, g, unknown or other
  misc_feature (393)..(393): n is a, c, g, or t
  modified_base (410)..(410): a, c, t, g, unknown or other
  misc_feature (410)..(410): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtccggcccaggactggtgaagccctcggagaccctgtccctcatttgcactgtgtctggatccaccgtcacagattggttcctcgtggggctgggtccgcagtccccagaggaaggtcnggacgtggagttgggagtgtctaagtaagtcggggagtacaatagtcgtggtgaactctaccctactaccaaccgttctttaagacgtcgacgtctactatatcagtncgctcgtccacgaaccngtcctccgtgagatgacgatacgtggtacgaccggtcgaccgaggaacccgacggtaccctaagtttacgttttctacgggttacgtaccggaggtaaccggacccccgggtaagggtttacggacccggtacccggtccgtacggggtaacgggtacccgtaacgggttacggggtttaaacccgttccgggtaacgttccgggtcccggttacgggggggtccccgtacgggggccccgtcccccgggttcggggttaacccccg

SEQ ID NO: 85837 - DNA, 612 bp, Homo sapiens
  misc_feature: GYAE6OF01DB06I.21.45.E01.1.454.CMB.1.raw
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
  modified_base (283)..(283): a, c, t, g, unknown or other
  misc_feature (283)..(283): n is a, c, g, or t
  modified_base (398)..(398): a, c, t, g, unknown or other
  misc_feature (398)..(398): n is a, c, g, or t
tcagtcgtcgctcgcacgaccggtgctcgatttagtgagtcagtaagggaaaggggctttcagagagtcatggacctcctgtgcaagaacatgaggcacctgtggtttttcctcctgctggtggcagcctccagatgggtcctgtcccaggtccacctgcaggagtcgggccaggactggtgaacgccctggagaccctgtccctcattgctactgtntctggatccaccgtnacagtatcggttcctcgtggggctgggtccgcacgtccgagagaaggtcnggagtggtagtgggagtgtcgtagtaagtacgggatacaatatcggtagtacgactactccctataacctaaccgttctttaaggagtacgtagtcaacgtatagtcagttcgcncgtccgaccacgaacctggtcctccgagagtatcgaagtctcgtagtaccggaccggtaccacgtaacgacgacccgacgtaagtacttttccgaggtcgtacggaacgaccggtacccggttaagtacgccggaacgtccgtaggggacacgtacgttaggtaactcggtactcggccggttcggggccgttaggcccggtcccgtggtaccg

SEQ ID NO: 85838 - DNA, 770 bp, Homo sapiens
  misc_feature: GYAE6OF01DEBCH.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggttttcctcctgctggtggcagctcccagagtgggtcctgtcccaggtccacctgcaggacgtcggcccaggactggtgaacgcccgtcggacgaccctcgtccctcactttcgctactgtgtctggactcccaccgtcacagtacttcggttccttcggtgggggcgttcggggtcccggcgtaccggtccccgaaggtacggtaacgggtcgtagggaggtggtagttgggagttgtactaagtaacggtacgggatactaagtagttcggtggtacgacctaccgtccctaactaacccgttaacccgtttacgtttaaacggacgttacgtacgttactaacgttataactacgtaacgtcgccggtacctacccgtacccgtaaccgtaaacccgtcggttacccttaccgtaggacggtactacggtaacgtaaccgttcgtcgggtaccggacccgggtccgacgaacgacccggaacggtaccttaagttcgtttcgtaggtccggaacgtacggtaacccgggtacccggttaaggttaccggaccggaccgtccggtagggaccggtaccgtacgttaccgggttaacttcggaacggtttccgggacccggggttcggggcccggttacgggccccgttccggtggttaccccg

SEQ ID NO: 85839 - DNA, 693 bp, Homo sapiens
  misc_feature: GYAE6OF01DKKN3.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcgggagaccctgtccctcatttcgcactgtgtctggactccacgtcaacagtattcggttccttcgtgggggctgggtccggcacgtcccaggagaagggtctggagtggagtgggagtgtacgtaagtaagtacggggagtacaatagtcgtggtagacctacctccctactaaccctaacccgttacttttaaacggacgttacgtaacgtctaacttaatactcgtaagtcgtacgctccgtaccaacgtaacctacggtaccctccgtagacggtacgtagagtactcgtggtacgacggccgacgtacgaaccgacggacctaaggttactttcgtacggtcggacggtaacggtaccggaaccccgggttaaggttaccggaccggtaaccgggtcccggtagggtacgggacccgttacgggttacggttaaccgttcggtacgtccggtacccgggtcgggggtcccggtaggggcccgtcccggtcggtcccg

SEQ ID NO: 85840 - DNA, 740 bp, Homo sapiens
  misc_feature: GYAE6OF01C0F9F.21.45.E01.1.454.CMB.1.raw
  modified_base (164)..(164): a, c, t, g, unknown or other
  misc_feature (164)..(164): n is a, c, g, or t
  modified_base (250)..(250): a, c, t, g, unknown or other
  misc_feature (250)..(250): n is a, c, g, or t
  modified_base (522)..(522): a, c, t, g, unknown or other
  misc_feature (522)..(522): n is a, c, g, or t
  modified_base (543)..(543): a, c, t, g, unknown or other
  misc_feature (543)..(543): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctccagatgggtcctgtcccaggtccacctgcaggngtcggcccaggactggtgaacgccctggacgaccctcgtccctcgtattcgactactgtgtctggactccgaccgtcacgtaagtnttcggttccttcggtgggggtccgtcggggtcccgacgtacggtccccgaaggacggaacgggttcgtggaggtggtagtgggagttcgtactaagtaaaggtacgggtatactaagtagtcgtggtagacctacctccctaacgtaacctaacccgttacgtttaagacgtacgtacgtacgtaacttaagtactacgtagtacgtccgtacgtaccggtacctaaccgaacctacggtccttaccgaggacggtactaggtactacgttntacggtacgaccgggacccgngtaaccggacccgtacggtaacctaaggtttaactttcgtacgggtaccggtaacgaacgggtaacccggtacccgggttaacgttacggccggtaaccgtccggtagggacggtaccgtaacgggttacggttaccttcgggtacgttcgggacccgggttcggggcccggtagggccccgtccggtcggtacccg

SEQ ID NO: 85841 - DNA, 716 bp, Homo sapiens
  misc_feature: GYAE6OF01DNVTY.21.45.E01.1.454.CMB.1.raw
  modified_base (242)..(242): a, c, t, g, unknown or other
  misc_feature (242)..(242): n is a, c, g, or t
tcagtcgtcgctcgcacgaccggtgctcgatttagtgagtcagtaagggaaaggggctttcagagagtcatggacctcctgtgcaagaacatgaggcacctgtggtttttcctcctgctggtggcagctccagatggtcctgtcccaggtccacctgcaggagtcgggcccaggactggtagaacgccctcggacgaccctgtccctcatttcgctactgtgtctggactccacgtcaacgngtagttcggttcctcgtggggctcgggtccgacacgtcccgagagaggtctggagtggagtgggagtgtactagtaagtacgggatacgtaagtagtcggtaggtacacgaccttacccgttaactaacccgtaacccgtttacgttttaaaacggacgtacgtaacgtacctaactaataactcgtacgttacgaccgtctaccgggtacccaacggaacccgtacgggtccttaccccgtagaacggtataggtaacgtatacgttggtacgggaaccggacccggtacgaaccgaaccgtaccgggtaacctaagggtttactttaccgtaggtacggtaccggtaaggtaaccggaccccgggttaagttacggaccggaccgtacggtagggacggtaccgtacggttaggttaccttcgggattccgggacccgtagggggtcccacgggcccgtcccgtggtacccg

SEQ ID NO: 85842 - DNA, 770 bp, Homo sapiens
  misc_feature: GYAE6OF01AN88P.21.45.E01.1.454.CMB.1.raw
  modified_base (127)..(127): a, c, t, g, unknown or other
  misc_feature (127)..(127): n is a, c, g, or t
tcagtcgtcgctcgcacgaccggtgctcgatttagtgagtcagtaagggaaagggggacgtttcgagagagtcatggactcctgtgcaagaacatgaggcacctgtggttttcctctgtctggtgcngctccagatgggtctgtcccaggtccacctgcaggacgtcgggcccaggacgtggtgaacgccctcggacgaccctgtccctcagtttcgactactggtgtcgtggactccaccgtcacgtagagtcggttccttcgtggggccgttgggtccggtcgaacgttccccgaaggacggtaacgggtccgtagggtcggtggtacggttaggggagttcggttacgttaagtaaacggtacgggggacgttacgtaagtaacgtcggtaggttcgactacgtccctaacgtaccaacccgttacgtttaaacgcggtacgtacgtactaactactactcgaacgttcgcgtaccgtaccgtaccgaaccggtaaccgtacgggtcccttccccgtaggtaggaccttggtaacgtcgtcgtttacggcgggtaacggccgtcgaacgaccggtacccggaccgttaaaacggttcgttttacgacgggttcgacccggttaaaggaccccggggtaacccgttaacgggttacgacccggtaaccggccggttagggaccgggtactaccgggtgtttaccccggtaagtccgtcgttaccggggcggggtaccccggtgggtccccggcccggttggtccccgg

SEQ ID NO: 85843 - DNA, 755 bp, Homo sapiens
  misc_feature: GYAE6OF01C144W.21.45.E01.1.454.CMB.1.raw
  modified_base (209)..(209): a, c, t, g, unknown or other
  misc_feature (209)..(209): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactgggtgaagccctggagaccctgtcccctnatttcgcactgtgtctggactccaccgtcacagtatcggttcctcgtggggctcgggtccgcgacgtcccgaggacgaaggtctggagtggagttgggagttgtacgtaagtaagtacggggtatacgaagtacgtcgtggtacgactacctccctaacttaccgtaaccgttacttttaagacgtacgtaagtaccgtactaacgtactacgtagtcgacgtccgtacgtacccaaccggtaacccgtacggttcccttacccgtagggtaacggtacgtaggaaacgtacgttaccgttggttacgggacccgggacccgtaccgaccggaaccggtaacccggtaaccctaaaggtttctttaccggtggtacggtaccggaaacggtaccggaaccccgggttaggttacggccggtacccggtaccgtacggggtcggacccgtacgggttaccggttacggttccggtaacggttccgggaccccggtccgggggggttaccgtcccgggtccccggtacccgggttccggttaacccgg

SEQ ID NO: 85844 - DNA, 626 bp, Homo sapiens
  misc_feature: GYAE6OF01A4U97.21.45.E01.1.454.CMB.1.raw
  modified_base (524)..(524): a, c, t, g, unknown or other
  misc_feature (524)..(524): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctccagatgggtcctgtcccaggtccacctgcaggagtccgggcccaggactggtgaacgccctcgggacgaccctgtcccctctagtttcgcactgtgtctggactcccaccgtcactagtattcggttccttcgtgggggccttcggggtcccggcgtacggtccccgaggacggtaacgggtcgtggaggtggtagttgggagtgtacgtaagtaacggtacggggagtacgaagtcgtcggtggtcgactacctccctaactacctaacccgttctttaagacgtcgtagtcactatatcagtcgcgtctacgtaccgaacgtaccgcgtcctccgtagacgtatagacgtatcgtgtcggacggccacgacgaccgaccgtactaacgttnttcgtggtacggacgacgtaccggacccggtagtaccgcgtacgcgtacggacgcgtacgtaggtactcgactcgtcgtcggcgtccggtcgccgtcgtcgg

SEQ ID NO: 85845 - DNA, 691 bp, Homo sapiens
  misc_feature: GYAE6OF01EV2DS.21.45.E01.1.454.CMB.1.raw
  modified_base (113)..(113): a, c, t, g, unknown or other
  misc_feature (113)..(113): n is a, c, g, or t
  modified_base (208)..(208): a, c, t, g, unknown or other
  misc_feature (208)..(208): n is a, c, g, or t
  modified_base (255)..(255): a, c, t, g, unknown or other
  misc_feature (255)..(255): n is a, c, g, or t
tcagtcgtcgctcgcacgaccggtgctcgatttagtgagtcagtaagggaaagggggctttcagagagtcatggacctcctgtgcaagaacatgaggcacctgtggttttccncctgctggtggcagctccagatgggtcctgtcccaggtccactgcaggagtcgggcccaggactggtgaacgcccctgggacgaccctgtccctnatttcgcactgtgtctggactcccacgtcacagtatcggttccttgnggggctgggtccgcagtcccagaggaggtctggagtggagtgggagtgtctaagtagtacggggatcaagtagtcggtggtagaccacgttaccctacgtaacctaacccgttctttaaaggcgtacgtacgtactaactaattatcgaagtcgaccgtccgttccgtaccaaccggtaaccgtacggttcccttacccgtaggaacggtacgtagtagtaacttccgtaggtacggaccgggtacccgaccgaacggaccgtaccgggtacccgttaagtttacgtttccgtaaggtcggaacccggtaggtaacccggtacccgggtagttaccggccgtaccggtacccgtggacggaccgtaggttccggttaaccgttggaactcggtccccggtagggggtcccttgggccccgttccggtcggtacccg

SEQ ID NO: 85846 - DNA, 799 bp, Homo sapiens
  misc_feature: GYAE6OF01EJFLW.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggccaggactggtgaagccctggagaccctgtccctctatttgcactgtgtctggactccaccgtcacagtattcggttccttcggtggggcgttcggggtcccggccgaacgttcccccgaggaaggtaacggggttccgtggtaaggtgggtaagtttggggaaggttcggttacgttaagttaaacggtacggggggtaagtcgaaaagttacgttcgggttgggttacgaaccgtaccgttacccccgttaaacgttaaccctaaaccccggtttacgtttttaaaacggacggttaccgaaggttacccaagttaacgtaatttaccgaggtacgtccgacccttaccggtacccaacggtaacccgtaacggttccttacccccgtaggaacgggtatcggtaacggaacttcgttacgggtacgaaccgggtcccgtacggtaaccggaccggtaacccggaccccgtaaaggtttacgttttccgtaggtccgaccgggtaaacggtaaccggtacccccgggtaggttacggccgaaccggtctggggacggccgtacgttcggtacgttcgaagtcgcccgggttacgggtcccggtggtcccggtcccgtgggtacccg

SEQ ID NO: 85847 - DNA, 731 bp, Homo sapiens
  misc_feature: GYAE6OF01CJMI6.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaacgcccgtcggacgaccctgtccctcatttgcactgtgtctggactccaccgtcacagtagttcggttccttcggtggggcgtggggtccgcgacgtccccgagaggaacgggtcgtggaggtggtagttggggagtggttactaagttaaggtacggggtagttacaaagtagttcggtaggttagaccgtaccttaccctaacctaaccgtaacccgtttacgtttaagacgttacgtacgtactaactatatcgtagtcgcgtacgtccgtacccgaacgtaaccgtacggtccttcccgtaggaacggtatacggaagtacgttcgtggtaccggaccgggcccgacgaacgaccgaccgggtacctaagtttcgtttacgtaggtacggaccggtagaccgggtaaccccggtagttaccggaccggtaaccggtccggtacgggacggtaccgtacggttacgggttaccggtttcggtaacgtcgggtcccgggttacgggggtcccggtcgggtcccggtcccggttagggttacccg

SEQ ID NO: 85848 - DNA, 853 bp, Homo sapiens
  misc_feature: GYAE6OF01BJPLZ.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggttttcctcctgctggtggcagctcccagatggtcctgtcccaggtccacctgcaggacgtcgggcccaggactggtgaacgcccgtggacgaccctgtccctctatttcgcctactgtgtctggactcccgaccgtcacgagtacgttcggttccttcggtggggtccgttcggggtcccggtcgacggttccccgaaggtaacggtaacggggtccgtagggtacggtgggtaaggtttggggacgttcggtacgttaagtaaacggttacgggggtacgttacgaaagttacgtcggtcggtacgaacctaccgttacccccgttaaacgtaaccgtaaccccgtttacggttttaaacggacggttccgtaacggttactaacgtttaacgttaacgttaccgtacggtcggtaccgtaccgttacccgtacccgaaccggttaaacccgtacggttacccttaccccggttaaggacggtacgttagaacgtacttacgtcgacggtaacccgggtccgaaccgtacggtaacccgacccggtaaccttaacgttacgtttccgacggttacggaccgggtaaaccggtaccgggtaacccgggttaacggttacggaacccgggacggtaacccgtacgggggtaaccgtaccgttaccgggttaccggtttacgtacggtacgtccgggtacccgggttcggggacccggttacgggccccggttcccggtcgggttaccg

SEQ ID NO: 85849 - DNA, 704 bp, Homo sapiens
  misc_feature: GYAE6OF01A5HW9.21.45.E01.1.454.CMB.1.raw
  modified_base (209)..(209): a, c, t, g, unknown or other
  misc_feature (209)..(209): n is a, c, g, or t
  modified_base (577)..(577): a, c, t, g, unknown or other
  misc_feature (577)..(577): n is a, c, g, or t
  modified_base (663)..(663): a, c, t, g, unknown or other
  misc_feature (663)..(663): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggacgaccctgtccctnatttgcactgtgtctggactccaccgtcactagtatggttccttgtggggcgtcgggtccgcgacgtccccagaggtaagggtctggaggtggagttgggagtgtactaagtaaggtacgggagtacaagtatcggtagtacgacgtacctcccgtaactaaccgtaacccgtttcgtttaaagacgtacgagtacctacgtaatactacgtagtcgacgtcctaccgtaccgaaaccgtaaccgtacgttacccgtcccgtagggaacggtagttcggaaacgttagttccggtacggtacgggtaacccgggcccgacggacccggtaacgtaacccgggtaacctaaaggtttcgttttaaccgnggttaccggaacggtacgtaaccggaacccgggttaggttacggccggagtcccgttgggaccggcgtacggtggtacttaccggntccggcgggtacgggtcgacgggtccctccggttgtacccg

SEQ ID NO: 85850 - DNA, 602 bp, Homo sapiens
  misc_feature: GYAE6OF01ASRVI.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcgggagaccctgtccctcatttgcactgtgtctggatccaccgtcacagattggttccttcgtggggctgggtccggcacgtccccagaggaagggtctggagtgggagttggggagttgtcgtaagtaagtacggggagtcaatagtcggtggtagacactccctactaaccaacccgttctttaaagagtcgagtcactatatcagtgcgctccgtcacgaaccagtcctcctgaggatagagtatcgtggtcgaccggccgagacggaccgacggacctaagttactttcgtaggttacggacgtaggaccggtacccggagttacgcgtacgtccggtggacgtcgacgttaggtaccttcggagtcggaccggtcggggaccgtcgggcccgtcccggtggtaccc

SEQ ID NO: 85851 - DNA, 758 bp, Homo sapiens
  misc_feature: GYAE6OF01ES6L4.21.45.E01.1.454.CMB.1.raw
  modified_base (115)..(115): a, c, t, g, unknown or other
  misc_feature (115)..(115): n is a, c, g, or t
tcagtcgtcgctcgcacgaccggtgctcgatttagtgagtcagtaagggaaagggggctttcagagagtcatggacctcctagtgcaagaacatgaggcacctgtggtttttccncctgctggtggcagcctcccagatgggtcctgtcccaggtccacctgcaggagtccgggcccaggactggtgaacgcccctggagacccctgtccctcatttcgcctacgttgtgtcctggtacttccgaccgtcacagtacttcggttcccttcggtgggggcgttcggggtccggcacgttccccgagacggtaacgggtctggacgtggtagttgggagttgtactaagtaacgtacgggggtagtacgtaagtacgtcggtagggttacgaacctaccgttaccccttaaccgtaacccgtaaccccgtttacttttaacggacgttacgacgttacaacttacgtactacgagtcgccgtccgtacgtaccgaaccgtaaccgtacggtacccgttaccccgtaggacggtaacgttcggaacgtacgttcgtacggttacgggacccggtccggaccgtaacggtaacccgaaccggtaacccgtaaagtttacgtttcgtaggttacggacggtacggtaaccggtacccggtaaggttacggaccggtacggtccgtacgggacgccgtacgtacggttacgttcgacgttacggccggtacgggtcccggtccggcccgtcccgtcggtacccg

SEQ ID NO: 85852 - DNA, 619 bp, Homo sapiens
  misc_feature: GYAE6OF01BHR4Z.21.45.E01.1.454.CMB.1.raw
  modified_base (452)..(452): a, c, t, g, unknown or other
  misc_feature (452)..(452): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggactccaccgtcacagtactggttccttgtggggctgggtccgcacgtcccagagaagggtctggagtggagttgggagtgtactagtaagtacggggtatacaagtatcggtggtagacacttccctactacctaacccgttacttttaaggagtcgagtaccacttaatatctagtcgacgtctccgtaccacgaaccgtcggtcctcccgtagacggattgagtntcgtagtcggaccggccgagtaacgacgaccggacctaagttacgttctggtacgacggtacgaacggaccccggtagttacgcggaccggtcgtaggacggtcgacgttggtacttcggacgttcggaccgtcgggggcccgtaggcccggttcccgtggtacccg

SEQ ID NO: 85853 - DNA, 807 bp, Homo sapiens
  misc_feature: GYAE6OF01A4Z3S.21.45.E01.1.454.CMB.1.raw
  modified_base (208)..(208): a, c, t, g, unknown or other
  misc_feature (208)..(208): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatggtcctgtcccaggtccacctgcaggagtcgggcccaggactggtgaagccctggacgtaccctgtccctnatttgcactgtgtctggatccaccgtcacgagtacttcggttccttcgtggggccttcggggtcccggccgtacggtccccgaaggtaacggaagggttcctagggtacgttgggtagtttaggggagttacgttacgtaagttaaaggttacgggggattacgaaagttacgtcggtggtacgtacctaaccgtaccccgttaactaaccgtaacccgtttcgttttaaaacggacgttaccggtaacgttaccaaccgtttaaattacgtaccgtaaggttacgaccggtccttaccggtacccgaaccgtaaccgtaccgggttaccctacccgtaggaacggtacgttacggaacgtacgttccgtaggtacgggtaccggccggtacgaacggaacccgtaaccggtacctaaacgtttacgtttaccgtgggtacgaccggtaacggtaaccgggtacccccgggtaaggtttaccgaccgggtaccggtaccggtacgggacggtaccgtaccgtttacgggttaccgttcggacgttacgggtcccgggtacgggggtacccgtacgggtccccggtccgttcgggtaccc

SEQ ID NO: 85854 - DNA, 641 bp, Homo sapiens
  misc_feature: GYAE6OF01C7MB0.21.45.E01.1.454.CMB.1.raw
  modified_base (219)..(219): a, c, t, g, unknown or other
  misc_feature (219)..(219): n is a, c, g, or t
  modified_base (461)..(461): a, c, t, g, unknown or other
  misc_feature (461)..(461): n is a, c, g, or t
  modified_base (549)..(549): a, c, t, g, unknown or other
  misc_feature (549)..(549): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctggagaccctgtccctcatttgcactgtntctggatccaccgtcacagattggttccttgtggggctgggtccggcacgtccccaggaggaagggtctggagtggtagttgggagttgtactataagtacggggatacgaatagtcgtaggtacgacctaccgtaccctaactaaccgtaacccgttacttttaagacggtacgtaacgttacctacttaatactcagtcgacgctcgtaccacgtaaccaggtcctccgtgagatgaagntctgtcgacggccgcgacgaccgacgcctaagttctttcgtaggacgtcggacgtacgacccggtagttacggacgtacccggtccgngggacggtaccgacgttagggtaaccgtttcggaacgttcggacccggttcggggggaccgttccggggaccgtccccggttggttaccccg

SEQ ID NO: 85855 - DNA, 718 bp, Homo sapiens
  misc_feature: GYAE6OF01EBXLZ.21.45.E01.1.454.CMB.1.raw
  modified_base (135)..(135): a, c, t, g, unknown or other
  misc_feature (135)..(135): n is a, c, g, or t
  modified_base (208)..(208): a, c, t, g, unknown or other
  misc_feature (208)..(208): n is a, c, g, or t
  modified_base (347)..(347): a, c, t, g, unknown or other
  misc_feature (347)..(347): n is a, c, g, or t
tcagtcgtcgctcgcacgaccggtgctcgatttagtgagtcagtaagggaaagggggcgtttcagagagtcatggacctcctgtgcaagaacatgaggcacctgtggtttttcctcctgctggtggcagctcccngatggtcctgtccaggtccacctgcaggagtcgggcccaggactggtgaagccctcggacgaccctgtccctnatttcgctactgtgtcgtggactcaccgtcacagatcggttccttcgtgggggctcgggtcggcacggtccccaggagaaggtctggagtggagttgggagtgtactataagtacgggagtcaatagtcgtggtgaccncgtccctacactaacccgtctttaagagtcgacgtcactatatcgaatgcgctcgtccaaccgtaaacgtaccgtcgtaccgtacgtacggtaagtagtacgtacgtacgttacggtaccggtaccgggaccggtaccgaacggtaaccgaaccggtaccgtaaacgttaacgtttacgttacgtacgggtaccggtaaccgggtaacgggtaaccccgggtaaccggttaaccggtaccggtaaccgggtacccggtaccgggtacgggtaccggtaacccgttacgggttaaccggtttaccggtacggttacgggtacccgggtacgggggtacccggggttcccgggtcccgggtccccggtccggg

SEQ ID NO: 85856 - DNA, 627 bp, Homo sapiens
  misc_feature: GYAE6OF01C0V0U.21.45.E01.1.454.CMB.1.raw
  modified_base (531)..(531): a, c, t, g, unknown or other
  misc_feature (531)..(531): n is a, c, g, or t
  modified_base (613)..(613): a, c, t, g, unknown or other
  misc_feature (613)..(613): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctctgctggtggcagctccagatgggtcctgtcccaggtccacctgcaggagtcggccaggactggtgaagccctcggagaccctgtccctcatttgcactgtgtctggactccaccgtcacagtattcggttccttcggtgggggcttggggtccggcacgtcccgagaggaaggtctggagtggagttgggagttgtactaagtaagtacggggatacgaagtagtcggtaggtacgtactaccgttaccctaactaaccgtaacccgtttacttttaaacggacgtacgtaacgtactaacgttatatcaggtcgccgtctcgtaccaacgtaacctacggtcctccgtacggaggtatggagacttcgtagtcggacggccgacgacgaaccgaccggactaaaggttctttcgnggtcgacgtacggaccggacccggtagttacggaccgacgtccgaggacgcgtacgtcgtacgtcgagtgccgtcgggccgnggccgccgtggtcc

SEQ ID NO: 85857 - DNA, 855 bp, Homo sapiens
  misc_feature: GYAE6OF01AF4VY.21.45.E01.1.454.CMB.1.raw
tcagtcgtcgctcgcacgaccggtgctcgatttagtgagtcagtaagggaaagggggctttcagagagtcatggacctcctgtgcaagaacatgagcacctgttggttttcctcctgctggtggcagcctcccagagtgggtcctcgtcccgaggtcccacctgcgaggacggtccgggcccgaggactggtagaacgcccgtcggacgaccctcgtccctctatttgcacgtgtcgtctggactccaccgtcacgagtattcggttccttcggtcggggtcgttcggggtcccggcgaccgtccccgaggaacgggtaagggtcgtagggtaggtgggtaggttggggagttcggtacgttaaaggttaaaggtacgggggtacgttactaaagttagttcggttgggtacgacctacccgttaccccttaaccgttaacccgttaaacccgttttacgttttaaaacggtacgttacggtaacgttacctaacttaacgttactacgtaggtcgccgtccgttcccggtacccgaaccggtaacccgtacggttcccctcccggtaggtaacggtagttacggaacgtacgttcgttacggtacgggacccggacccgtaacggaaccggaccggtaacccggtaaccgttaacggtttctttacggtcggtacggtaccgggtacggtaacccgggtaccccgggtaagttacccggacccgggtacccggtccggtacgggtaccgtccgtaccggttacgggttacccgttacggtaccgttccgggtaccccggggttcggggggtaccccggttccggggccccggttccccgggtttggtaccccgg

SEQ ID NO: 85858 - DNA, 874 bp, Homo sapiens
  misc_feature: GYAE6OF01BPYSL.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggtttttcctcctgctggtggcagcctcccagatgggtcctgtcccaggtccacctgcaggagtccgggcccaggactgggtgaacgccctcgggacgaccctgtccctctatttcgcctactgtgtctggactccaccgtcacgagtacgtcggttccttcggtgggggtccttcgggggtcccggacgtaaccggttacccccgaagggaacgggtaacggggttccgtaggggtacgggttagggtaggtttagggggtacgttacggttaccgtttaaaggttaaacgggttaaccggggggtaacgttaaccgtaaagttacggttaccgggttagggttaccggtaaaccctacccgtttacccccgttaaccgttaacccgtaaacccccggttttacgtttttaaaacggaccggttaccggtaaacggttaccctaaacgtttagttaacgttacgaacggttcgtaccggttccgttacccggtacccgaacccggtaaacccgtacggttacccttaccccgtagggaacggtacgttacggaacgttacgtcgtacggtacgggacccggtccgacgtacggaaccgaaccggtaccgtaagtttacgttcgtacgtacggaccggtaacgaccggtaccccgggtagttaccggaccggtaccggtaccggtgggaccggtaccgtacggttcggttacgttccggacgttcggtacccgggtcggggtcccggtgggcccgtccggtcggtacccg

SEQ ID NO: 85859 - DNA, 879 bp, Homo sapiens
  misc_feature: GYAE6OF01DU02J.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggttttcctcctgctggtggcagctcccagatgggtcctgtcccaggtccacctgcaggagtccgggcccaggacctgggtgaacgccccgtcgggacgtaccccttcggttccccctactagttttcggccaccgttggtcgtccgtgggaaccttccccgaaccgtccaacgtaggtacttccgggtttcccttcgggtcgggggtccgttcggggtcccggcgtaccggtcccccggaaggtaacgggtaacggggttccgtaggggtaggttagggtaggttagggggtaggttcggttacgttaagttaaagggtaccgggggtaatacgtaagttagtcggtggtacgaacctaccgttacccttaaccgtaacccgtaacccgtttaccgttttaaacggacgttacgtacgtacctaacgttaactacgtacgtagtcggtaccgtaccgtccgtacccgaaccggtaaccgtaccggttccccgtacccggtaggaacggtacgtacgtaacgtacgttcggtacggtccgggaacccggtcccggaacgtacgaacccgggaaccggtaccgttaacgtttacgtttcggtaacggtcggaaccggtaacggaacccgggtaacccggttaaggtacggacccggttacgccgggtaacgggcgtaccggtacggtttaccggtaacgttccggtacggttccgggtacgggggttcccggggtacccgggttaccgggtccccggtcccggttcgggttacccg

SEQ ID NO: 85860 - DNA, 643 bp, Homo sapiens
  misc_feature: GYAE6OF01DDA2X.21.45.E01.1.454.CMB.1.raw
  modified_base (264)..(264): a, c, t, g, unknown or other
  misc_feature (264)..(264): n is a, c, g, or t
  modified_base (419)..(419): a, c, t, g, unknown or other
  misc_feature (419)..(419): n is a, c, g, or t
  modified_base (514)..(514): a, c, t, g, unknown or other
  misc_feature (514)..(514): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtccgggcccaggactggtgaacgcccctcgggacgacccctgtcccctctatttcgcactgtgtctggactcccacgtcacgagtattcggttcctgnggggctgggtccgcacgtcccgagaggaacggtcgtaggagtggtagttgggagtgtactaagtaaggtacggggatacgaatacgtcggtggtacgacctactccccgtaactaccgtaaccgtttatttaacgagtacgtacgtctaactatntcagtcgcgctcgtaccacgaacctcgtcctccgtagacgatgagtactcgtgtcgaccggccgacgacgaccgacggacctaagtttctttcgngtacgcgaacggaccggtacccggtagtacggccgtaccggcggtacgggagtaccgtaacggttcggttaccgttcggaccgttcggcccgggttacggggccggtcgggcccgtccggtcggtaccg

SEQ ID NO: 85861 - DNA, 880 bp, Homo sapiens
  misc_feature: GYAE6OF01BN1NW.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgttggtttttcctcctgctggtggcagctcccagatgggtcctgtcccaggtccacctgcaggacggtccgggcccaggacgtggtgaacgccccgtcggacgacccgtcgtcccctctatttcgcctaccgttggtgtccgtgggtactccccgtaccgtacacgtaggtacgtttcggtttcccgtttcgggtcggggggtccgttcgggggtcccggtaccgaccggttacccccggaaggaacgggtaacggggttccgtaggggtaggtgggtaacggtttgggggacgtttggtacgttaagttaaacgggtaccgggggtaagttaccgtaaagttacgttcgggtacggttacgaacccttaacccgttacccccgttaaaccgttaacccgtaaaccccggttttacgtttttaaacggacggttaccggtaacggttaccctaaactttagttaacttacgaaggttcgaccgtcttacccggtacccgaaccgtaacccgtacggttcccctacccggtgggtaacggtactggaacgttcgtccgttaggtccggaccgggcccgtacgacgtaaccgtaccggtaccgtaagtttcgtttcgtacggtacggtaccggtaacggaacccgggttacccgggtaaggttacccggaaccggtacccgggtaccggtagggaaccggtaccgtacggttaccgggttaccttcggacgttcccggaccgggtccggggtaccgtcgggcccgtcggttcggtacccg

SEQ ID NO: 85862 - DNA, 591 bp, Homo sapiens
  misc_feature: GYAE6OF01DO9OW.21.45.E01.1.454.CMB.1.raw
  modified_base (301)..(301): a, c, t, g, unknown or other
  misc_feature (301)..(301): n is a, c, g, or t
  modified_base (365)..(365): a, c, t, g, unknown or other
  misc_feature (365)..(365): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctgggacgaccctgtccctcatttgcactgtgtctggactccaccgtcacagatcggttcctcgtggggctgggtccgcacgtcccagagagggtctggagtggagttgggngttgtctagtaagtacggggagtacaagtagtcggtggtgactactccctactactaaccgttntttaagagtcgagtcactatactcagtcgcgtctcgtaccaacgtaaccgacggtcctcccgtaggacggatgagacgtctgtcggacggcccgagacggacacggactaagttacttcgtgtcgcgtaggaccggacccgggtagtacggccgaccgtcgtacgggagtaccgacgttcggttacttcgacgttccggcggtcggggcgcggccgccgtgtaccg

SEQ ID NO: 85863 - DNA, 605 bp, Homo sapiens
  misc_feature: GYAE6OF01EX0XG.21.45.E01.1.454.CMB.1.raw
  modified_base (297)..(297): a, c, t, g, unknown or other
  misc_feature (297)..(297): n is a, c, g, or t
  modified_base (372)..(372): a, c, t, g, unknown or other
  misc_feature (372)..(372): n is a, c, g, or t
  modified_base (494)..(494): a, c, t, g, unknown or other
  misc_feature (494)..(494): n is a, c, g, or t
  modified_base (501)..(501): a, c, t, g, unknown or other
  misc_feature (501)..(501): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgagccctcgggacaccctgtccctcatttgcactgtgtctggactccaccgtcacagatcggtttcctcgtgggggcttcgggtccggcacgtccccgagagaagggtctaggngtggagtgggacgtgtctaagtaagtacggggatgtaatgtcgtggtgacgtactcccgtactactaacccgttntttaacgagttcgagtctactatactcagtcgcgtcttcccgacgacgaacccgtcgtacctacccgtgtaacggagtgacgtatccgtagcgacgggccacagccacggactattcttcgnggtacgngacgtacgacccggtagtacgcggaccgccgtgggacgcgtacgttgggtacctcggacgtcggtaccggtcggggcgtccgggtcggtccccgttggtacccg

SEQ ID NO: 85864 - DNA, 905 bp, Homo sapiens
  misc_feature: GYAE6OF01A1HBD.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcgaggagtcgggcccaggactggtgaacgccctcggagaccctgtccctctatttcgccacgtgtcgtctggactcccgaccgtcacctagtacgttcggtttcccttcgtcgggggtccgttccggggtcccggaccgtaccggttcccccgaaggtaacggtaaggggtccgtaggggtaggtagggtaggtttaggggaggttcggtacgttaaacggtaacggttacgggggtaacttaccgtaaattaaggttccgggttaggttaccggaaacctaccgttacccccttaactaacccgttaaaccccggtttacttttaaacggacgtaccggtagttaccgtaaccgttaatacgtacgtaacgtcgtccgtcgttcccgtaccgaacccgtaaccgtaccggttccgttacccccgtagggtacggtacgtggtaacgtacgtcgttacgggtaccggaaccgggcccgtaccggaacggaacccggtacccggtaacccgtaaggtttactttaccgggttacgtacggggaacccggtaacgggtaaccccgggtaaccccgggttaaacggttaccgggtacccgggtacccggtacccgggtaccggggaacccgggtaaccgtaccggtttaccgggttaacccggtttccggaccgttacccgggtccccggggttccgggggtccccgggttacccggggtcccggtaccccggggttggttaccccgg

SEQ ID NO: 85865 - DNA, 782 bp, Homo sapiens
  misc_feature: GYAE6OF01ENPDU.21.45.E01.1.454.CMB.1.raw
  modified_base (113)..(113): a, c, t, g, unknown or other
  misc_feature (113)..(113): n is a, c, g, or t
  modified_base (214)..(214): a, c, t, g, unknown or other
  misc_feature (214)..(214): n is a, c, g, or t
tcagtcgtcgctcgcacgaccggtgctcgatttagtgagtcagtaagggaaagggggctttcagagagtcatggacctcctgtgcaagaacatgaggcacctgtggttttccnctgctggtgcagctccagatggtcctgtcccaggtccacctgcaggacgtccggcccaggactggtacgaacgtcccgtacggactaccccgtgtcccctntatttcgcctacgtgtcgtactggactcccaccgtcacgtagtacgttcggttccgtggtcggggcgttacgggtcccgcgtaccgtccccgaaggacggtaacggtcgtaggtaggtaggtaggttcgggtagttcgtacgttaaggtaacggtacgggggtaacgtacgtaaagttacgttcggttaggtacgtaacctaacccgttacccgtaaacttacccgtaacccgttacgttttaaacggacgtacggtacgttacctaaacttataactacgtaacgtcgtccgtacgtaccgtacccaacgaaccgtacgttccctacccgtaggacgtagtaggaacgtacttcggtcgtacgggacccggtccgacgtaccggaaccgtacccggtaccttaagtttaccgttacgtcggtaccggaaggtacccggaaaccggtacccgggttaaggtaccgacccggtacgtcccgggtaggaccggtctacgggttacgtaccggttcgcggtaccggtcccgggtacggggtcccgtaggtccccggtccgtcggttacccg

SEQ ID NO: 85866 - DNA, 817 bp, Homo sapiens
  misc_feature: GYAE6OF01CFIR0.21.45.E01.1.454.CMB.1.raw
  modified_base (785)..(785): a, c, t, g, unknown or other
  misc_feature (785)..(785): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtccgggcccaggactggtgaacgccctcggacgacccctcgttccctctatttcgcctacgttgtcgttcgtacggtacctaccccgaccgtacaacgaggtacgtttcggtttccccgttggtcgggggtccgttcgggggtcccggtccgtaaccggtcccccgaaggtaacgggtaaacggggttccgtggggaaggttgggtacggtttaggggtagttggttaccgttaaagttaaacgggttacgggggaacgttacgtaaagttacgttacggttagggtacgaaccctacccgttaccccgtaaccgttaaaccccgtaaacccggttttaccgtttttaaacggacggttaccgtaacggttaccctaaacgtttaattaaccgttcgtaacggtcggaacccgttccgttacccgtacccgaacccggtaacccggtaacggtttcccttacccgtaggtaaacggtacgtaagtaacgtacgttcgtaggtccggaccggtccgacgaacggacgtaaccggtactaagttcttcgtaggtcgacgggacgaaccggtaccggtagtaccgccgtccgtacgtcggacgtcgtacgttgtacgtccgngtcgtcggtcgggcgccggtccgtcgtgtccg

SEQ ID NO: 85867 - DNA, 873 bp, Homo sapiens
  misc_feature: GYAE6OF01CUA6A.21.45.E01.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagcctccagatgggtcctgtcccaggtccacctgcaggacgtccgggcccaggtactgggtagaacgcccctagggacgtacccttggtccccctntatttcgctacgttgtcgtcgtgggacttcccaaccggtcaaccgtaggtacgtttcgggttttcccttgggtcggggggtccttcgggggtcccggtacgtaaccggttcccccgaaggtaacgggtaacgggttcgtaggggtaggtggtaggttggggagttcgtacgtaagttaacggtacgggatacgtaagttacgtcggtggtaccgactacccgtaccctacctaacccgtaacccgtttacgttttaacgacggttacgtacgtactaacgtaactacgtacgtaacggtcgtaccgtcgttccgtaacccgaccgtaaccgtcggttaccctccgtaaggacggtacgtacgtacgtacgtccgtagggtaccggacccgggtaccgacggaaccggtaaccggtaacccggttaactaaacggttttccgtttaacggcgggttaccggtaccgggtaaccgggaaccccggttacccgggttaacgggttaccggacccgggtaacccgtcccggggtaagggtacccggtaccgtaccggtttacggttaaccggttaccggtacgggttcccgggtcccggggttaccgggggtcccggttaccgggtaccccgttcccgggttaccggttacccgg

SEQ ID NO: 85868 - DNA, 821 bp, Homo sapiens
  misc_feature: GYAE6OF01EEOS6.21.45.E01.1.454.CMB.1.raw
  modified_base (206)..(206): a, c, t, g, unknown or other
  misc_feature (206)..(206): n is a, c, g, or t
  modified_base (265)..(265): a, c, t, g, unknown or other
  misc_feature (265)..(265): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtgcagctccagatggtcctgtcccaggtccactgcaggacgtccggccaggactggtagaacgcccgtggacaccctgtccctntagtttcgctacgtgtgtcgtggactccgaccgtcacgagtacgttcggttccttcggnggggtccgttcgggtccgcgaccgtaccccgaaggaggtaacgggtcgtaggaggtggtagttggggagttcgtacgttaaggttaaacggttacgggggtaacgttacgtaaacgttagtaccgggttagggtaccgtaacctaacccgttaccccgttaaaccgttaacccgtaaacccgttttacgttttaaaacggacggttacggtaacgttacctaacgtttaagtaacgtacgtaggttcggtaccgtaccttccggtaaccctaacggtaaacccgtacggttccctaccccgtagggaacgtacgtagaagtacgttacggtggtacggtcccggaccgtcgtaacggaccgtaccgggtacttaaacggtttgtttacggtacgtacggacggtaaccggtaacccgggtaccccggttaaggtacccggaccggtacccggtaccggtacggggacggtaaccgtcccgggtttaacggttacgtcgtacgttcccgggtaccgggtcgggggtaccctcgggccggttcccggtgggttacccg

SEQ ID NO: 85869 - DNA, 579 bp, Homo sapiens
  misc_feature: GYAE6OF01CSLO4.21.45.E01.1.454.CMB.1.raw
  modified_base (295)..(295): a, c, t, g, unknown or other
  misc_feature (295)..(295): n is a, c, g, or t
  modified_base (398)..(398): a, c, t, g, unknown or other
  misc_feature (398)..(398): n is a, c, g, or t
  modified_base (438)..(438): a, c, t, g, unknown or other
  misc_feature (438)..(438): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggacgaccctgtccctcatttgcactgtgtctggatccaccgtcacagattcggttccttcgtggggctgggtccggcacgtccccagacggaagggtctggngtggagttgggagtggtctagtaagtacggggagtacaatagtcggtggtagaccacttacccctactaaccaacccgttctttaagagtcgtagtcatatanctagtgcgctcgtacacgactacggtctcctgagatagantctgtagcggccgcacgacacgaccgaattgttctaggtcgacgaggtaccgacccggtagtacggacgtaaccgccgtgggacggcgtacgtaggtacttgacgtggccgtcggggccgtcgggccgtcccgtggtcccg

SEQ ID NO: 85870 - DNA, 882 bp, Homo sapiens
  misc_feature: GYAE6OF01CHXIT.21.45.E01.1.454.CMB.1.raw
  modified_base (873)..(873): a, c, t, g, unknown or other
  misc_feature (873)..(873): n is a, c, g, or t
tcagtcgtcgctcgcacgaccggtgctcgatttagtgagtcagtaagggaaaggggctttcagagagtcatggacctcctgtgcaagaacatgaggccacctgttggtttttcctcctgctggtggcagcctcccagagtcggtcctgtcccaggtcccacctgcgaggacgtccgggacccaggtaccgtggtacgaaccgtcccccgtgggaaccgtacccctcgtcccctagtacgtttcggacctacttggttcgtccgtggaaccttcccgaccggtacaccgtagtacgtttcggttcccgttcggtcggggccgtcgggtacccgtcgtacccggttaccccgaaggtaacggtaacggtccgtaggggaggttaggtacggttaggggtacgttaccggttaaccgttaaaggtaaacggtaccggggtaagttaccgtaaaggttacggttcggttacggtacgtaacccgtacccttacccgttaaaccttaacccgttaacccggtttacgttttaacggaacgttaccggtaacgttaccttaaccgtaagttactacgtacgttacgacccgtacgttacccgtacccgaaccgtaaccgtaccggttaccctacccgaaggtacgtacgaggtaacgtactacggtacggtaccgacccggtaccgacgtaaccgtaccggaacggtaacctttaacggtttctttaccgtacgggtacggtaaccggaacggttaaccccggtaaccggttacggtacggaccccggtaagggttcccgagggtacggtacccgttcggtacggttacccgtaggaccggtcggtcccgggaccgggttccgccgggcccttccgggnttaccccgg

SEQ ID NO: 85871 - DNA, 612 bp, Homo sapiens
  misc_feature: GYAE6OF01DTY9Q.21.45.E01.1.454.CMB.1.raw
  modified_base (466)..(466): a, c, t, g, unknown or other
  misc_feature (466)..(466): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctctatttgcactgtgtctggactccaccgtcaccagactcggttccttcgtggggctgggtccgcacgtcccgagaggaggtctggagtggattgggagtgtctagtaagtacggggtagtctaatatcggtggtagacactccctactacgtaacccgttactttaagacgtacgagttcaactatatctagtgcgtctaccgtccaacgtaccgacggtcctaccgtagaggatgtagactgtcggtcgacggcccgngagaaccgacggactaagttctttcgtggtgacggtacgaaccggtaccccggtaggttacgccggtaccgccggtagggacggccgtacgttacggttacgtcgtagtcggtccggtcggggccgtcggccgcccggtggtcccg

SEQ ID NO: 85872 - DNA, 578 bp, Homo sapiens
  misc_feature: GYAE6OF01APO1W.21.45.E01.1.454.CMB.1.raw
  modified_base (220)..(220): a, c, t, g, unknown or other
  misc_feature (220)..(220): n is a, c, g, or t
  modified_base (338)..(338): a, c, t, g, unknown or other
  misc_feature (338)..(338): n is a, c, g, or t
  modified_base (407)..(407): a, c, t, g, unknown or other
  misc_feature (407)..(407): n is a, c, g, or t
  modified_base (471)..(471): a, c, t, g, unknown or other
  misc_feature (471)..(471): n is a, c, g, or t
tcagtcgtcgctcgcacgaccggtgctcgatttagtgagtcagtaagggaaagggggcgtttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcattgcactgtntctggactccaccgtcacagattggttcctcgtggggctggtcggcagtccccagagaaggtctggacgtggagttgggagtgtctagtaagtacggggatcaatagtcgtggtgacnctaccctactacaacccgtctttaagagtcgacgtcactagtctcaagtgacgtctcgtccacgaaccnggtcctccctgagtactgacgatctggtcgacggccgcgagacgacgtactaagttactttcgngtaggacgtagaccgaaccccggtagttacgcgacgccgtgggacggcaacggtggttactcggaagtcggccgtaggggcccgttagggcctcccgttggtacccg

SEQ ID NO: 85873 - DNA, 781 bp, Homo sapiens
  misc_feature: GYAE6OF01EHMHJ.21.45.E01.1.454.CMB.1.raw
  modified_base (210)..(210): a, c, t, g, unknown or other
  misc_feature (210)..(210): n is a, c, g, or t
tcagtcgtcgctcgcacgaccggtgctcgatttagtgagtcagtaagggaaagggggctttcagagagtcatggacctcctgtgcaagaacatgaggcacctgtggttttcctcctgctggtggcagctcccagatgggtcctgtcccaggtccacctgcaggagtcgggcccaggactggtgaacgcccgtcggacgaccctgtccctntatttcgctactgtgtcgtggactcccgaccgtcacagtacttcggttccttcggtggggtccgtcggggtcccggctaccggtccccgaaggaacggtaacgggtccgtagggtaggttagggtaggttggggaggtttcgttacgtaagttaaagggtacgggggtagtacgtaaagttacgtcgggtaggtcgaaccctaccttcccctaaaccgttaaccgtaaccccgtttacgttttaaaggacgttacgtaacgtctaacttaattacgtacgtaggtcgtaccgtccgtaccgtacccgaaccgtaaccgtacggttcccttaccccgtaggtacggtaacgtggaacgtacttacgtcggtacgggacccggccgtacgaacgtaacccggaccggtaccgtaagtttacgtttcgtggttaccggacggtaacggtaccggaacccggtagtaccggaccggtaccgtccggtacgggtcgtaccgtacggtacggttaacgtccggacggtccggtaccgggtcggggtcccggtacggtcccggtcccgtcggtacccg

SEQ ID NO: 85874 - DNA, 929 bp, Homo sapiens
  misc_feature: GYAE6OF01BZQO7.21.45.E01.1.454.CMB.1.raw
  modified_base (114)..(114): a, c, t, g, unknown or other
  misc_feature (114)..(114): n is a, c, g, or t
  modified_base (210)..(210): a, c, t, g, unknown or other
  misc_feature (210)..(210): n is a, c, g, or t
tcagtcgtcgctcgcacgaccggtgctcgatttagtgagtcagtaagggaaagggggctttcagagagtcatggacctcctgtgcaagaacatgaggcacctgtggtttttccnctgctggtggcagcctccagagtggtcctgtcccaggtccaccgtgcgaggacgtcggcccaggactggtgaacgccctggacgaccctgtccctntatttcgactacgtgtcgtcgtggacttcccgaccgtcaacgtaggtacgtttccggtttaccgtttcggtcggggggtccggttcggggttaccccgggaccgtaaccggttaccccggaaagggtaacgggtaaacggggttccggtaggggtaaggttgggtaacggtttacgggggtagttcggttaacgttaaacggttaaacggttaacgggggtacttaacgtaagtttacggttacgggtacggttacggaacccttacccgttaaccccgttaaacgttaaccccgttaaacccggttttaacgtttaaaacggtacggtttaaccggtacgttaaccgtaacgtttaacttaacgtacggtaacggttcggtaccccgttacgttaccccgtaacccgtaaaccggtaacccggtaccggttacccctttcccggtaagggtaacggtaagttacggaacgttacggttccgtacgggttacggaccccgggtactaccggtaaacgacccgggtaaccgtaacgtaacgttttaacgtttcgaagggttaccgaccgggtaacgggaacccggtacccggttaaggtaccggacccgtacgggtcccgtaagggaccgttacggtaccggttacggttaccgttcggaccgttccgggtacccgggtcggggtacccggtacgggaccccgttcccgttaggtacccg

SEQ ID NO: 85875 - DNA, 684 bp, Homo sapiens
  misc_feature: GYAE6OF01A5U98.21.45.E01.1.454.CMB.1.raw
  modified_base (199)..(199): a, c, t, g, unknown or other
  misc_feature (199)..(199): n is a, c, g, or t
  modified_base (211)..(211): a, c, t, g, unknown or other
  misc_feature (211)..(211): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcagggagtcgggcccaggactgggtgaacgccctcgganaccctgtccctnatttgcactgtgtactggactccacgtcacagactcggttccttggtgggggtctcggggtccgactacgtaccccgaaggaggaacgggtctagggacggttaggtagttggggagtggtctaagtaaggtacggggagtcgtaagtagtcggttaggtcgaacgtctccctaactaacctaaccgtactttaacgacgtacgacgtactaactatactctagtcgcgtctcgtaccacgtaccgcggttacctccgtaggagtatagtacgtacttcgtaggtcggtaccggcgccgaacgacgaccgggtactagtttaacgttcgtaggtacgcgggtaacgtacccgggaacccggtaggttacgaccggtaccggccgtagggacgtacgtacggtacgggttacttcggaaggttcccgtacgggtacggggtcccggtagggtcccggttcccggtggtaccccg

SEQ ID NO: 85876 - DNA, 774 bp, Homo sapiens
  misc_feature: GYAE6OF01B99TF.21.45.E01.1.454.CMB.1.raw
  modified_base (113)..(113): a, c, t, g, unknown or other
  misc_feature (113)..(113): n is a, c, g, or t
  modified_base (206)..(206): a, c, t, g, unknown or other
  misc_feature (206)..(206): n is a, c, g, or t
tcagtcgtcgctcgcacgaccggtgctcgatttagtgagtcagtaagggaaagggggctttcagagagtcatggacctcctgtgcaagaacatgaggcacctgtgtttttccncctgctggtgcagctccagatgggtcctgtcccaggtccacctgcaggagtcgggcccaggactggtgaacgccctggacgaccctgtccctnatttgctactgtgtctaggacttcccaccgtcacgtagattcggttccctttggcgggggcttacggggtccggcgaccggttacccccgaggacggtaacggggtcctagggaggtagggtagttcggggtagtggtacgtaagtaaaggtacggggtatacgtaattagtcggtgtacggaacctaccgttaccccgttaacctaaccgttaaccccgttactttttaaaacggcggtttaccgaacggttacctaacgttaattacgtacggtaagttcgacgtccgtccgtacccgaaccgaaacccggttggtcccgttaccccgtaggtacgggtaacgttagaacggtacttccgtgggacgtaccggggccctagtaacgaaccggaccggtaccgtaaagtttacgtttccgtaggaggtaccgaaccgggtaccggaaccccggggttagttaccggaccgtaccggtacccgtgggtaccggccgtaacgttcgggttacctggacggtcgccgggttacggggccccggttgggccctcccggttcgggttacccg

SEQ ID NO: 85877 - DNA, 703 bp, Homo sapiens
  misc_feature: GYAE6OF01DF93J.21.45.E01.1.454.CMB.1.raw
  modified_base (572)..(572): a, c, t, g, unknown or other
  misc_feature (572)..(572): n is a, c, g, or t
tcagtcgtcgctcgcacgaccggtgctcgatttagtgagtcagtaagggaaagggggctttcagagagtcatggacctcctgtgcaagaacatgagcacctgtggttttcctcctgctggtggcagctcccagatgggtcctgtcccaggtccacctgcaggagtccgggccaggactggtgaacgccctaggacgaccctggtccctgatttcgcacgtgtgtcctggtactcccgaccgtcacgagtactcggttcctcggtcggggtccgtcgggtaccgcacgtcccgaggtacggaacgggtctaggagtcggtagtgggagtgtacgtaagtaacggtacggggtagtacgtaagttacgtcggtaggttacgacctaccgttaccctaaccgtaaccgtaacccgtttagtttaacggacggtcgtaacgtctaacgttactagtcgagtcgccgtcgttccgtaccaaccggtaacctacggttcctcccgtagggtacgtatacggatactgtaggtacggccggaccgtacgacgtaccggacgaccgtaagtttcgttcgngtacggacgtacggaccggtaacccggtagttaccgacggaccgttcgacgggcgtaccgtacggttcggttaccttcgacggttccgccggggtcggggtaccctcgggacccgtcccggttggtacccg

SEQ ID NO: 85878 - DNA, 660 bp, Homo sapiens
  misc_feature: GYAE6OF01E2DSH.21.45.E01.1.454.CMB.1.raw
  modified_base (393)..(393): a, c, t, g, unknown or other
  misc_feature (393)..(393): n is a, c, g, or t
  modified_base (487)..(487): a, c, t, g, unknown or other
  misc_feature (487)..(487): n is a, c, g, or t
  modified_base (642)..(642): a, c, t, g, unknown or other
  misc_feature (642)..(642): n is a, c, g, or t
tcagtcgtcgctcgcacgaccggtgctcgatttagtgagtcagtaagggaaagggggctttcagagagtcatggacctcctgtgcaagaacatgaggcacctgtggttttcctcctgctggtggcagctcccgagagtcgggtcctcgtcccaggtccacctgcagggagtccgggcccagggactgggtagaacgcccgtacgggacgtaccccttcgtcccctactattttcgcctacgttgtcgttcgtggtactcccaccgtacacgtagtacttcggttcctggtcggggctggggtccgctaccgtacccgaggacggtaacgggtctcgggtaggtcggtaggttacgggagttaggtctaagtaacggtacggggtatactagtntcggtgtacgactccgtaccctactaccgtaaccgttcttaagctacgacgtacactatacgtcgacgtgccgtctaccgtaccacgtaaccgngtcccttacgaggacgtatagacgtactcggtgacggaccgcgtcgaaacggccacgtaactagttactcgtagtcgacgacgtaccgacggtactacgccgacgcgtagggactcgaaggttcggtactagtacgtcggcggtacggggcccgngtcccgtccgtggtaccc

SEQ ID NO: 85879 - DNA, 706 bp, Homo sapiens
  misc_feature: GYAE6OF01DMFO5.21.45.E01.1.454.CMB.1.raw
  modified_base (132)..(132): a, c, t, g, unknown or other
  misc_feature (132)..(132): n is a, c, g, or t
  modified_base (263)..(263): a, c, t, g, unknown or other
  misc_feature (263)..(263): n is a, c, g, or t
  modified_base (642)..(642): a, c, t, g, unknown or other
  misc_feature (642)..(642): n is a, c, g, or t
tcagtcgtcgctcgcacgaccggtgctcgatttagtgagtcagtaagggaaaggggctttcagagagtcatggacctcctgtgcaagaacatgaggcacctgtggttttcctcctgctggtgcagctccagntggtcctgtcccgaggtccacctgcgaggacggtccggcccaggtacgtggtacgaacgcccgtcggacgtacccgtcgtccctctacgtttcgcctacgttgtcgtcgtggactcccgaccgtcacagtntcggttccgttcggtgggcgtcgggtccggcgacgtcccgaagaggtaacgggtctaggaggtggtagttgggagttgtacgtaagtaaggtacggggtagtacgtaagtacgtcggtaggtacgtacctaccttacccgtaaccgtaaccgttaaccggtttaacgttttaacggaacggttacgtaacgttacctaacgttaactacgtacgtagtcgtcgtccgtaccgacccgtaaccgaaccgtacggtacccgtaccggtagacggtagtagacgtacgttgtaggcgaccgtccgacgaccgacgacggtactaacgtttcttacgtgtacggacgtacgaccggtacccgtaggttccgacgtccgtcggnggccgcgtaggtcggttactcgacgtccgcgggtccgggccgtagggccgtccggttgtacccg

SEQ ID NO: 85880 - DNA, 871 bp, Homo sapiens
  misc_feature: GYAE6OF01ACH44.21.45.E01.1.454.CMB.1.raw
  modified_base (134)..(134): a, c, t, g, unknown or other
  misc_feature (134)..(134): n is a, c, g, or t
  modified_base (206)..(206): a, c, t, g, unknown or other
  misc_feature (206)..(206): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtgcagctccagntggtcctgtcccaggtccacctgcaggagtcgggcccaggactggtgaacgccctcggacgccctgtccctntacgtttgctacgtgtcgtcgtcggactcccgacgtcaacagtacgttcggtttcccttcggtgggggtccgttcggggttcccggactaccggttaccccgaaggtacgggtaacgggttcgtacgggtaggtaggggttacgtttgggggattcggttacgtaacggtaacggttaccgggggatacgtaagttacgggttccgttgggtaacggtaccctaacccgttaaccccgttacgttaaacccggttaaccccgtttacgttttaaacggaccggttacggtacgtacccgttaaactttagttaaccttcgttaaacgggtccgaccggttaccgttaacccgtacccgtaaccgggaaaccgttaccgggttacccttaccccggtaggaacgggttctaacgggttaacgtcgttacgttacgggttccgaacccgggtccgaaccggtacgaacccggtacggttaacctaacgtttactttcggtaacgtacggaacggtaacgaacccggttacccggggtaaggttaccgacgggttcccgacggtaccgggtcggtacccgtaccgggtttacgtaccggtttcgaaccggttggtcccggggttacccgggttacggcccggtccgggtacccggtcgttaacccggg

SEQ ID NO: 85881 - DNA, 776 bp, Homo sapiens
  misc_feature: GYAE6OF01CE5IZ.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtccgggcccaggactgggtagaacgcccctcgggacgaccctgtccctctatttcgcacgttgtgtctggtactcccgaccgtcacacgtattcggttccttcgtgggggcctcggggtccggcctaccggtcccccgaaggacggtaacgggtctgggagtgggtagttggggagttgtacttaagtaaggtacggggtacgtacgaagttagtcggtggtacgtacctaccgtaccccgtaactaacccgtaacccgtttacttttaaacggacgttacgtacgtacctaactttaagttaactacacggtcggccgtaccgtccgtaccgaacccgtaacccgtaccggttccctacccgtacgggtaaggacgttacgtaagtaacgttcgtaggtaccgggacccggacccgagaccggtaaccgaccggaccttaaggttacctttacgtgggtacggacggtaacggtaaccggtaccccgggttaaggtaccggaccggtacccgtccggtacgggacggtaccgtaccgggtttgtaacccggttcgaacgttcggacccggtcgggggtacccgtcgggtcccggtcccgtcgggtaccg

SEQ ID NO: 85882 - DNA, 806 bp, Homo sapiens
  misc_feature: GYAE6OF01BVWG4.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagagtgggtcctgtcccaggtcacctgcaggacgtcggccaggactggtgaacgccccgtcggacgaccctcggtccctctagtttcgacctacttggtcgtcgtacggacctcccgaacggttcaacgtagtacgttcggtttcctttcggtacgggggtcctcggggttcccgaccgtaaccggtccccgtaaggtaacgggtaacggggttccgtaggggtacggttagggtaaggttacggggtacggttacgtacgttaaaacgttaaacggttaacgggggtacgttacgtaagttacgttacgggtaggtacgtaccctaacctacccgtaactaacccgtaacccgtttacgtttaaggcgtacgtaacgtccgtaacttaacgtacgtcgtaaggttcgacccgtacgtccgtaccgaacgtaaacccgtcggtcctacccgtggaacgtagtcggaatcgttgtacggtccgacggtccgacgtacgacgtacgaccgtagttcttcgaggtcgacgggtaaccgaccggtacccggtagtacgtaccggaaccggtccgtgggtaaccgtcccgtaaaggttccggtaccgttacggacgtcccggttacggggtcggggttaccccgggtccggcccgggttaccccgtgggttaaccccg

SEQ ID NO: 85883 - DNA, 639 bp, Homo sapiens
  misc_feature: GYAE6OF01EMF6K.21.45.E01.1.454.CMB.1.raw
  modified_base (114)..(114): a, c, t, g, unknown or other
  misc_feature (114)..(114): n is a, c, g, or t
  modified_base (208)..(208): a, c, t, g, unknown or other
  misc_feature (208)..(208): n is a, c, g, or t
  modified_base (257)..(257): a, c, t, g, unknown or other
  misc_feature (257)..(257): n is a, c, g, or t
  modified_base (315)..(315): a, c, t, g, unknown or other
  misc_feature (315)..(315): n is a, c, g, or t
  modified_base (354)..(354): a, c, t, g, unknown or other
  misc_feature (354)..(354): n is a, c, g, or t
  modified_base (535)..(535): a, c, t, g, unknown or other
  misc_feature (535)..(535): n is a, c, g, or t
  modified_base (573)..(573): a, c, t, g, unknown or other
  misc_feature (573)..(573): n is a, c, g, or t
  modified_base (587)..(587): a, c, t, g, unknown or other
  misc_feature (587)..(587): n is a, c, g, or t
  modified_base (607)..(607): a, c, t, g, unknown or other
  misc_feature (607)..(607): n is a, c, g, or t
tcagtcgtcgctcgcacgaccggtgctcgatttagtgagtcagtaagggaaagggggctttcagagagtcatggacctcctgtgcaagaacatgaggcacctgtggtttttccncctgctggtggcagctcccagatgggtcctgtcccaggtccactgcaggagtccggcaggactggtgaacgccctgggactaccctgtcccttnactttggactactggttcgtactaggtacttcccgacctaccacgagtntttcggtcctttggacggggtcttggggtaccggctacgtcccgaggagtaaggttcnggacggtgtagtgggacgttgtctaagtaggtacggggntaccaagttgtcgttggcgtacactcccgttactaacctaccggttatttaacgagttcgatacctattatactcgtagtcggcctcgtagtaccaaccgggtaacctggtaaccttccgtaggacgggtattacggtaatctgtacgtggacccgacgacgagtacgacgactaacgttntttcgtaggtcgcgaagggtcaacccggtggttaaccncggacgtcgtaggngtacgtcgtaaggtctaggngtcggcgtcgggacgtcgccgtccgtgtaccg

SEQ ID NO: 85884 - DNA, 975 bp, Homo sapiens
  misc_feature: GYAE6OF01DMFLJ.21.45.E01.1.454.CMB.1.raw
  modified_base (241)..(241): a, c, t, g, unknown or other
  misc_feature (241)..(241): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctccagatgggtcctgtcccaggtccacctgcaggacgtcgggcccaggactggtgaagccctcggacgaccctgtccctcatttggcacttgtgtctgactccaccgtcacngtatggttcctgtgggctgggtccgcacgtcccagaggaaggtctggacgtggagtggtagtagtctaagtaagtacggggtatacgtaagtagttcggtggtacgactaccgtccctaacgtaccgtaaccgtttcttttaaggcgttacgtaacgtacctaacgttaattactaccgtaacggttcgtaccgtacgttaccggttacccgtaaacccggtaacccgtacgggttaccccttaccccggttaaggtaacgggttaacgtacgggtaacggtaacgtttaaccggtttcggggttaacccgggaaacccgggggtaccccggttaacccggaaaacccgggttaaaccccgggtaacccccgggggttaaacccctttaaaaaccggggttttttacgttttttaaacccccggttgggggtttaaccccgggtaacccgggggttaaaccggggtaaaccccccgggggtttaaacccccccggggtttaggggtttttaacccgggaaccccgggtttaaacccccggggtaaccccgggtttaacggggggaaccccgggttaaacccggttaaaccgggtttttaccgggggtttaaaaccccggtttacgggtaacccgggtttaaccggggtaccccccggggttttcggggggtaaccccggggttacccggtttcccccggggtacccccgggttttccggggtttaaacccccgg

SEQ ID NO: 85885 - DNA, 883 bp, Homo sapiens
  misc_feature: GYAE6OF01AFKG8.21.45.E01.1.454.CMB.1.raw
tcagtcgtcgctcgcacgaccggtgctcgatttagtgagtcagtaagggaaagggggcgtttcagagagtcatggacctcctgtgcaagaacatgaggcacctgtggtttttcctcctgctggtggcagcctccagagtcgggtcctcgtcccaggtccacctgccaggacggtcccgggcccgtaggaccgttggtacggaaccgccccgttacgggaccgacccgttcgtcccctctaacgtttgcctaccgttgttcgtcgttacgggtactcccgtaaccgtcactaggtacgttcggttccgtttcggcggggtacgttcgggtccggaccgtaccgtcccgaaggacggtacgggtccgttaggggacggtaggttacggtgggtaggttcgttacgtaaggtaaacggttcggggacttaacgtagttacgtaccgggttaggtaccgaccgtaaccgttaccccttacgtaaacccgttacccggttttacgttaaacgtacggttacgtacgtacttaacttaacgctaacggtgtaccggtcgtccgttacccgaccgtaaccgacccgtaccgttacccgtaccgtacggaaccgtggtaacggtattaccggttcgttacggtacggtaccggtacccggaccgtacccggaaccggtacccgtaccggtaagttttcgttaccgtagggttaccggacgggtaacccgtaccgggtaacccgttaacgggtaaccgtcccgggtacggcccgggtacgggaccggtacttcccgggtttaacgttaccggttcggtaccggttacccgggttccgggttaacgggggtcccggtaacccggtcccgggtaaccccggtcggttacccggg

SEQ ID NO: 85886 - DNA, 583 bp, Homo sapiens
  misc_feature: GYAE6OF01BTRSV.21.45.E01.1.454.CMB.1.raw
  modified_base (183)..(183): a, c, t, g, unknown or other
  misc_feature (183)..(183): n is a, c, g, or t
  modified_base (219)..(219): a, c, t, g, unknown or other
  misc_feature (219)..(219): n is a, c, g, or t
  modified_base (239)..(239): a, c, t, g, unknown or other
  misc_feature (239)..(239): n is a, c, g, or t
  modified_base (242)..(242): a, c, t, g, unknown or other
  misc_feature (242)..(242): n is a, c, g, or t
  modified_base (393)..(393): a, c, t, g, unknown or other
  misc_feature (393)..(393): n is a, c, g, or t
  modified_base (403)..(403): a, c, t, g, unknown or other
  misc_feature (403)..(403): n is a, c, g, or t
  modified_base (426)..(426): a, c, t, g, unknown or other
  misc_feature (426)..(426): n is a, c, g, or t
  modified_base (432)..(432): a, c, t, g, unknown or other
  misc_feature (432)..(432): n is a, c, g, or t
  modified_base (441)..(441): a, c, t, g, unknown or other
  misc_feature (441)..(441): n is a, c, g, or t
  modified_base (493)..(493): a, c, t, g, unknown or other
  misc_feature (493)..(493): n is a, c, g, or t
  modified_base (509)..(509): a, c, t, g, unknown or other
  misc_feature (509)..(509): n is a, c, g, or t
  modified_base (544)..(544): a, c, t, g, unknown or other
  misc_feature (544)..(544): n is a, c, g, or t
  modified_base (550)..(550): a, c, t, g, unknown or other
  misc_feature (550)..(550): n is a, c, g, or t
  modified_base (565)..(565): a, c, t, g, unknown or other
  misc_feature (565)..(565): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagcctcccagagtggtcctgtcccaggtccacctgcaggagcggcccaggacgtggngaacgcccgtcggacgccctcgtccctctatttgcnctgtgtctggatccacgcanagnttcggtctttttttcggggcgtggcggcacgccgagaggaggtctggagtggagttgggattcggtattagaagtacgggtatactaagttgtcggtgtgacacctccctagtaaccacccgtttagttacgagttacgatcaactatagnagtcgctacncgccacggaacctggtccctcgngaggtntgaccgtangttagcgaccgtcacgacgaccgcggtactaagttctttcgagtcgacgganaccggttacccggtanacggccgtcgtcgacggaggtccagttcggttaancggtcncggccggttgggcgngccgtcccggtgaacccg

SEQ ID NO: 85887 - DNA, 781 bp, Homo sapiens
  misc_feature: GYAE6OF01B8Y8A.21.45.E01.1.454.CMB.1.raw
  modified_base (112)..(112): a, c, t, g, unknown or other
  misc_feature (112)..(112): n is a, c, g, or t
  modified_base (337)..(337): a, c, t, g, unknown or other
  misc_feature (337)..(337): n is a, c, g, or t
tcagtcgtcgctcgcacgaccggtgctcgatttagtgagtcagtaagggaaagggggctttcagagagtcatggacctcctgtgcaagaacatgaggcactgtggttttccnctgcgtggtggcagctcccgagagtgggtcctcgtcccgaggtccacctgacgaggcggtccggcccaggacgtggtagaacgccccgtacgggacgtacccgtcgtccctcgtattcgcctagttggtcgtacgtcggtacctacccaccgtcacgtagtcgttcggttccttggcgggtcggtcggggtacccgcgaccgtaccgaggtaaggtacggtcggnggtaggtggtacggtgggtacgtgtagtaaggtaaggtacggggtaatacgtaagttacgttggtacggtacgtactaccccgtacctaacgttaaccctaaccggtttaacgtttaacgacggttaacgtacgtaacctagttaacgttaacgtcgtacgggtacgtacccggtacttcccggtaaaccgtaacccgtaaccggtaccggtcccgtaccggtacggaagtgtaacggacgttacacggtttacgggcggtacccgggtaccgacgaccggtaaccgaccggtacgttacgttacttcggtacgtcgaccgggtacggaacccgggtcgtaacggtaccggacgtccgggcgtaggaccgtacgggtacgttacggtacctagggccgtcgggtaccggcggggttccgtaccgggtccggtccgtgtaaccgg

SEQ ID NO: 85888 - DNA, 773 bp, Homo sapiens
  misc_feature: GYAE6OF01AGMNJ.21.45.E01.1.454.CMB.1.raw
  modified_base (139)..(139): a, c, t, g, unknown or other
  misc_feature (139)..(139): n is a, c, g, or t
  modified_base (305)..(305): a, c, t, g, unknown or other
  misc_feature (305)..(305): n is a, c, g, or t
tcagtcgtcgctcgcacgaccggtgctcgatttagtgagtcagtaagggaaaggggctttcagagagtcatggacctcctgtgcaagaacatgaggcctacctgttggtttttcctcctgtctggtgcagcctaccagngtcggtcctcgtcccgagtcccaccgtgacgaggtacggtccgggacccgtaggacgttggtacgaaccgtccccgttacggaaccgttcccgttccgttccccgttagtacgtttccgacctacgttggttcgttccgtacggtacctccccgtaccgtaccganaacgttcgtttcggtttcccgttcggtcgggtccgttaccgggccgaccgtaccggtacccgaggtaacggtacggttcggtagggtacgttggtaggttacgggtagtcggtaacgtaaggtaacggtacgggatacgtagtcgtcggtgtacgacctaccgtacctaacgtaccgtaacgtttacgttaagcgtactagtacctacgttagtctaggtagtccgtacgttacgtacccgtaaccgaccgtacggttcctaccgtacgtaacggtgtacgtaagtcgtacgttacgtacggtacggacggtccgaacgtacggtaaccgtaccgtacgttaagttaccgttcgtacggtacgacggtaccggtaccggttaacgtacgtacgacgtccgtggaccgtacgtacgttacggtacgttacgcgttacgcggtaacggcggtacctcgcgtcgtagtccg

SEQ ID NO: 85889 - DNA, 885 bp, Homo sapiens
  misc_feature: GYAE6OF01ETVQU.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtcccacctgcaggagtccgggcccaggacgtggtgaacgccccgtcggacgaccctcgtccctctagtttcgctacgttgtgtcgtggtactcccgaccgtcaacgagtacgttcggtttcccgttcggtcgggggtaccgttcgggggtcccggtaccgtaccggtacccccgaagggtaacggtaacggggtcgtaggggtacggttagggtaggtttggggtagttacgtacgttaaggttaacgggtacgggggtacgtacgtaacgttaggttccgggttagggtacgtaacctaacccgttaccccgttaacgttaaccccgttaaacccgtttacgttttaaaacggaccgttacggtaaccgttaccgtaactttaacgttacgtacgtacgttacggccgtaccgtcccggaaccccgtaaccggtaacccgtaccggtccccgttacccgtagggtaacgtaacggtacggaacggtacgttccggttagggacccgggtacccgggtcccgaacggacgtaacccggaccggttaacccgtaagtttccgttcggtaggtccggtaacggtaaccggtacccgggtaacccgttaaggtaccggaccggtaccggtaccggttagggaccggtaccgtacggttaccggttaaccggttccggaacggttccgggaccgggttcccggggtcgacccgggtcccgtcccggttcggtacccg

SEQ ID NO: 85890 - DNA, 820 bp, Homo sapiens
  misc_feature: GYAE6OF01CA7JL.21.45.E01.1.454.CMB.1.raw
  modified_base (113)..(113): a, c, t, g, unknown or other
  misc_feature (113)..(113): n is a, c, g, or t
  modified_base (133)..(133): a, c, t, g, unknown or other
  misc_feature (133)..(133): n is a, c, g, or t
  modified_base (202)..(202): a, c, t, g, unknown or other
  misc_feature (202)..(202): n is a, c, g, or t
tcagtcgtcgctcgcacgaccggtgctcgatttagtgagtcagtaagggaaagggggctttcagagagtcatggacctcctgtgcaagaacatgaggcacctgtgtttttccncctgctggtgcagctccagngtcggtcctcgtcccaggtcccaccgtgcgaggagtccggcccaggactggtagaacgccccgtggacncccgttcgtccctcagtttcgctacgtgtgtctggactcccgacgtcacgtagtacgttcggttaccttcggtaggggtccgttcgggtcccggtaccgtaccggtacccccgaaggtaacgggtaacgggttcccgtagggtacggttagggtacggtttagggggtacgttggttaccgtaaggtttaaacggtaaccggggggtacgtttaaccggtaaggtttaaccggtcgggtttcggtaacggtacccgtaaccctttacccccgttaaccgttaaacccgtaaacccccgttttaacgttttaaacggacggttacgtaacgttaccgtaactttaagttactacgtaaggtccgtccgttaccgttcccggtacccgaaccgtaacccggtaaccgtttcccgtacccgagggtaacggagtcggaacgtacgttcgtgggacgccgcgaaccgagacccgacgtacggtaacgttgttacgtggtcgaggaccggtacggacccggtggtacgccggcggtacgcggagtacccgtaggtcggtaccgtaggtccgttcggacccgggttccggggcccgtcgggacccgttcccggtaggttccccg

SEQ ID NO: 85891 - DNA, 901 bp, Homo sapiens
  misc_feature: GYAE6OF01D4VLF.21.45.E01.1.454.CMB.1.raw
  modified_base (215)..(215): a, c, t, g, unknown or other
  misc_feature (215)..(215): n is a, c, g, or t
tcagtcgtcgctcgcacgaccggtgctcgatttagtgagtcagtaagggaaagggggctttcagagagtcatggacctcctgtgcaagaacatgaggcacctgtggttttcctcctgctggtgcagctccagatggtcctgtcccaggtccacctgcaggagtccgggacccaggtactggtacgaacgcccgtacggacgtaccctgtcccctntaatttcgactacgtgtcgtcgtggactcccaccgtacactaggtacttcggtttacctcggtggggtcgttcgggtccggtaccgtaccgtaccccgaaggacggtaacgggtcgtcgggtaaggtggtacggttggggtaagttcgtaacgttaaggtaacgggttacgggggtaattacgtaagtacggttcggtagggtaccaaccttaccctaccccgttaaaccgtaaacccgttaaaccccggttttaacgttttaacggaacgtttaccggtaacgtaaccttaacgtaacttaaactcggtaacggttcggtacccgttaccgttaacccgttacccgaaacccggtaaacccgggttaccggttaccccgttacccggttaagggaacgttacgtaacgggtaacgtacgttacgtacgggtaccgacccgggtaccggaccgtaaaccggaacccgaaccggttaaccgttaaacggtttacctttcccggttagggtaccgggtaaccggtaaccgggtaacccggtaaccccggggttaaggtcccggaccggtacccggtacggtaccgggtaacggtacccggttaacggtttaccggttaccgttacggtaccggtccggtacccgggtggggtaccccggtcggtccccggttaccgttcgggtacccg

SEQ ID NO: 85892 - DNA, 626 bp, Homo sapiens
  misc_feature: GYAE6OF01CPYG3.21.45.E01.1.454.CMB.1.raw
  modified_base (209)..(209): a, c, t, g, unknown or other
  misc_feature (209)..(209): n is a, c, g, or t
  modified_base (224)..(224): a, c, t, g, unknown or other
  misc_feature (224)..(224): n is a, c, g, or t
  modified_base (237)..(237): a, c, t, g, unknown or other
  misc_feature (237)..(237): n is a, c, g, or t
  modified_base (285)..(285): a, c, t, g, unknown or other
  misc_feature (285)..(285): n is a, c, g, or t
  modified_base (326)..(326): a, c, t, g, unknown or other
  misc_feature (326)..(326): n is a, c, g, or t
  modified_base (444)..(444): a, c, t, g, unknown or other
  misc_feature (444)..(444): n is a, c, g, or t
  modified_base (456)..(456): a, c, t, g, unknown or other
  misc_feature (456)..(456): n is a, c, g, or t
tcagtcgtcgctcgcacgaccggtgctcgatttagtgagtcagtaagggaaagggggctttcagagagtcatggacctcctgtgcaagaacatgaggcacctgtggttttcctcctgctggtggcagcctcccagatgggtcctgtcccaggtccacctgcaggagtccgggcccaggacctggtgaagccctggacaccctgcccctnatttgcactgtgtcnggtatccaccgtnacagtactggttacctgtggggctggtccggcagtcccagagaggtcnggagtgagtggagtgtacgtaataagtacgggagtcaactntcggtaggtagacctaccgtaccctactaccacccgttctttaacgacgttcgagttccattatacgtcagtacgcgcgtcgtccaacgtaccagtccttcccgagagactgagatgngtcgaccggccnaacgaccaacggcccaaagtttacctttcgagtacccggacgtagaccgtaacccgggtatttacgacccggaagtccgttacggggagttcccgcgtttaccgggtactttaccggcgttccggaacccggtcggggtacccggtcggaccggccccgttcggtacccg

SEQ ID NO: 85893 - DNA, 702 bp, Homo sapiens
  misc_feature: GYAE6OF01EIQOW.21.45.E01.1.454.CMB.1.raw
  modified_base (196)..(196): a, c, t, g, unknown or other
  misc_feature (196)..(196): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactgggtgaagccctgganaccctgtccctcatttgcactgtgtctggacttcccaccgttcaacagtatggttccttcgtggggctgggtccgcacgtcccagagaggtctggagtggagttgggagtgtactagtaagtacggggtagtcgaagtacgtcggtggtagacctaccgtcccctaactaacccgtaacccgttacttttaaacggagtacgtagtactaactaatactacagtcgacgtcgtaccgtaccaaccggaacctacgggtcccttaccccgtaggtaggtacttaggaagtacgttcgtacggtacgggaccggtcccgaccgaacggaacccgacggtacccgtaagttactttcgtagtcgacgtaaggacccggtacccgggtaaggttaccggccggtacgtaccgtaggggaacgtaccgtacggttacgggttacgttccgacgttcggacccgggttcgggggtcccggttacgggccccggttcccggttcgggtacccg

SEQ ID NO: 85894 - DNA, 830 bp, Homo sapiens
  misc_feature: GYAE6OF01CA3UH.21.45.E01.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagagtgggtcctgtcccaggtccacctgcaggagtccgggcccaggactggtagaacgccccgtcggacgtacccctcgtcccctntagtttcgctactgtgtcgtggactcccgaccgtcaacgagtagttcggtttccgttcggtgggggtccgttggggttcccggaccgtaccggttacccccgaaggtaacgggtaaaggggttccgtaggggaaggttggtaaggtttgggggagttggttaaccgttaaggttaaaacggtaccggggagttaaccgtaaagttagttaccggtaggttacgaaccgtaacccttaccccgttaacttaaacccgtaaccccggtttacgttttaaacggacgttacgaacgttacctaacttaattacgtacgagttcgccgtaccgttccgtacccgtaaccgaacccgtacggttcccttacccgttagggaacgtacgttaggaacgttacgtacggttcggtacggacccgggtacccgacgaacgtaacccgaccggtaaccttaaggttactttcggtacgtacggacgtaacggtaccggaacccggtaggttacgaccggtacccgtaccggtacgggacgaccgtacggttaccggttacgttcggacggtccgtaccgggttcggggcccggtacgggcccgtcccggttgggtacccg

SEQ ID NO: 85895 - DNA, 1029 bp, Homo sapiens
  misc_feature: GYAE6OF01DTZWJ.21.45.E01.1.454.CMB.1.raw
  modified_base (114)..(114): a, c, t, g, unknown or other
  misc_feature (114)..(114): n is a, c, g, or t
  modified_base (192)..(192): a, c, t, g, unknown or other
  misc_feature (192)..(192): n is a, c, g, or t
tcagtcgtcgctcgcacgaccggtgctcgatttagtgagtcagtaagggaaagggggctttcagagagtcatggacctcctgtgcaagaacatgaggcacctgtcggttttccncctgctggtgcagctccagagtgggtcctgtacccgaggtacccacctggacagggacgtcgggacccaggacctggngaacgcccctggaacgtccctggtcccctagtaactttggacctacgttgtacggttcctacgggtaaccttccccgaccggttacaacgtaacggtacgtttccgggttttcccgttaccggtcggggggtaacgtcgggggttacccccggttacgaaacccgggttccccccgtaaaaggggaaccgggtaaaacgggggtttccctaacgggggtaaacgggttcgggtaaaggttttaggggggaaccgttttacggggttaacctttaaaaaccggttaaaaaggggtaaccgggggggttaactttaacccggtaaaaagtttacgggttccgggttaaggtaccgggtaaacccctaaacctttaccccccggttaaaactaacccgttaaaaccccggttttaccggttttttaaaaggacccggttaccgggaaacgtttaaccctaaacggtttaaattaccgttaccgaaacggggtttcggtaaccccgggacctttaccgggaaaccccgttaaaccgggtaaacccgtaacgggttacccgttccccggtttaagacgggttaacgtacggtaacgtaacgtacgtcgtacggaaccgggtaccgacgtaacgtaaccgaaccggtaccttaaagttacgttacgtggtaacggaccggtaacggtaccggaaccccgggttaagttacggaccggtaaccgtaccggtacgggtaaccggtcgtaaccgggttacggtaaccgttacggaaacccggttcggaacccgggtttacgggggacccgttacgggtaaccccggtcccggttacggttaacccg

SEQ ID NO: 85896 - DNA, 810 bp, Homo sapiens
  misc_feature: GYAE6OF01EK8NT.21.45.E01.1.454.CMB.1.raw
  modified_base (275)..(275): a, c, t, g, unknown or other
  misc_feature (275)..(275): n is a, c, g, or t
  modified_base (355)..(355): a, c, t, g, unknown or other
  misc_feature (355)..(355): n is a, c, g, or t
  modified_base (409)..(409): a, c, t, g, unknown or other
  misc_feature (409)..(409): n is a, c, g, or t
  modified_base (474)..(474): a, c, t, g, unknown or other
  misc_feature (474)..(474): n is a, c, g, or t
tcagtcgtcgctcgcacgaccggtgctcgatttagtgagtcagtaagggaaaggggctttcagagagtcatggacctcctgtgacaagaacatgaggcacctgttcggtttttcctcgtgcgtggtggcagcctccgagagtcggtcctcgtcccaggtcccactgcgaggtacgtccggaccgtaggaccgtggtacgacgccccgtacggaacgtaccccgttcgtccctagtaagtttcgccgtagttcgtgtcgtcggacctccgaccgtnaacgtagtagttccggtttcgttggtaccggggtccgtacggggtacccgcgtaccgtacccgtaggacggtacgggttntacgggtagttcggagttgggtacgttcgtaacggtaagttaagggacggttanaccgttaagtacgttcggaggttacgaccctaccgttaacccgtaatacccgtaaacccggtttntttaaacggaccgttggaaaccttcgtaagttattaacgtcggaacgttcgacccgttcgtacccggttaccaaccgtaacccgttcgttacccggtactacggacgtacgtagtacgtagtacgtcggtaacggtccggacgaccgtacggaaccgtaccgtaacgttacttacgttcgacggttaccgacgggtacccgaaccgggttccgtaaccggtaccggtacgtaccggtaccggtacgtaaccggtccgttaaccgggttcggttaacccgtcggtaccgtcgggttaaccggtccggtcggtaccccggtcggttaccgcggttacg

SEQ ID NO: 85897 - DNA, 941 bp, Homo sapiens
  misc_feature: GYAE6OF01BT3YG.21.45.E01.1.454.CMB.1.raw
  modified_base (239)..(239): a, c, t, g, unknown or other
  misc_feature (239)..(239): n is a, c, g, or t
tcagtcgtcgctcgcacgaccggtgctcgatttagtgagtcagtaagggaaagggggctttcagagagtcatggacctcctgtgcaagaacatgaggcacctgttggtttttcctcctgctggtggcagcctcccagagtcgggtcctgtcccaggtcccacctgcgagggacggtcccgggcccgagggacgtgggtacgaacggtccccgtacgggaccgtacccgtcgtccccttntacgtttcgacctacgttggtcgttccgtacggtacctaccccgtaaccgtaccacgtacggttcgtttccggtttcccgtttcggggtcgggggtccggttccggggtccggacctaccggtacccgaaggacgggtacgggtacggtggtaggtaggtaggttagggtgttacgttagttaagttaacgggtaacggggtacgtacgtaaggttacgtcggttacggtacgtaccctaacccgttaccccgtaaccgttaaacccttaacccggtttaacgttttaacggaaccggttaccgtaacgtaaccttaacttaactaacgtacgtacggtcgtccgtacccgttccgtaaccccggtaaccgtaacccggtaccgttaccctaccggggggggggtactacgggtacgtacgtaacgtcgttcgtacggtaccggtaccggaccgaccgtaaccggtaccgaaccggttaccgttaaacgtttacgtttacggttacggtaccgggtaccgggtaaaccggtacccgggtaaaccccgggttacgggttaacccggacccgggtaccgtaccgggtacgggtaccggtccgtaccgggtttacggttacccggttacggtacccggttaccggggtcccggggttccggggtcccgggtacccgggttcccggtccgggtccgggttacccgg

SEQ ID NO: 85898 - DNA, 885 bp, Homo sapiens
  misc_feature: GYAE6OF01A50OX.21.45.E01.1.454.CMB.1.raw
  modified_base (245)..(245): a, c, t, g, unknown or other
  misc_feature (245)..(245): n is a, c, g, or t
tcagtcgtcgctcgcacgaccggtgctcgatttagtgagtcagtaagggaaagggggctttcagagagtcatggacctcctgtgcaagaacatgagcacctgtggtttttcctcctgctggtggcagctcccagatgggtcctgtcccaggtccacctgcaggacgtcgggcccaggactggtcgaagccctggacgtaccctcgtccctctatttcgctactgtcgtctggactccgaccgtanaccagtagttcggttccttggtcggggtcctcggggtcccggtcgaccggttcccccgaaggaacggaaacggggttccgtagggtaggttcgggaggtttacggggtagtttcggtaacgttaaggttaaacggttaaccgggggagttaccgaaacgttacgttcgggtagggttacgaaccgtaaccctttacccctaaccgttaaacccgtaaccccgttttacgttttaaaacggacgttacgtaacgttacctaactttaaacgttaactacgtaacggttacgtaccgtacgttacccggtaccccaaaccggtaacccgtacggttacccttaccccggttaggaaacggttacgttaggaaacgtacgtttaccggttacggtacgggaacccgggcccgtaccgaaacgggtaaacccaacccgggtaaccgttaaaggtttaacttttcggtaggtaccggacgggtaacggtaacccggaaccccggtttaggttaaccgccgggaccgtacccggtagggaaccggtacgtaccggtttacgggttaaccctttcgggtaacgttccgggtcccgggttaccggggggtacccgttggggaccccgtcccgggtttacggtaccccg

SEQ ID NO: 85899 - DNA, 854 bp, Homo sapiens
  misc_feature: GYAE6OF01EJLT6.21.45.E01.1.454.CMB.1.raw
  modified_base (113)..(113): a, c, t, g, unknown or other
  misc_feature (113)..(113): n is a, c, g, or t
  modified_base (232)..(232): a, c, t, g, unknown or other
  misc_feature (232)..(232): n is a, c, g, or t
tcagtcgtcgctcgcacgaccggtgctcgatttagtgagtcagtaagggaaagggggctttcagagagtcatggacctcctgtgcaagaacatgaggcacctgtggttttccnctgctggtgcagcctaccagtatcgggtcctgtcccaggtcccactgacgaggacggtccgggacccagggtactgggtagaaccgccccgtagggaccgtaccccgtcgttacccctnttagtttcggacctacttggtcgtcgtacggaccctacccgtacccggtcaacgtaggttaccgttcgggtttccttcggggtcgggggtccgtcggggtaacccggcctaacccggtacccgaagggtaacgggtaacgggttccgtagggtacggttgggtacggttcggggtagttcggttactaaaggtaacgggttacgggggtaaactacgtaaacggttcgttacgggttggtaacgtaccttaacccgttacccctaaaccggttaaccctaacccggttttaacgtttaaacggcgttaacgtacgtactaacgtaactacgtacggtagtccgccgttaccgtaccgtacccggaacgtaacccggttaccgttccccgtacggtagggtaacgtataacgggtactcgttcggtacgtaccgaccggcgtaacgacgaaccgtacccggtaacgttagtttacgtccgtacgtacggaccggtaacggaccccggttaaccggtacgtaccggtccggacccggtggtacggaaccgtcgtaacggttactacggttacgccgttacgggcccgggtagggtccccggtacggtcccgtcgtcggtacccg

SEQ ID NO: 85900 - DNA, 880 bp, Homo sapiens
  misc_feature: GYAE6OF01EYMXL.21.45.E01.1.454.CMB.1.raw
  modified_base (114)..(114): a, c, t, g, unknown or other
  misc_feature (114)..(114): n is a, c, g, or t
tcagtcgtcgctcgcacgaccggtgctcgatttagtgagtcagtaagggaaagggggctttcagagagtcatggacctcctgtgcaagaacatgaggcacctgtggtttttccncctgctggtggcagctcccagactgggtcctgtcccaggtccacctgcaggagtcgggcccaggactggtgaacgccctggacgaccctgtcccctgactttgcactgtcgtcgtggacctccaccgtcacgtagtacgttcggtttccttcggtcgggggaccgttcggggttcccggccgtacgtacccccgaggaaggtaacgggttccgtaggaggttagggtaggtttaggggtagttcggttaacgttaacggtaaacgttaacgggggtacgttacgtaaagttagtaccgggttagggtacgaaccgtaccgttacccttaaccgtaacccgtaaacccgtttaccgttttaaacgtacggttaacgtaacgttaccgtaacttaacgttacgtaccgtaggtccgtacggtccgttaccggtaccccgaacggtaaacccggtacggttacccttaccccggttacgggaacggttaacggtaggtaacggtaccgttcgtacggtacgggaacccgggtacccgtacgtaaccggaacccgtaaaccgggtacccgtttaaacggtttaacgttttccgtaacggttacccggaccgggtaacggtaacccggtaaccccgggttaggtttaccgggcccggtaaccggtcccggttaccggacggtccggtaacggttacggttaccggttcggtacgtccgggtacccggtcgggggtacccggtaggtaccccgggtccgttcgggtaacccg

SEQ ID NO: 85901 - DNA, 821 bp, Homo sapiens
  misc_feature: GYAE6OF01EX62U.21.45.E01.1.454.CMB.1.raw
  modified_base (209)..(209): a, c, t, g, unknown or other
  misc_feature (209)..(209): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaacgccctggacgaccctgtccctntatttgctactgtgtctggactcccgaccgtcacgagtattcgggttccttggtcgggggcttcggggtcccggcgtaccggtccccgaggaacggaagggtccgtgggaggtgggtagttggggtagttcgtacgtaagttaacggtacgggggagtacgtaaagtacgtcggtaggtacgtaaccgtaccttacccgtaactaaccgtaaacccgtttacgttttaaacggacgtacgtagtacctaacttaacgtactacgtaacgtcggaccggtccgttaccggtacccgtaaccggtaacccgtacggttcccgttaccccggtaggtaacggtagtacggtaacgtacgttacgttaggtaccgggtaccgggccgtaacgaacgtaacccggaccgtaacccggtaaacgttcgttttacgtcgggttaccggtacgggtaaccggtaacccggtacccggggttaacggtaccgggtacccggaccggtcccggtacggggaaccggttaccggtaccggttacgggttacccgttcgggtaacgttccgggtacccgggttcgggggcccgttacgggccccgttcccgggtcggttacccg

SEQ ID NO: 85902 - DNA, 563 bp, Homo sapiens
  misc_feature: GYAE6OF02GPWN9.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggatccaccgtcacagatggttccttcgtggggctgggtccggcacgtccccagagaagggtctggagtggagttgggagtgtctagtaagtacggggagtcaatatcgtggtgacactccctactacaaccgtcttttaagagtcgagtcactatatcagtgcgctcgtccacgaaccagtcctccctgaggatgagatctgtgaccggccgcacgaccacggacctaagttactttcgtggtcgacgagacgaccccggtagttacgcgacgccgtagggacggcgacgtggtaccgttcgagtcgccggtggggccgtgggccgtcccgtggtaccg

SEQ ID NO: 85903 - DNA, 536 bp, Homo sapiens
  misc_feature: GYAE6OF02IGFTR.21.45.E01.1.454.CMB.1.raw
  modified_base (252)..(252): a, c, t, g, unknown or other
  misc_feature (252)..(252): n is a, c, g, or t
  modified_base (438)..(438): a, c, t, g, unknown or other
  misc_feature (438)..(438): n is a, c, g, or t
  modified_base (455)..(455): a, c, t, g, unknown or other
  misc_feature (455)..(455): n is a, c, g, or t
  modified_base (460)..(460): a, c, t, g, unknown or other
  misc_feature (460)..(460): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggatccaccgtcacagatggttccttcgnggggctgggtccggcagtccccagagaagggtctggagtggattggggagtgtctaataagtacgggggagtcaatagtcgtggtgacactccctaactacaacccgtctttaagagtcgagtcactatatcagtgcgctcgtccacgaaccaggtctccctgaggatgagatctgtgacggccgnagaccacggccaaagtntttcngtgcgagacgacccggagttacgcgacgctggaggcacgtgtactcgatgccgtggggccgtggcgcccgtggtcc

SEQ ID NO: 85904 - DNA, 549 bp, Homo sapiens
  misc_feature: GYAE6OF02F7TV8.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggatccaccgtcacagatggttccttcgtggggctgggtccggcacgtccccagagaagggtctggagtggattgggagtgtctagtaagtacggggagtcaatatcgtggtgacactccctactacaaccgtctttaagagtcgagtcaactatatcagtgcgtctcgtccaacgaaccacggtcctccctgaggatgagatcgtgtgacggccgcagacgacgaccaagttacttcgtgtgcgagacgacccggtagttacgcgacgccgtggacggcacgtggtactcgagtcggccgtcggggccgtggccgtccgtggtcc

SEQ ID NO: 85905 - DNA, 641 bp, Homo sapiens
  misc_feature: GYAE6OF02FIEKP.21.45.E01.1.454.CMB.1.raw
  modified_base (239)..(239): a, c, t, g, unknown or other
  misc_feature (239)..(239): n is a, c, g, or t
  modified_base (279)..(279): a, c, t, g, unknown or other
  misc_feature (279)..(279): n is a, c, g, or t
  modified_base (356)..(356): a, c, t, g, unknown or other
  misc_feature (356)..(356): n is a, c, g, or t
  modified_base (364)..(364): a, c, t, g, unknown or other
  misc_feature (364)..(364): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtcctggatccaccgtcacngatggttccttcgtggggctggggtccggcagtccccagngaagggtctggagtggattgggatgtctataatacgggagtcaatatcgtggtgacactccctactacaacccgttntttaacgngtcgagtcactatatcagtcgcgctccgtccacgaacccaggtctccctgacggtatgagactcgtgtagaccggtccgctaacgaccgacggccctaaaggttacttttcctggttcgaccgtaacggtaccggtaacccccgggtaagtttaaacggccgaaccggtcccgttagggacggccgtaaccgttcgggttaaccctttccggaacgttcgggtcccggttacgggggggtccccgttcggggtcccggtccccgttagggttacccg

SEQ ID NO: 85906 - DNA, 548 bp, Homo sapiens
  misc_feature: GYAE6OF02GHSL5.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggatccaccgtcacagatggttccttcgtggggctgggtccgcacgtccccagagaagggtctggagtggattgggagtgtctataagtacggggagtcaatatcgtggtgacactccctactacaaccgtctttaagagtcgagtcactatatcagtgcgctcgtcccaacgaaccaggtcctccctgacggatgagattcgtgtcgaccggccgacaggacacggcaagttattcgtgtcgcgacgacgacccggtagtacgcgaccgcgtaggacgcacgtcggtactcgactggccgtgggccgtggccgtcccgtggtcc

SEQ ID NO: 85907 - DNA, 530 bp, Homo sapiens
  misc_feature: GYAE6OF02FFS6W.21.45.E01.1.454.CMB.1.raw
  modified_base (287)..(287): a, c, t, g, unknown or other
  misc_feature (287)..(287): n is a, c, g, or t
tcagtcgtcgctcgcacgaccggtgctcgatttagtgagtcagtaagggaaaggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggatccaccgtcacagatggttccttcgtggggctgggtccggcagtcccagagaagggtctggngtggattgggagtgtctataatacggggatcaatatcgtggtgacactcccgtactacaaccgttcttttaagagtcgagtctactatatcagtgcgctcgtccacgaaccaggtctccctgaggatgagatctgtgacggccgcagacacgccaagtatttctgtgcgagacgaccccgagtagcgacgcctggagcgacgtggtacttcgatgccgtggggccgtgggccgccgtggtccg

SEQ ID NO: 85908 - DNA, 637 bp, Homo sapiens
  misc_feature: GYAE6OF02HVP30.21.45.E01.1.454.CMB.1.raw
  modified_base (434)..(434): a, c, t, g, unknown or other
  misc_feature (434)..(434): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggatccacgtcacagatcggttccttcgtggggctgggtccggcacgtcccagagaagggtctggagtggattggggagtgtctaagtaagtacggggatcaatatcgtggtgacactcctactaccaaccgttcttttaaagcgtacgacgtcaacgttatactcagtcgcgcttccgtccacgaaccaggtctcccgtggacggatganatctggtgaccggtccacgacggaccacgggtacccaaagtttactttcgtaggtcggtacggaacgtaccgggaccccggttagggttacgaccggtaacgtccggtgggaacgggtacctaccggtttacgggttaaccttccggaagttcggacccggttcggggggacccgtcggggaccccgtcccggttgggtaccc

SEQ ID NO: 85909 - DNA, 923 bp, Homo sapiens
  misc_feature: GYAE6OF02GC6CQ.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggttttcctcctgctggtggcagctcccagatgggtcctgtcccaggtccacctgcaggagtcgggcccaggactggtgaacgcccgtcggacgaccctgtcccctattgtcgactacgtgtcgtcgtacgtcctaccgtaccgacacgagtcggttccgtttccgtcggggtcggtcgggtccggggtccgacgtaccccgtaccggaaggtaacgggtacggttcggtagggtagggtacggttaggggtagggtacggttacgttaacgttaaaggtaacgggggtaacgggtacgtaacgtaacggttacggttagggttacggtaccgtaacccttaccccgttaacccttaaccgtaaaccccggttaccgttttaacggttaacgtacggtacgtaacgtaccttaacgtttactacgtacgtacggtaccggtccgttaccgtaccgtaacccgaaacccgtaccggttccgttccccgttaggaagggtaacgttacggaacggtaacttccgttcggggtacggaccccggggccgtacgaacggaaacccggtaccgggaacccgttaaacgtttagtttttcctaggggacgtacccgggaacggtaaacccgggaacccccgggttaagggttttaaggccccgggaacccgggtcccgttacggggggaacggggtacccttaacccgggtttaacgggggtttaaccctttaccgggtaaccgtccggggttccccgggttacccgggggggttcccgggttccgggcccccggttacccccgggttttgggtacccgtacccg

SEQ ID NO: 85910 - DNA, 535 bp, Homo sapiens
  misc_feature: GYAE6OF02G1JTO.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggatccaccgtcacagatggttccttctggggctgggtccggcacgtccccagagaagggtctggagtggattgggagtgtctagtaatacggggagtcaatatcgtggtgacactccctactacaacccgtcttttaagagtcgagtcactatatcagtgcgctcgtccacgaaccaggtcctccctgacggatgagtatctgtgacggccgcagacacgcaagttattcgtgtgcgagacgacccggagttacgcgacgcctggaggcgacgtggtactcgatgccgtgggccgtggccgccgtggtccg

SEQ ID NO: 85911 - DNA, 537 bp, Homo sapiens
  misc_feature: GYAE6OF02GX7P5.21.45.E01.1.454.CMB.1.raw
  modified_base (362)..(362): a, c, t, g, unknown or other
  misc_feature (362)..(362): n is a, c, g, or t
  modified_base (444)..(444): a, c, t, g, unknown or other
  misc_feature (444)..(444): n is a, c, g, or t
  modified_base (450)..(450): a, c, t, g, unknown or other
  misc_feature (450)..(450): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggatccaccgtcacagatggttccttctggggctgggtccggcagtccccagagaagggtctggagtggattgggagtgtctataagtacgggagtcaatatcgtggtgacactccctactacaacccgttctttaagngtcgagtcactatatcagtgcgctcgtccacgaccagtctccctgacggatgagatctgtgacggcgcagacacggcaagtntttcgngtgcgagacgacccggagttacgcgacgccgtggaggcacgtaggttactcgagtcgccgtcgggccgtcggccgtcccgtggtacc

SEQ ID NO: 85912 - DNA, 666 bp, Homo sapiens
  misc_feature: GYAE6OF02HN8A9.21.45.E01.1.454.CMB.1.raw
  modified_base (373)..(373): a, c, t, g, unknown or other
  misc_feature (373)..(373): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggactccaccgtcacagatcggttccttgtggggctcggggtccggcagtccccaggaggaagggtctgggagtggagttggggagtgtactataagtacgggggagtacaatagtcgtggtgactactccctaactactaaccccgttntttaaagcgtcgagtcactatatcagtgacgctcgtaccacgaaccgtaggtcctcccgtgacggattagagtactcgtggtcgaccggtccgacagaccgacggacctaaggttactttcgtagttgacggtaggaaccggtaaccccggtaggttaacggaccgtaccggtccgtaggggaaccgggtcctaaaccggttcgggttaaccgtttcggaacgtttccgggacccgggttacgggggggccccgttccggggggtacccgttccccgggtacgggttacccgg

SEQ ID NO: 85913 - DNA, 558 bp, Homo sapiens
  misc_feature: GYAE6OF02IELR9.21.45.E01.1.454.CMB.1.raw
  modified_base (349)..(349): a, c, t, g, unknown or other
  misc_feature (349)..(349): n is a, c, g, or t
  modified_base (446)..(446): a, c, t, g, unknown or other
  misc_feature (446)..(446): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggatccacgtcacagatggttccttgtggggctggggtccgcagtccccagagaaggtctggagtggattgggagtgtctataagtacggggatcaatatgtggtgacactccctatacaaccgtntttaacgagtcgagtcaactatatcagtgcgctcgtccacgaaccaggtcctccctgagactgagctctgtcgacggccacacgacacggcaagttnttctgtcgacgaggacgacccggtagtacgacgacgtcctgggacggccgtaattcgggtaacttcggactacggccggtacggggccgtcgggcccgtcccgtggtacccg

SEQ ID NO: 85914 - DNA, 553 bp, Homo sapiens
  misc_feature: GYAE6OF02FVU2G.21.45.E01.1.454.CMB.1.raw
  modified_base (282)..(282): a, c, t, g, unknown or other
  misc_feature (282)..(282): n is a, c, g, or t
  modified_base (406)..(406): a, c, t, g, unknown or other
  misc_feature (406)..(406): n is a, c, g, or t
  modified_base (453)..(453): a, c, t, g, unknown or other
  misc_feature (453)..(453): n is a, c, g, or t
tcagtcgtcgctcgcacgaccggtgctcgatttagtgagtcagtaagggaaagggggctttcagagagtcatggacctcctgtgcaagaacatgaggcacctgtggttttcctcctgctggtggcagctcccagatgggtcctgtcccaggtccacctgcaggagtcggcccaggactggtgaagccctcggagaccctgtccctcatttgcactgtgtctggatccaccgtcacagatggttccttcgtggggctgggtccgcagtccccagagaaggtcnggagtggattgggagtgtctagtaagtacggggagtcaatagtcgtggtgacactccctataccaccgtctttaagagtcgagtcactatatcagtgcgctcgtccacgaacctaggtctccgngacgatgagatctgtcgacggccgcacgcacggcctaagtctttcgngtcgacgagaccggacccggtagttacggccgacgtccgtgggacggtacacgtggtacttcgattcggacgtcggggaccgtggccgcccgtggtaccg

SEQ ID NO: 85915 - DNA, 586 bp, Homo sapiens
  misc_feature: GYAE6OF02H8X7M.21.45.E01.1.454.CMB.1.raw
  modified_base (209)..(209): a, c, t, g, unknown or other
  misc_feature (209)..(209): n is a, c, g, or t
  modified_base (444)..(444): a, c, t, g, unknown or other
  misc_feature (444)..(444): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctctgctggtggcagctccagatgggtcctgttccaggtccacctgcaggagtcgggcccagggactggtgaacgccctcggagaccctgtcccctnatttgcactgtgtctggactccaccgtcacagacttcggttccttcgtggggcttcggggtccggcacgtcccagaggaagggtctggagtggatgggagtgtctataagtacggggatacgaatagtcgtggtagacactaccctactaacctaacccgttactttaagacgtacgtacgtactactatatcagtgcgtctcgtaccacgaacacgtctcccgtagaggatganactcgtgtcgacggccacgagacgacggacctaagttcgtttcaggtcgcgaacgaccgacccggtagtacggccgaccgcgtggacgccgtcgttcggtacgtcgatcggacgtcggggccgtcggccgtcccgtggtccc

SEQ ID NO: 85916 - DNA, 617 bp, Homo sapiens
  misc_feature: GYAE6OF02HS53Z.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggacgaccctgtccctctatttgcactgtgtctggactccaccgtcacagattcggttccttcgtggggtcgtcggggtccggcgtacgtccccgagaggaagggtcgtgggagtggtagttgggagtgtactaagtaaggtacggggagtcaatagtcggtggtagacactccctactacctaaccgttactttaagacgtcgtagtcactatatctagtcgcgtctccgtccaccgaaccgcgtcctccgtggaggtagtaggagtatcgtgtcggacggccgcgacgacgacgactaagttattcgtgtcgacgacggaccggtacccggtaggttacggaccgtacgtccgtgggacgacgtacgttacggtacgtcgtacgtcggccggtcggggccgtcgggccggtcccgtcggtccg

SEQ ID NO: 85917 - DNA, 605 bp, Homo sapiens
  misc_feature: GYAE6OF02H8FY4.21.45.E01.1.454.CMB.1.raw
  modified_base (253)..(253): a, c, t, g, unknown or other
  misc_feature (253)..(253): n is a, c, g, or t
  modified_base (452)..(452): a, c, t, g, unknown or other
  misc_feature (452)..(452): n is a, c, g, or t
  modified_base (471)..(471): a, c, t, g, unknown or other
  misc_feature (471)..(471): n is a, c, g, or t
  modified_base (477)..(477): a, c, t, g, unknown or other
  misc_feature (477)..(477): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaacgccctcggagaccctgtccctcatttgcactgtgtctggactccaccgtcacagatggttccttgnggggctgggtccggcacgtccccaggagaacgggtctgggagtggattggggagtgtctagtaagtacggggagtacaatatcgtggtgacactccctactacaaccgtctttaagacgtcgagtcactatatcagtgacgtctcgtccaacgaacccgaggtcctccctgacggatagagtatcgtgtgacggccganacgacgacgacctaagttntttacngtcgcgacgacgaccccgggagttacgaccgtacgaccgtagggacggaccgtacggtacggttacgttacggacgttcggtccggtacggggcccggttcgggacccgtccccgtagggttaccccg

SEQ ID NO: 85918 - DNA, 607 bp, Homo sapiens
  misc_feature: GYAE6OF02HOLF1.21.45.E01.1.454.CMB.1.raw
  modified_base (251)..(251): a, c, t, g, unknown or other
  misc_feature (251)..(251): n is a, c, g, or t
  modified_base (356)..(356): a, c, t, g, unknown or other
  misc_feature (356)..(356): n is a, c, g, or t
  modified_base (413)..(413): a, c, t, g, unknown or other
  misc_feature (413)..(413): n is a, c, g, or t
  modified_base (441)..(441): a, c, t, g, unknown or other
  misc_feature (441)..(441): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggatccaccgtcacagatggttccttgnggggctgggtccgcagtccccagagaaggtctggagtggattgggagtgtctagtaagtacggggagtcgaatagtcgtggtgacactccctactacaacccgtntttaacgagtcgagtcactatatcagtcgcgctcgtccacgaaccaggtcctcccgngacggatgagatctggtcgacgggtccncgagaaccgacggtcctaagttactttcgtagtcgacgtacgacggaccccgtaggttaccgcgaccgtccgtacgggacggtccgacgttcgggtaaccgttccggaagttccggtacccggtcgggggtcccggtacgggtcccggccccgtttacgggtcccg

SEQ ID NO: 85919 - DNA, 609 bp, Homo sapiens
  misc_feature: GYAE6OF02IN7E3.21.45.E01.1.454.CMB.1.raw
  modified_base (248)..(248): a, c, t, g, unknown or other
  misc_feature (248)..(248): n is a, c, g, or t
  modified_base (343)..(343): a, c, t, g, unknown or other
  misc_feature (343)..(343): n is a, c, g, or t
  modified_base (494)..(494): a, c, t, g, unknown or other
  misc_feature (494)..(494): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctggagaccctgtccctcatttgcactgtgtctggatccaccgtcacagatggttcctntggggctggggtccgcacgtccccgagaggaaggtctggagtggtacgttgggagtgtcgtaagtaagtacggggattcaatagtcgtggtgacncgtacctataccaaccgttatttaagacgtcgacgtacactatacttcagtgcgtctccgtaccacgtaaccgaggttcctacccgtagacgtatgtagagttcctaggtcgaccggcgtcgaagaccgacggacctaagttactttacgngttcgacgacgaacggacccggaagttacgccgtacgccgtagggacgcgtaacgtcgggttaccttacgacgttcggaccgtacggggtcgttcgggcccgtcccgtggtaccg

SEQ ID NO: 85920 - DNA, 556 bp, Homo sapiens
  misc_feature: GYAE6OF02IMJD9.21.45.E01.1.454.CMB.1.raw
  modified_base (251)..(251): a, c, t, g, unknown or other
  misc_feature (251)..(251): n is a, c, g, or t
  modified_base (357)..(357): a, c, t, g, unknown or other
  misc_feature (357)..(357): n is a, c, g, or t
  modified_base (420)..(420): a, c, t, g, unknown or other
  misc_feature (420)..(420): n is a, c, g, or t
  modified_base (438)..(438): a, c, t, g, unknown or other
  misc_feature (438)..(438): n is a, c, g, or t
  modified_base (460)..(460): a, c, t, g, unknown or other
  misc_feature (460)..(460): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctccagatgggtcctgtcccaggtccacctgcaggagtcgggcccaggactggtgaagccctcggagaccctgtccctcatttgcactgtgtctggactccaccgtcacagatggttccttgnggggctggggtccgcagtccccagagaaggtctggagtggagttgggagtgtctataagtacggggagtcaatagtcgtggtgactactccgtactacaacccgtntttaaagagtcgagtcacgtatatcagtgcgctcgtcacgaaccaggtcctcctgagactganatcgtgtcgacggccgtnagacacggacaagtactttcgngtgcgtagacgacccgtagtacgcgacgcctaggagcgtaactcggtacttaccgatcggccgtaggggcctcgggacccgtcccggtggtacccg

SEQ ID NO: 85921 - DNA, 954 bp, Homo sapiens
  misc_feature: GYAE6OF02HWJVQ.21.45.E01.1.454.CMB.1.raw
tcagtcgtcgctcgcacgaccggtgctcgatttagtgagtcagtaagggaaagggggcgtttcgagagagtcatggacctcctgtgcaagaacatgaggcacctgtggttttcctctgctggtggcagctccagatgggtcctgtcccaggtccactgcaggagtcgggcccaggactggtgaacgccctcggagaccctgtccctgtatttgctactgtgtactggacttccgaccgtcaacgagacttcgggttcccttggtcggggacgttcggggtccggtaccgtacggtcccccgaggaacggtaacggggtccgtgggaaggttggagttggggtaagtcgtcgttaagtaagtaccggggtagtacgaataacgtcggtcgggttaggaacctaccgtaccctaacgtaacccgaacccggtttacttttaaacggacggttacgtaacggttacctaaccgtttatacgtaccgtaaggtcgtacggtccgttacggtaccctaaccggtaacccgaagggttacccgtaccccgttacgggtaacggtaacggttacgggtaaacgtaaacggttccgtttagggtaccgggtaacccggggttacccggtaccggaaacgggttaaccccggaaccggggtaaccccggtaaacggttttaaccggtttttaacccggtttcgggttaaccgggtaccgggtaaaccggggtaacccgggtaaacccccgggtttaaaccgggggttttaaaccgtaaccccggggaacccgggttacccggttaacccgggggttaacggggtaccccgtttaacggttacccggggttttaacgttaccggggttaaaacctttccggggttaaccccgggtttaaccgggggggtccccgtttaaccgggggtacccgggttacccccgggtttcgggttaaccccgggg

SEQ ID NO: 85922 - DNA, 628 bp, Homo sapiens
  misc_feature: GYAE6OF02JNGO0.21.45.E01.1.454.CMB.1.raw
  modified_base (214)..(214): a, c, t, g, unknown or other
  misc_feature (214)..(214): n is a, c, g, or t
  modified_base (262)..(262): a, c, t, g, unknown or other
  misc_feature (262)..(262): n is a, c, g, or t
  modified_base (346)..(346): a, c, t, g, unknown or other
  misc_feature (346)..(346): n is a, c, g, or t
  modified_base (416)..(416): a, c, t, g, unknown or other
  misc_feature (416)..(416): n is a, c, g, or t
  modified_base (456)..(456): a, c, t, g, unknown or other
  misc_feature (456)..(456): n is a, c, g, or t
tcagtcgtcgctcgcacgaccggtgctcgatttagtgagtcagtaagggaaagggggacgtttcgagagagtcatggacctcctgtgcaagaacatgaggcacctgtggtttttcctcctgtctggtggcagctcccagatgggtcctgtcccaggtccacctgcaggagtcgggcccaggactgggtgaagcccgtcggagaccctgtccctnactttgcactgtgtctaggactccaccgtcacagatcggttccttcgnggggtctgggtccggcacgtccccgagacggaaggtctggacgtggagttggggagttggtctataagtacggggatcgaagtntacggtggtgaccactccctactaaccaaccgttctttaagacgtcgtatccgatatatcagtgtaccgntccgtccaacgacccgacgtctcccgtagagagtagagtntacgtgtcgacgccgcgacgccacggacctacggtactttcgtacgtggcgtagccggaacccggtgttacggaccgacggtcccgtagggacggccgtcgttacgggttaacctttcgaacgttcggcccgtggggggtcccgtaccgggtccgtcccggttggtaccccg

SEQ ID NO: 85923 - DNA, 1052 bp, Homo sapiens
  misc_feature: GYAE6OF02GIA60.21.45.E01.1.454.CMB.1.raw
  modified_base (217)..(217): a, c, t, g, unknown or other
  misc_feature (217)..(217): n is a, c, g, or t
tcagtcgtcgctcgcacgaccggtgctcgatttagtgagtcagtaagggaaagggggtcgtttcagagagtcatggaccctcctggtagcaagaacactgaggcacctgtggtttttcctcctgctggtggcagctcccagatcgggtcctgtccaggtccactgcaggagtcgggcccaggactggtcgaagcccttggacgacccgtgtaccctnactttcgcactgtgtcgtggatccaccgtcacagacttggttccttcgtggggctgggtccgcagtccccagacgaacgggtcgtggacgtggattcgggaagtgtactagtaacgtacggggtagtaccgaaagtacgtacggttgggtacgtaaccgtaccgttacccccgttaacgttaacccgtaaaacccccggttttaccgttttttaaacggaacgggtttaccggtaaaggggtttcccgtaaaccggtttaaagtttaaaccgtttacccgtaaacggggttttacccgggtacccggttacccgtttaccccgggtttaaacccccgtaaaccccgggttaaacccccggggtaaaccggggtttacccctttaacccccccgggtttaggggtaaaaccgggggttaaacggtttacggggaaaccgggttaaaccgtttacccgggttttacggggtttaacccgggttaacccggggttcccggggttacccggttaacggggaaaccccggtaaccggggtaacccccgtaaaagggtttttaacccggttttcccggtttacgggtttaccgggttaaacccgggttaaccggggtaaccccgggttaaacccccccggggggttaaaaggttttaaacccgggaaccgggtaaccccggggtacccgttaacggggggtaacccggggacccgtaaaccgggttttacggggtttaacccggtttacgggaaccggtttccgggtccccgggtttaccggggggggtaccccggtttccgggggtaccccggttcccccggtttagggtttacccccgg

SEQ ID NO: 85924 - DNA, 588 bp, Homo sapiens
  misc_feature: GYAE6OF02GUKCH.21.45.E01.1.454.CMB.1.raw
  modified_base (492)..(492): a, c, t, g, unknown or other
  misc_feature (492)..(492): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctggagaccctgtccctcatttgcactgtgtctggatccaccgtcacagatcggttccttcgtggggcttggggtccggcacgtccccaggaggtaagggtctggagtggagttgggagtgtactagtaagtacggggagtcaagtatcggtggtagacactccctactaacctaaccgttctttaagagtacgagtctatatatcagtcgctctacgtccaacgacctaggtcctccgtagacggactagagtactcgtagtcgaccggccgcacgaccgacggacctaaggttactttcgngttacgacgagtaccggaccggtagttacgacgtacgctgggacgctaacggtgtactcgacgtcgccggtggggccgtcggccgtccgtggtccg

SEQ ID NO: 85925 - DNA, 554 bp, Homo sapiens
  misc_feature: GYAE6OF02HPRLS.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggatccaccgtcacagatggttccttcgtggggctgggtccgcagtccccagagaaggtctggagtggattgggagtgtctagtaatacggggagtcaatagtcgtggtgacactccctactacaaccgttctttaagagtcgatcactatatcagtgcgctcgtccacgaaccagtcctcctgaggatgagatctgtgaccggccgcagacacggctaagttattctgtgacgagacgacccgagttacgcgacgccgtaggacgcgtacgtcggttacctcggtacgtcgtaccggtcggggcccgtagggcccgtcccggttggtccg

SEQ ID NO: 85926 - DNA, 595 bp, Homo sapiens
  misc_feature: GYAE6OF02FNKER.21.45.E01.1.454.CMB.1.raw
  modified_base (353)..(353): a, c, t, g, unknown or other
  misc_feature (353)..(353): n is a, c, g, or t
  modified_base (514)..(514): a, c, t, g, unknown or other
  misc_feature (514)..(514): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggactccaccgtcacagatggttccttcgtggggctggggtccgcacgtcccgagaggaagggtctggagtggagttggggtagtgttacgtaataaacgtacgggggatcgtaaatagtcggtgggtanactacctcccgtaactaacctaaccccgttcttttaaagagttcgaagttctaacttatacttcaagtcgcgtctccgtccaaccgtacacggtactccctagagtatgagtactctagtcggacggtccgacacgaccgacggacctaaagttactttcnggttcgcgagaccgaccgtagtacgcgacgcgtggagctacgtggtactgatggcgtcgggccgtggccgtccgtggtacc

SEQ ID NO: 85927 - DNA, 586 bp, Homo sapiens
  misc_feature: GYAE6OF02IUIA0.21.45.E01.1.454.CMB.1.raw
  modified_base (270)..(270): a, c, t, g, unknown or other
  misc_feature (270)..(270): n is a, c, g, or t
  modified_base (341)..(341): a, c, t, g, unknown or other
  misc_feature (341)..(341): n is a, c, g, or t
  modified_base (365)..(365): a, c, t, g, unknown or other
  misc_feature (365)..(365): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttcgcactgtgtctggatccaccgtcacagatcggttccttcgtggggctggggtccggnacgtccccagaggaagggtctgggagtggagttgggagtgtctagtagtacggggatcaatgtcggtggtnacctactcctactacctaccgttntttaagagtcgagtcatatatcagtgcgctcgtccacgacctaggtcctccgtgagatgatactgtacgtcgtacggccgcgacgacgacggacctaagttatttcgtagtcgacgaagacgacccgggtagttacggacgtaccgccgtagggacggtccgacgttcggtacgttacgacgtcggccggtcggggtccggcggcccggtccggtgtaccg

SEQ ID NO: 85928 - DNA, 644 bp, Homo sapiens
  misc_feature: GYAE6OF02FQCSV.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggactccaccgtcacagatcggttccttcgtggggctcggggtccggcacgtccccagaggaagggtcgtggagtggagttgggagtggtctaagtaagtacgggggtagtacaagtagtcggtggtgactacctcctactacctaaccgttctttaagagtacgagtcactatatcagtgcgtctcgtccacgaaccagtcctccgtgaggatagagtatcgtggtcgaccggccgacgacggaccgaccggtacctaaaggttactttccgtaggttcgacggaacggtaaccggtaaccccgggtaggtttaacggccggaaccggtccgtagggacggtaccgtaacggttcggttaaccgttcggacgtcggtacccggttcggggcccggtcgggcccggtcccgtgggtacccg

SEQ ID NO: 85929 - DNA, 544 bp, Homo sapiens
  misc_feature: GYAE6OF02FKYCY.21.45.E01.1.454.CMB.1.raw
  modified_base (459)..(459): a, c, t, g, unknown or other
  misc_feature (459)..(459): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggatccaccgtcacagatggttccttctggggctgggtccgcagtccccagagaagggtctggagtggattggggatgtctataagtacggggatcaatatcgtggtgacactccctactacaacccgtctttaagagtcgagtcactatatcagtgcgctcgtccacgaaccaggtctcctgaggatgagatcgtgtgaccggccgcgacgaccacggacctaagttactttcgngtgacgagacgacccggagttacgcgacgccgtggacgcgtacgtggtacttcgatcgccgtggggccgtggccgtccgtggtcc

SEQ ID NO: 85930 - DNA, 756 bp, Homo sapiens
  misc_feature: GYAE6OF02J0TIY.21.45.E01.1.454.CMB.1.raw
  modified_base (257)..(257): a, c, t, g, unknown or other
  misc_feature (257)..(257): n is a, c, g, or t
  modified_base (309)..(309): a, c, t, g, unknown or other
  misc_feature (309)..(309): n is a, c, g, or t
tcagtcgtcgctcgcacgaccggtgctcgatttagtgagtcagtaagggaaagggggacgtttcgagagagtcatggacctcctgtgcaagaacatgaggcacctgtggtttttcctcctgctggtggcagctcccagatgggtcctgtcccaggtccacctgcagggtagtcgggccccaggacctggtcgaagcccctcgggacgaccccgtgtcccctcattttcgctactcgtgtctggatcccaccgtcacngatcggttcctcgtggggctggggccgtcacgtcccaggagaagggtcaggngtaggtagttggggactggtactaagtaacgtacggggatacgtaagtacttcggtagggtcgaaccgtaccgtacccgttaacgttaacccgtaaccccggtttatttaaacggtaggttaccgtagtaccgtaacttaattaccgtcgtaaacggttgccgttaccgtaccgtacccgtaaccggaacctacgggttcctaccccggtgtacgggtagtagtaacgtcgttacgtcgggtacggtaccgggtccgacggtaaccgaaccgaccgggtacctaaacggttaacgtttcgtacgggttcgacggtacggaaccggtacccgggtaagttacccggacgacgggtccgtacgggacggtcgtaaccggttcggttaaccgtcggttaacgtcgggtccgtacgggggccgtccgggtacccgtaccggtcggttaccg

SEQ ID NO: 85931 - DNA, 577 bp, Homo sapiens
  misc_feature: GYAE6OF02JEEU1.21.45.E01.1.454.CMB.1.raw
  modified_base (209)..(209): a, c, t, g, unknown or other
  misc_feature (209)..(209): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcgggagaccctgtccctnatttgcactgtgtctggatccacgtcacagatcggttccttgtggggctgggtccggcacgtccccagagaagggtctggagtggagttgggagtgtctatagtacggggatcaatatcggtggtacgacactcctactaccaaccgttctttaagacgtcgagtcactatatcagtgcgtctcgtccacgaccgaggtcctcccgtgaggatgagtatcgtgtcggaccggccgcgacgaccacgggaccctaagttacttcgtggtcgacgaaggacggacccgggtagttacgcggaccgtccgtggacggcgtacgtcggtacttacgactcggccggtggggccgtggccgtccgtggtaccg

SEQ ID NO: 85932 - DNA, 730 bp, Homo sapiens
  misc_feature: GYAE6OF02JXXBX.21.45.E01.1.454.CMB.1.raw
  modified_base (186)..(186): a, c, t, g, unknown or other
  misc_feature (186)..(186): n is a, c, g, or t
  modified_base (267)..(267): a, c, t, g, unknown or other
  misc_feature (267)..(267): n is a, c, g, or t
  modified_base (283)..(283): a, c, t, g, unknown or other
  misc_feature (283)..(283): n is a, c, g, or t
  modified_base (292)..(292): a, c, t, g, unknown or other
  misc_feature (292)..(292): n is a, c, g, or t
  modified_base (300)..(300): a, c, t, g, unknown or other
  misc_feature (300)..(300): n is a, c, g, or t
tcagtcgtcgctcgcacgaccggtgctcgatttagtgagtcagtaagggaaagggggcgtttcgagagagtcatggacctcctgtgcaagaacatgaggcacctgtggtttttcctcctgctggtggcagctcccagatgggtcctgtcccaggtccacctgcaggagtccgggcccaggactggngaacgcccctcgggacgaccctgtcccctcgatttgcactgtgtcctggactcccaccgttcacagattcggttccttcgnggggcttggtccggcncgtcccagngacggtcnggagtggagttgggagtgtctagtacgtacgggtagtacaagttataccggttggtacggacctaccctaccccttaaccgtaacccgtaacccggttttactttaaacggtacggttacggtacttacctacgtaattaccgtacgtacggtcggtccgtccgttacccgtacctaaacccggaacccgtacggttcccgtacccgtaggaacggtagtacggtacgcgttaccgtgtacggaccggtccgacgaccgtaaccgggccgtaacgtacgtttaacttcgtaggtacgacggtaacggacccgtaacggtaacggtaccgcgggttaaccgccgtagggaccgtccgaacggttccgggtaacctacgtagtacccgccggggttcgggtccggtccgtacccggtcccggtcggtaaccg

SEQ ID NO: 85933 - DNA, 652 bp, Homo sapiens
  misc_feature: GYAE6OF02ITZ9E.21.45.E01.1.454.CMB.1.raw
  modified_base (400)..(400): a, c, t, g, unknown or other
  misc_feature (400)..(400): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggacgaccctgtccctcatttgcactgtgtctggatccacgtcacagatggttccttcgtggggctggggtccgcacgtcccagaggaaggtctgggagtggagttgggagttcgtcgttaagtaaacgtaccggggggtaattaccgaaattacgtccggttgggtacggaacctaccgttcccctaacttaaccgaaacccgtttnttttaaacggcgtacgtagtactacgttaatacgtacaggtcgacgtcctacgtacccgaacggaacctacgggttcccttacccgtaggaggtacttggaagtagttacctaggttacgaccggtccgacgaacgaaccgtacggacctaaaggttctttaccgtgtcgacgtacggacgtacccgggtgttacgcgtacgccgtggaacgtcacgtgtctacgatcgacggtggccgtgcgtcgtgtacg

SEQ ID NO: 85934 - DNA, 687 bp, Homo sapiens
  misc_feature: GYAE6OF02JLBR9.21.45.E01.1.454.CMB.1.raw
tcagtcgtcgctcgcacgaccggtgctcgatttagtgagtcagtaagggaaagggggacgtttcgagagagtcatggacctcctgtgcaagaacatagaggcacctgtggtttttcctcctgtctggtggcagctccagatgggtcctgtcccaggtccacctgcaggagtcgggcccaggactggtgaagccctcggagaccctgtccctcgatttgcactgtcgtctggactccaccgtcacacgatcggttccttcgtgggggctacggggtccgtcgacgtccccgagacggtaacgggtcgtggagtggagttgggagtgtcgtataagtacggggatcgaatcgtcggtggtgactacctccgtaataccaaccgttctttaacgacgtcgtagtcacttataactcgtagtacgcgccttaccgtccaaccggtaaccgtacggttaccctcccgttaggaacggtagtacggaagtacgttacgtcggtcgtaccgggccgtaccgaacggaccgtaccgggacctaacgggttactttcgtacgtacggaccgacgtaaccggtaccccgggtagttaccggacggaccgtcggtacgggacggtccgaacggttggttaccgttcggacgttcggtaccggtcggggccggtacgggtccggtaccgtcggttccgg

SEQ ID NO: 85935 - DNA, 687 bp, Homo sapiens
  misc_feature: GYAE6OF02JATO2.21.45.E01.1.454.CMB.1.raw
  modified_base (252)..(252): a, c, t, g, unknown or other
  misc_feature (252)..(252): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggatccaccgtcacagatggttccttcgngggtctgggtccgcagtcccagagaggtctggagtggattggggagtggtactagtaagtacgggggagtacgaatatcggtggtagacgtacctccctaacgtaaccaacccggttcttttaaggacgtcgtagtccacgttactatcgagttgcgtctcgttaccaacggtaacccaggttcctacccgtgaacgggtacgtagagaacgttccgttaggtacgggacccgggaccgtcgaacggaaccgacccgggtaccaaacggtttactttcgagggttcgacgaaggtaccggtaccccgggtaaggtaacggtcccgaacggtccgtagggacgcggtaccgtttaacgggttacctttacggaacgttcggaccccggttcgggggggtacccttgggggtaccccggtcccgttggggtaacccc

SEQ ID NO: 85936 - DNA, 592 bp, Homo sapiens
  misc_feature: GYAE6OF02HW7X6.21.45.E01.1.454.CMB.1.raw
  modified_base (271)..(271): a, c, t, g, unknown or other
  misc_feature (271)..(271): n is a, c, g, or t
  modified_base (369)..(369): a, c, t, g, unknown or other
  misc_feature (369)..(369): n is a, c, g, or t
  modified_base (401)..(401): a, c, t, g, unknown or other
  misc_feature (401)..(401): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaacgccctggacgaccctgtccctctatttgcactgtgtctggactccaccgtcacagatcggttccttcgtggggctggtccggcncgtccccagagtaaggtctggagtggagttgggagtgtactagtaagtacggggagtacaagtgtcggtggtcgactactccctactaccaaccgttntttaacgagtacgagtcactatatcagtcgcnctcgtaccacgaaccacgtcctccgtagaggtactagagtactcgtgtcgaccggccgcacgaccgaccggacctaacggttcttcgtgtgacgagcgacccggtagtacgccgtacgccgtagggacgtacacgttcggtactcgtacgtcggtccggtcggggccggtcgggcccgtccggtggtcccg

SEQ ID NO: 85937 - DNA, 763 bp, Homo sapiens
  misc_feature: GYAE6OF02JCVD8.21.45.E01.1.454.CMB.1.raw
  modified_base (227)..(227): a, c, t, g, unknown or other
  misc_feature (227)..(227): n is a, c, g, or t
  modified_base (255)..(255): a, c, t, g, unknown or other
  misc_feature (255)..(255): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctaggntcccaccgtcacagatcggttccttcgnggggctcgggtccgcacgtccccgagaggaagggtcgtggagtggtagttgggagtgtctagtaagtacggggatcgaatacgtcggtggtacgtacaccttaccctaactaaccgtaacccgttacttttaaacggacgttcgaacgtacaacctatacgtcgtagtcgtacgtaccgttccgtacctacgaaacctacggttccgtacccgtggaaggtactaggaacgtacgttcgtggtacggaccggtaccgacgtaacggaaccgtaccggtaccgtaaaggtttacgtttaccgtagttacggacgtaacggtaacccgggtaccccgggtaaggtttaaccggacccggtaacccgggtaccgtacgggggtaaccggtaccggtaacccgggtttaaccgggttaacggtttaccccgggtagttacccgggtacccgggttccggggggtacccggttcccggggtaacccggtcccccgggttacgggttaacccgg

SEQ ID NO: 85938 - DNA, 570 bp, Homo sapiens
  misc_feature: GYAE6OF02I8SIE.21.45.E01.1.454.CMB.1.raw
  modified_base (436)..(436): a, c, t, g, unknown or other
  misc_feature (436)..(436): n is a, c, g, or t
  modified_base (444)..(444): a, c, t, g, unknown or other
  misc_feature (444)..(444): n is a, c, g, or t
  modified_base (462)..(462): a, c, t, g, unknown or other
  misc_feature (462)..(462): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggatccaccgtcacagatggttccttcgtggggctgggtccggcagtccccagagaagggtctggagtggattggggagttgtctataagtacgggggatcgaatagtcggtggtgacactccctactaccaaccgtcttttaaagacgtcgtagtcactatatcagtgcgctcgtccaacgaaccaggtcctcccgtgaggatgagatctgngacggccngacgacacggacaagttntttcgtgtgacgagcgacccggtagttacgcgtacgccgtgggacgctcggtgttaccgttagagtcggaccggtcggggcccggtcggccggtacccgtggtacccg

SEQ ID NO: 85939 - DNA, 809 bp, Homo sapiens
  misc_feature: GYAE6OF02GLARH.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggactccaccgtcacagtattcggttccttcgtggggcgtcggggtccggcacgtccccgaggacggaacgggtcgtaggagtgggagttgggtagtgtactaagtaaggtacggggtagtacgtaagtacgtcggtggtacgtacctaccttacccctaaccttaaccgtaaaccccgtttacgttttaaacggaacggttacgtaacggttacctaacgtttataactacgtaacggttcgccggtccttacccggttacccgaacccggtaacccgtaacgggttcccttaccccggtagggtaacgggtagtacggtaacgtacgttacggttacgggtaccgggaacccgggtacccgacgtaaaccggacccggtaaaccgggtacccctaaaggggttttacctttacgggttacggttacggaccgggtaaccgggtaaccgggtaaccccgggtaaggttaccggaccgtaaccggtccggtacgggacggtacccgtacggttacgggtaccttaccggtacggttccggtacgggtccgggggtaccgtccgggtacccgtccggttcggtcccg

SEQ ID NO: 85940 - DNA, 645 bp, Homo sapiens
  misc_feature: GYAE6OF02FZXBH.21.45.E01.1.454.CMB.1.raw
  modified_base (400)..(400): a, c, t, g, unknown or other
  misc_feature (400)..(400): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagcccctcggacgaccctgtcccctcatttgcactgtgtctggactcccaccgtcacagatcggttccttcgtggggctggggtccggcacgtcccaggagaagggtctggagtggagttgggagtgtctagtaagtacggggagtcaagtagtcggtggtgactactccctaactactaacccgttctttaagagtcgagtcactatatcagtncgctcgtaccacgaccgacggtcctcccgtaggacggtatggacgtagttcgtggtacggaccggccgacgaacggaccgaccgggtaccgtaaagttacgtttcgacggttcggacgtaacggaccgggtaacccgggtagttacggaccgtacgccggtaggacggaccgtacggtacggttaccgttacgtacgtccggaccggtcgggggtacccggtcgggcccggtcccgtggtacccg

SEQ ID NO: 85941 - DNA, 742 bp, Homo sapiens
  misc_feature: GYAE6OF02GBZ7C.21.45.E01.1.454.CMB.1.raw
  modified_base (255)..(255): a, c, t, g, unknown or other
  misc_feature (255)..(255): n is a, c, g, or t
  modified_base (573)..(573): a, c, t, g, unknown or other
  misc_feature (573)..(573): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaacgccctggagaccctgtcccctcatttgcactgtgtctggatccgaccgtcacagattggttccttcgnggggctggggtccgcacgtccccagaggaacgggtctggagtggattgggagttgtctaattaagtacggggagtctaagtatcggttaggtgacctacctcccgttaacctaaccgtaaccccgttacgttttaaaggacgttcggaagttcctaacgttatactctaggtcgtccgcgttcgtacccaaccggtaacccgtaggttaccctaccccgtagggtacggtaacgtaggaagtacgttccgttacggtcggtaccgggtacccgacggaacgtaaccgaacccgggtacctaacggtttactttaccgnggttacgtacggaacggtaaccggtaccccggggtaagtttaacggaccgtaccgggaccgttacgggacggtaccgtaacggttaccggttaaccgttaccggacgttccggcccgggttccggggggtcccggttcgggccccggttacccggttcgggttaccccg

SEQ ID NO: 85942 - DNA, 571 bp, Homo sapiens
  misc_feature: GYAE6OF02FXR13.21.45.E01.1.454.CMB.1.raw
  modified_base (371)..(371): a, c, t, g, unknown or other
  misc_feature (371)..(371): n is a, c, g, or t
  modified_base (428)..(428): a, c, t, g, unknown or other
  misc_feature (428)..(428): n is a, c, g, or t
  modified_base (433)..(433): a, c, t, g, unknown or other
  misc_feature (433)..(433): n is a, c, g, or t
  modified_base (446)..(446): a, c, t, g, unknown or other
  misc_feature (446)..(446): n is a, c, g, or t
  modified_base (471)..(471): a, c, t, g, unknown or other
  misc_feature (471)..(471): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactgggtgaagccctcggagaccctgtccctcatttcgcactgtgtcgtggactccaccgtcacagattcggttccttcgtggggctcggggtccggcacgtcccagaggtaagggtctggaggtggagttggggattgtctagtaagtacggggatacaatagtcggtggtgactctcctactactaccgttntttaagagtcgagtcactatactcagtcgctctcgtccacgactcgtctcctgaggntgatntctgcgacggccnacgacgacggactaagttctttcgnggtcgacgagaccgacccggtagtacggcgacgccgtgggacgacgtacgtggtaccttgacgtcggccggtcggggccgtggccgttccgtggtacccg

SEQ ID NO: 85943 - DNA, 845 bp, Homo sapiens
  misc_feature: GYAE6OF02GESMT.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggactccaccgtcacagattcggttaccttcgtgggctgggtccggcacgtcccagaggagggtctggagtggatggggagtgtactaagtaagtacggggtagtcgaagtagtcggtaggtgacctaccgtacccctactaacctaaccccggttacttttaaaggacgtaccggtagtacctaacttaacgttatactaggttcgaccgtccgttccggtacccgaaaccggtaacccgtacgggttacccctaccccggttagggaacgggtaacggtacggtaacggtaacgttcccggttagggttaccgggacccggggtacccggaaccggtaaccggtaaacccggaacccgggtaacccggttaaaacggttttactttttacccggtacgggttccgggtaccgggtaaaccgggtaacccggggtaaaccccccgggttagggtttaaccgggaccgggtaacccgggtcccgggttacggggtaccggggaccgttaaccgggtttaggtttaaccccggttcgggttaaacccggttcgggtacccggggttccgggggtacccggggttcgggttacccccgggtcccgggttaccgggttaccccgg

SEQ ID NO: 85944 - DNA, 616 bp, Homo sapiens
  misc_feature: GYAE6OF02GRJE0.21.45.E01.1.454.CMB.1.raw
  modified_base (356)..(356): a, c, t, g, unknown or other
  misc_feature (356)..(356): n is a, c, g, or t
  modified_base (363)..(363): a, c, t, g, unknown or other
  misc_feature (363)..(363): n is a, c, g, or t
  modified_base (378)..(378): a, c, t, g, unknown or other
  misc_feature (378)..(378): n is a, c, g, or t
  modified_base (397)..(397): a, c, t, g, unknown or other
  misc_feature (397)..(397): n is a, c, g, or t
  modified_base (409)..(409): a, c, t, g, unknown or other
  misc_feature (409)..(409): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggatccaccgtcacagatggttccttcgtggggctgggtccggcagtccccagagaagggtctggagtggattgggagtgtctagtaagtacgggagtcaatatcgtggtgacacgtccctataccaaccgtntttaagngtcgagtcactatancagtgcgctcgtcacgacngtctccctgagntgagatctgtcgaccggcgacgagaccgacggaccaacgttatttccgtgttcggacggacggaacggacccccgggtaaggttaaccggccggtaaccgcccggttagggaccggtccgtaacgttacgggttaccttaccggtacgtccgggtccggtccgggggtacccggttcggggacccggttccccgttagggttacccg

SEQ ID NO: 85945 - DNA, 684 bp, Homo sapiens
  misc_feature: GYAE6OF02GJVDE.21.45.E01.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctccagatgggtcctgtcccaggtccacctgcaggagtcggcccaggactggtgaagccctcggagaccctgtccctcatttgcactgtntctggactccaccgtcacagattggttccttcgtggggcttggggtccgcacgtcccgagacggagggtctggagtggagttgggagtcgtactaagtaacggtacgggatactaagtagtacggtggtagtaaccaccgttaccctaaccttaaccgaaccgtttacgttttaaagacggtcgtaacgttaccacttaactactactaagttcgacgtcccgttacgacccgaacgaaacccgtacgttacccgtaccgttaggtaacggtaacgtcggtaacgtacgttcgtacggttacgggccggccgtacgacgtaccgaccggtaaccctaaggtttactttccgtaggtacgaccggaggtaccggacccggtagtaccgacgtaccgtcgacggcgacgtcgtacggttacctggtaacgtcgtacggcggggtaccgtcgggcgtccgtggttaccg

SEQ ID NO: 85946 - DNA, 549 bp, Homo sapiens
  misc_feature: GYAE6OF02GHC0Q.21.45.E01.1.454.CMB.1.raw
  modified_base (268)..(268): a, c, t, g, unknown or other
  misc_feature (268)..(268): n is a, c, g, or t
  modified_base (363)..(363): a, c, t, g, unknown or other
  misc_feature (363)..(363): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggactccaccgtcacagatggttccttgtggggctggggtccggnagtccccagagaagggtctggagtggattgggatgtctataatacggggatacaatatcggtggtgacactccctataccaaccgttctttaagngtcgagtcactatatcagtgcgctcgcacgaccagtctcctgaggatgagatcgtgtgacggccgacacgacacggccaagttatttcgtgtcgacgaggacgaccccggtagtacgcgacgccgtgggacggactacgtggttactcgagtcgccggtcggggcccgtggcggtcccgtggtccg

SEQ ID NO: 85947 - DNA, 542 bp, Homo sapiens
  misc_feature: GYAE6OF02HND9J.21.45.E01.1.454.CMB.1.raw
  modified_base (400)..(400): a, c, t, g, unknown or other
  misc_feature (400)..(400): n is a, c, g, or t
  modified_base (451)..(451): a, c, t, g, unknown or other
  misc_feature (451)..(451): n is a, c, g, or t
  modified_base (456)..(456): a, c, t, g, unknown or other
  misc_feature (456)..(456): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggatccaccgtcacagatggttccttcgtggggctgggtccggcagtccccagagaagggtctggagtggattgggagtgtctataagtacggggagtcaatatcgtggtgacactcctactacaacccgtctttaagagtcgagtcactatatcagtgcgctcgtaccacgaaccnggtcctcccgtgaggatgagtatctgtgacggccgcagacacggcaagttntttcngtgcgagacgacccggagttacgcgacgccgtggacgcgacgtggtactcgatcggccgtggggccgtcggccgtcccgtggtccg

SEQ ID NO: 85948 - DNA, 738 bp, Homo sapiens
  misc_feature: GYAE6OF02GT99W.21.45.E01.1.454.CMB.1.raw
  modified_base (562)..(562): a, c, t, g, unknown or other
  misc_feature (562)..(562): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtccgggcccaggactgggtgaacgccctcgggacgaccctgtccctcatttgcactgtgtctggactccaccgtcacagtacttcggttccttcgtcggggtcgttcggggtcccggcacgttcccccgaggtacggaaacgggttcctggggtagtacgggtagttcggggaggttcggttacgttaagttaaaggttacgggggtaagtacgtaaagttaacgtcggtggtagacctacctacccttactaaccaacccgttactttaaacgagtaccgtatctaactaatactacgtagtcgtccgtctccggtcctaaccggaaccgtaccggttaccctcccgtaggaacggtactacgaagtacttccggtggtacgaccgggtcccganaaccggaccgaccggtacctaaaggtttctttacggtcggtcgaccgtaacggacccggtacccgggtagttacgccggtaccgccggtacgggacgtaccgtaacgtacggtttaccgtacgacgttcgtccgggtaccggggtccgtacgggcccgttcccggtcggttacccg

SEQ ID NO: 85949 - DNA, 611 bp, Homo sapiens
  misc_feature: GYAE6OF02JY967.21.45.E01.1.454.CMB.1.raw
  modified_base (114)..(114): a, c, t, g, unknown or other
  misc_feature (114)..(114): n is a, c, g, or t
  modified_base (208)..(208): a, c, t, g, unknown or other
  misc_feature (208)..(208): n is a, c, g, or t
  modified_base (233)..(233): a, c, t, g, unknown or other
  misc_feature (233)..(233): n is a, c, g, or t
tcagtcgtcgctcgcacgaccggtgctcgatttagtgagtcagtaagggaaagggggctttcagagagtcatggacctcctgtgcaagaacatgaggcacctgtggtttttccncctgctggtggcagctcccagatgggtcctgtcccaggtccacctgcaggagtcgggcccaggactggtgaagccctcggagaccctgtccctnatttgcactgtgtctgatccacgtnacagtatggttcctgtggggctggggtccgcagtccccaggagaagggtctggagtggagttgggagtgtctatagtacgggatacatacgtcgtgtgacactcctactactaaccgttctttaagacgtcgagtcgactatatcagtgcgctcgccacgaccaggtcctccagaggatgagtacttcgtaggtacggacggcccgagaacgtaccggaacggaccctaaaggtttactttaccgtgtacggaccggaggaacccggtaaccgtaggtttacgccggtacgccggttgggaacgtccgacggttacggttactccggtagtcggtaccggtcggggtacccgtcggacccggttccgtacgggtaccc

SEQ ID NO: 85950 - DNA, 561 bp, Homo sapiens
  misc_feature: GYAE6OF02FN6ZZ.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggatccaccgtcacagatggttccttcgtggggctggggtccggcagtccccagagaagggtctggagtggattgggagtgtctataagtacggggagtcaatatcggtggtgacactccctactacaacccgttctttaagagtcgagtcactatatcagtgcgctcgtccacgaaccaggtcctccctgaggatcgagatctgtgacggtcgcagacacggaccaagtctttctgtgcgagacgacccggagttacggcgaccgccgtgggacggtccacggtggttaccttcgagtcgtccggtcggggccgtcgggaccggtcccgtggtcccg

SEQ ID NO: 85951 - DNA, 660 bp, Homo sapiens
  misc_feature: GYAE6OF02JEFEB.21.45.E01.1.454.CMB.1.raw
  modified_base (347)..(347): a, c, t, g, unknown or other
  misc_feature (347)..(347): n is a, c, g, or t
  modified_base (416)..(416): a, c, t, g, unknown or other
  misc_feature (416)..(416): n is a, c, g, or t
  modified_base (424)..(424): a, c, t, g, unknown or other
  misc_feature (424)..(424): n is a, c, g, or t
  modified_base (428)..(428): a, c, t, g, unknown or other
  misc_feature (428)..(428): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtccgggcccaggactgggtgaagcccctcggagaccctgtccctcatttgcactgtgtctggactccaccgtcacgagattggttccttcgtggggtctgggtccggcacgtccccgagaggaagggtctggagtggattgggagtgtcgtagtagtacggggatacaatagtcggtggtnacacgtaccctactacaaccgtctttaagagtacgtagtaccaatatatcagtgcgctcgtcacgaccngtctccgngagntgagatctagtcggacgcgagacgacgaccgacgtaagttacgtttcgtacgtcggacgtaacgggtaccgtaccccgggttaagttaccggaccggtaaccgtacccggttagggaccgggtaccgtaaccggtttacgggtttaaccgttaccgggtaagtttcccggggccgggtttccggggggtacccggttccggggtacccggtcccccggtttaggtaccccgg

SEQ ID NO: 85952 - DNA, 732 bp, Homo sapiens
  misc_feature: GYAE6OF02GJ8ZR.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggatccaccgtcacagatggttccttcgtggggctcggggtccggcacgtccccaggaggagggtctgggagtggagttggggatgttactagtaagtacggggagtactaaagtagttcggtggtacgacctaccgttaccccttaacctaacctaaaccccggtttactttttaaacggaagttccgtaagttaccaacttaattaactcgtaacggttgacggtctaccggttacccaacggtaaccgtacggttccctcccgtaggaacgggtataggaagtactcgtggtacggaccgggccgacgaacgaccgaacgggtacctaaaggtttactttcgtaggttacggacgaacggtaccggaaccccgggtaggtttaaccggaccgggtacccgtccgttacggggaacggtaccgtaaccggtacgggtttaaccgtcgtacggtacgggtcccggtacgggggtcccggttcggggcccgttccccggtggttacccg

SEQ ID NO: 85953 - DNA, 602 bp, Homo sapiens
  misc_feature: GYAE6OF02I961S.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggatccaccgtcacagatggttccttcgtggggctggggtccgcacgtccccagagaagggtcgtggaggtggagttgggaggttgtctagtaagtacggggagtacaatagtcgtggtcacactccctaactaaccaacccgttacttttaagagttcgacgtcaacttaatactacagttcgcgtcgtcccgtaccgaaccgaacctacggtcctcccgtgaacggagtgagactccgtaggtcggaccgggccgaccgacgaaccgacgggacctaaaggttactttccgtgtcgacgacggacgacccggtagtacgcgacgccgtggagcgtacgtgtactcgagtcgcggtcgggtcgtcggccgccgtgtcg

SEQ ID NO: 85954 - DNA, 616 bp, Homo sapiens
  misc_feature: GYAE6OF02GHHY8.21.45.E01.1.454.CMB.1.raw
  modified_base (252)..(252): a, c, t, g, unknown or other
  misc_feature (252)..(252): n is a, c, g, or t
  modified_base (502)..(502): a, c, t, g, unknown or other
  misc_feature (502)..(502): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggatccaccgtcacagatggttccttcgnggggctgggtccgcacgtcccagaggaaggtctggagtggagttgggagttgtactaagtaagtacggggatacaatagtcgtggtcgactactcctaactacgtaacccgttatttaaaggacgtcgagtcactatatcagtcgcgtctacgtcccgacgaaccgtagtcctccctagggagtactaggacgtacgtcgtggtcggaccggtcccgagacgtaccgacggtacctaaaggttctttcgnggtcgacgaggaccgacccggtagttcgccgaccgtccgtgggacgtccgacgttcggttaccttcggacgttcggtccggtcggggtcccgtcgggtcccgtccggtggtccg

SEQ ID NO: 85955 - DNA, 848 bp, Homo sapiens
  misc_feature: GYAE6OF02H6QMA.21.45.E01.1.454.CMB.1.raw
  modified_base (212)..(212): a, c, t, g, unknown or other
  misc_feature (212)..(212): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaacgccctcggacgaccctgtcccctcntttgcctactgtcgtctggactccaccgtcacagattcggttcctgtggggctcgggtccgcgacgtccccgagacggaaggtctgggagtggtagttcgggagttgtcgttaagtaagttacggggacgtacgattacgtcggtaggtgaacctaccgttaccctaaccgtaacctaacccgttacgttttaacgacggtaacgtacgtactaacgtattatacgtagtcgaccgtcttccgtaccgaaccgtaaccgtacggccttaccccggtaggtaacggacttacgggtaagtaacgttccgacgggtacggtacccggacccgtacccgaaagtacccccgggtaaacggtaccggttaaaaaccggtttccgtttaccggtttacgggtacccggtaaaccgggtaaacggggtaaaccccggggtaaacccccgggggtttaaacgggttaacgggaaccccgggttaacccgggtcccgggtttaccgggggaaacgggtccccgtaaacgggtttttcccggtaaccggttttacccgggaacccggtttcggggtcccggttaaccgggggggtcccgtttaaccccgggggcccggttacccccggttggggtttaaccccgg

SEQ ID NO: 85956 - DNA, 872 bp, Homo sapiens
  misc_feature: GYAE6OF02JNYNZ.21.45.E01.1.454.CMB.1.raw
  modified_base (212)..(212): a, c, t, g, unknown or other
  misc_feature (212)..(212): n is a, c, g, or t
tcagtcgtcgctcgcacgaccggtgctcgatttagtgagtcagtaagggaaagggggacgtttcagagagtcatggacctcctgtgcaagaacatgaggcacctgtggtttttcctcctgctggtggcagctcccagatgggtcctgtcccaggtccacctgcaggagtcgggcccaggactggtgaaggcccctaggagaccctgtccctnatttgcactgtgtcctggactccaccgtcacagtattcgggttccttcgaggggtcttacgggggcccggcgtaacgtccccgagaggaacgggttcctaggacggttgggagttggggaggtttcgtacgttaagtaaaggttaaccgggggtagttaaccgaagttacggttaccgggtttggggtaggtaaccctacccgttaccccttaaccgtaacccgtaaccccggtttcttttaaaaggcggtaccggttaacgtacctaaacgttactaagtttaccgtaaggtggtacccgtaccggttacccgtacccgtaacccgggtaaaccccggtaaccgggtttacccttaccccgttcgggtaaccgggaaagttaccgggtaaggtaacgttaccgtacggggttaccggaaccggggtccccgtaaccggaaccggtaccggtaccccggggtaacccgtaaacgggtttaacccgtttcgtttaaccggtagggtcccggtaaagggaccccgggtaaccccggggtaagggttaccggtacgggaacccggttccggtacgggacggtccgtaacggtttcggaacggtttccgacggtaggtcccgggttcggggacgtccgggggtcccgtaccgttcggggttacg

SEQ ID NO: 85957 - DNA, 617 bp, Homo sapiens
  misc_feature: GYAE6OF02IB4CB.21.45.E01.1.454.CMB.1.raw
  modified_base (255)..(255): a, c, t, g, unknown or other
  misc_feature (255)..(255): n is a, c, g, or t
  modified_base (602)..(602): a, c, t, g, unknown or other
  misc_feature (602)..(602): n is a, c, g, or t
tcagtcgtcgctcgcacgaccggtgctcgatttagtgagtcagtaagggaaaggggctttcagagagtcatggacctcctgtgcaagaacatgatgcacctgtggtttttcctcctgctggtggcagctcccagatgggtcctgtcccaggtccacctgcaggacgtcgggcccaggactggtgaagccctggagaccctgtccctcatttcgcactgtgtctggactcccacgtcacagattcggttccttcgnggggctgggtccgcacgtcccagagaggtctggagtggtagttgggagtgtacgtagtaagtacggggatacatagtcgtggtgactactccctactaaccgtacccgttatttaacgcgttacgacgtacaacgttataactcgagtcgaccgtctaccgtaccgaacgtaaccgacgttcctacccgtaggaggtattaggacgtagtcgtaggtacggaccggccgtacgacgaccgaccggacctaagtttcttcgtgtcgacgagaccggacccgtagtacgccgacgtccgtaggacgtctacgttacggtaccttgacggtcggtccggcggggtcccgnggccccgtccgtcgg

SEQ ID NO: 85958 - DNA, 711 bp, Homo sapiens
  misc_feature: GYAE6OF02H3E2D.21.45.E01.1.454.CMB.1.raw
  modified_base (182)..(182): a, c, t, g, unknown or other
  misc_feature (182)..(182): n is a, c, g, or t
  modified_base (206)..(206): a, c, t, g, unknown or other
  misc_feature (206)..(206): n is a, c, g, or t
  modified_base (242)..(242): a, c, t, g, unknown or other
  misc_feature (242)..(242): n is a, c, g, or t
  modified_base (273)..(273): a, c, t, g, unknown or other
  misc_feature (273)..(273): n is a, c, g, or t
tcagtcgtcgctcgcacgaccggtgctcgatttagtgagtcagtaagggaaaggggctttcagagagtcatggacctccgtgtgcaagaacatgaggcacctgtcggttttcctctgctggtgcagctccagatggtcctgtcccaggtccacctgcaggagtccggcccaggacctggtanacgcctcggagaccctgtcccctnagtttcgcactgtgtctaggactccaccgtcaacgngacgttgttccctggtgggctaggtccgacncgtcccgagagaacggtcgaggagtcggagttggggagtgtcctaagtaagtacggggtatacgtaagtactcggtggttagaccgtacgtccctaacgttaccgaaccccgttacgtttaaacgacgttaccgaaggtcctaaccgttaataacgtactggtacgcgtccgttccgacccgaacggtaaccgtacgttacccgtcccgtaggtaaacggagtaggaacgtacgttacgtggtacggaccgtccgagtacgacccgaacgtaccctaaagtttctttacgtcgttacgaccggacgtaaccgggtacccgttaggttaacggcccggaacgtcccgtgggtacgtaccggtaagtccgggttaccttaacggccgttaggtcccggtacgggggtccctcggggtacccgtcccggtagggttccccg

SEQ ID NO: 85959 - DNA, 591 bp, Homo sapiens
  misc_feature: GYAE6OF02IL71Z.21.45.E01.1.454.CMB.1.raw
  modified_base (253)..(253): a, c, t, g, unknown or other
  misc_feature (253)..(253): n is a, c, g, or t
  modified_base (345)..(345): a, c, t, g, unknown or other
  misc_feature (345)..(345): n is a, c, g, or t
  modified_base (367)..(367): a, c, t, g, unknown or other
  misc_feature (367)..(367): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctggagaccctgtccctcatttgcactgtgtctggatccaccgtcacagattcggttccttcgnggggctcggggtccggcacgtccccgagagaagggtctaggagtggagttgggagtgtactataagtcggggatcaatagtcgtggtgaccncgtacctacgtactaacccgtntttaagacgtcgtatcacttatatcagtgcgctcgtcacgaacctgtcctcccgtgaggtatgagtacttcgtggtcgaccgggccgacgacgacgaccggacctaaggttcgtttcgtaggtacggaccgtaggaccgacccggtagttacgccggtacgccgtggagtcacgttcggtacttccgagtcggccgttggggaccctgggccgtcccgtggtcc

SEQ ID NO: 85960 - DNA, 1023 bp, Homo sapiens
  misc_feature: GYAE6OF02IQO89.21.45.E01.1.454.CMB.1.raw
  modified_base (207)..(207): a, c, t, g, unknown or other
  misc_feature (207)..(207): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctccagatgggtcctgtcccaggtccacctgcaggagtcgggcccaggactggtgaagccctcggagaccctgtccctnatttgcactgtgtctggactccgaccgtcacagtacttcggttccttcgtcggggtccgtcgggggtcccggccgtacggttcccccaagggtaacggtaacggggtccgtagggtaggtcgggtaagttggggaaggttcgtacgttaaggttaaggtaccgggggtagtaccgtaagtacgtcgggtcggtagtaacctaccttaccccgtaacttaacccgtaacccgttactttttaacggaacgttaccggtacgtacctaacttacgttaacttacgaaggtcggtaccgtccgttacccggttacccaaaccgggttaaacccctaacggggtttcccccttaaccccggtagggtaaaccggggtaacgttaacgggtaaacggttaaccgttaccgggtttacgggttacccgggggtaacccggggttacccgggtaacccggaaaacgggttaaccccgggtaaaccccgggggtaaccccgttaaaacggggtttttaccgtttttttacccggttaacgggggtttccggaaacccggggtaacgggtaaacccccgggggtaaacccccgggggtttaaacgggtttaacgggacccgggttaaaccccggggttccccgggtaagggggggtaacccgggttaccccgggtttaaacccggtttaccggggggttttaaaccccgttttcccggggaaaccggtttccgggggtttacccccgggttaccgggggggggtcccccgggtttacccggggggaaccccccggttttccccggggttacggggtttacccccg

SEQ ID NO: 85961 - DNA, 554 bp, Homo sapiens
  misc_feature: GYAE6OF02FITQT.21.45.E01.1.454.CMB.1.raw
  modified_base (452)..(452): a, c, t, g, unknown or other
  misc_feature (452)..(452): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggatccaccgtcacagatggttccttcgtggggctgggtccggcagtccccagagaagggtctggagtggattgggatgtctataatacggggagtcaatatcggtggtgacactccctactacaaccgttctttaagagtcgagtcactatatcagtgcgctcgtccacgaaccaggtctcccgtgaggatggagatctgtgacggccgcagacacggcaagtattcngtagcgaggacgtacccgggattacgcgacgccgtcggaggcgtaacgtcggtacttacggacttcggccgtggggccgtcgggcccgtcccgtggttcccg

SEQ ID NO: 85962 - DNA, 678 bp, Homo sapiens
  misc_feature: GYAE6OF02I9LK2.21.45.E01.1.454.CMB.1.raw
  modified_base (210)..(210): a, c, t, g, unknown or other
  misc_feature (210)..(210): n is a, c, g, or t
  modified_base (271)..(271): a, c, t, g, unknown or other
  misc_feature (271)..(271): n is a, c, g, or t
  modified_base (335)..(335): a, c, t, g, unknown or other
  misc_feature (335)..(335): n is a, c, g, or t
  modified_base (401)..(401): a, c, t, g, unknown or other
  misc_feature (401)..(401): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaacgcccctggacgaccctgtccctnatttgcacttgtctctggacttccgacgtcacagatcggttcctcgtggggctgggccgancgtcccgagagtacgggtctaggacgtggtagtggagtgtactagtagtacggggatacaagtnttcggtgtcgaccaccttacctactaaccgtaaccgttactttaagacgtacgtataccatatacncgtagttcgaccgtccttacgacccgaacgaaccgtcggtacccttaccgaggaacggatggaagtactgtggacggccggtacgacgaaccgacgaccggtactaacggttctttcgtacggtcgcgaacggaccggtacccgggtaagttaccggaccgtaccggtaccggtgggaggtacccggtggttaaccgggttacgttaaccgaaggtcccggttccggttacgggggcccggttaacgggtcccgggtaccccggttggttaacccgg

SEQ ID NO: 85963 - DNA, 670 bp, Homo sapiens
  misc_feature: GYAE6OF02FQCWS.21.45.E01.1.454.CMB.1.raw
  modified_base (265)..(265): a, c, t, g, unknown or other
  misc_feature (265)..(265): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggatccaccgtcacagatggttccttcgtgggctggggccgnacgtcccagagaggtctggagtggtagttgggagtggtactagtaaggtacggggtatacgaatagtcggtggtcgacctaccgttacccgttaacctaaccgtaaccccgtttagttttaacggaagttaccggtacgttctaacgttataacgtcgaagttcgccgtacgtccgtacccacgaaacccgcggtttcctcccgtaggacggaattggaatacttcgtggtcggaaccggcccgtacgacgaccggacggtacccgaagtttccgtttcgtggtcgtaccggaacggacccgggtacccggtaggttacggacgccggtacgtgggaccggtacgtacggtacgttacgtcggacgtcggtccggtcgggtccggcggcccgtccgtggtacccg

SEQ ID NO: 85964 - DNA, 727 bp, Homo sapiens
  misc_feature: GYAE6OF02IQKDY.21.45.E01.1.454.CMB.1.raw
  modified_base (113)..(113): a, c, t, g, unknown or other
  misc_feature (113)..(113): n is a, c, g, or t
tcagtcgtcgctcgcacgaccggtgctcgatttagtgagtcagtaagggaaagggggctttcagagagtcatggacctcctgtgcaagaacatgaggcacctgtggttttccnctgctggtggcagctcccagatgggtcctgtccaggtccacctgcaggagtcgggcccaggctggtgaacgccctcggagaccctgtccctcatttcgcacgtgtcgtctggactcccaccgtcactacgagttcggtttccttcgtgggggtccgtcgggggtccggtctaacggtccccgaggaacggtaacgggtcgtagggaggttgggaggtttgggaggttgttacgtaagttaacggtacggggtaacgtactaaacgtaacgttcggtaggtacggaaccgtaccgttaccccttaaacttaaacccgtaaccccgtttacgtttttaaaaggacgttacggaacgttaaccaacgtttagtacttacgtagtaggtaccgtacgttaccccgttaccgaaccgaaccgtacggttaccgttccgaggtacggtacgtacgtaagtactcgttaccggacgggaacgccggctaacggaccgacccggtactaaggtttacttcgtggtcacgggacgtaccgggaccgtaagttcgacggacgtcggtaggacgcgtcgtagtctagacgtcgcggtacggtcggaccggtcggtaccgtgtacg

SEQ ID NO: 85965 - DNA, 788 bp, Homo sapiens
  misc_feature: GYAE6OF02H8ZC8.21.45.E01.1.454.CMB.1.raw
  modified_base (651)..(651): a, c, t, g, unknown or other
  misc_feature (651)..(651): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctccagatggtcctgtcccaggtccacctgcaggacgtcgggcccaggactggtgacgcccgtcggacgccctgtcccctgatttcgcactgtcgtactgggtactacccgaccgtcaacgtacggagttccggttccctttcggttgggggccttcgggggtacccggcgtaccgttccccgaagtacgggaaacgggttcgtagggtaggttggagttggggtaagttgtaccgttaagtaacggttacgggggtataccgaaagttacgtacggttggtacgtaccgaaccgttccccttaacgtaaccgtaaccccgtttacgttttaaacggacgttaccgtaagtcaacgtttaactacgtaccgaggtacgtaccgtccgttacccgtaacccgtaacccgaaaccgttcggtcccttacccgtggaacggtacttacggatacgttaccgtggttaccggaccggccgtaagaccggaccgtacgtaaccgtaaggtttaacttcgtacgggtanacgggtaacggccggtaaacccggttggtaaccggacggtccgacggttaccgggagtaccgtccggttacggttaccttacgggctaccgggtccggtggggttaacccgcgggtaccctacccggttggaacccg

SEQ ID NO: 85966 - DNA, 788 bp, Homo sapiens
  misc_feature: GYAE6OF02GGA72.21.45.E01.1.454.CMB.1.raw
  modified_base (193)..(193): a, c, t, g, unknown or other
  misc_feature (193)..(193): n is a, c, g, or t
tcagtcgtcgctcgcacgaccggtgctcgatttagtgagtcagtaagggaaagggggcgtttcagagagtcatggacctcctgtgcaagaacatgaggcacctgttcggtttttcctcctgctggtggcagcctcccagagtgggtcctcgtcccaggtccacctgcaggagtcggcccaggcgtggtgaacncccgtcggacgtacccgtcgtccctgtactttcgaccgacttcgtcgtccgtaggtctacccgaccgtcacgagtcgttcggttcctcggtgggtcgtcgggtccggcgtaccgtccgagaggtaacggtcgtggacggtggaggtcgggtagtgtacgtaagttacggtacgggtactcgtaagtacgtggtcggtacgtacgtaccgttcctaaccgtaaccgtaaccgttacgtttaacggacgttacgtacgtacgtactagttacgtcgtagtcgtaccgtcgtaccggtacctaccgaccgtaccggtacctcccggaggtaaccggtagtacggtacgtacgttaccgtgggccgtaaccgggtccgtaacgtaccggaaccggtaccggtaaccgtttaaaggttacgtttagtccggttacgggaaccggttaaaccgggacccgttaacccggggtaggttaacccgaaccggtaccggtcccgggttaggaacccggtttccggaaccggtttcggtaacgttacggacgtccggggttaaccgggtcccgggacggtcccggtaccggttccggtagttaccg

SEQ ID NO: 85967 - DNA, 731 bp, Homo sapiens
  misc_feature: GYAE6OF02I5IX8.21.45.E01.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggaggtccgggcccaggactggtgaacgccctggacgaccctgtccctntatttgccacgttgttcgtcgtggactcccgaccgtcacgagattcggttccttgtggggctcgggtccgcgacgtcccgagacggtaacgggtctaggagtggtagttgggagttgtacgtaagtaacggtacgggagtcgaagtacgtcgtggtacgactaccgttaccctaactacgtaacccgttactttaagacgtacgtacgtactaacgttattaactacgtaggtcgcgtaccttccggtacccgaacgtaacccgtcggtacccttcccgtagggacgtagtgaagtacgtcgttaggtacggaccggtaccgacgaaccgaccgaaccggtacctaaaggtttacttccggtagttcggaccggtaacgtaacccgggtacccgggttaagtacggaccggtaccgtccgggtacggaccgtacggtaaccggttcggtttaaccgttcgtaacggttccggtaccgggtaccgggccggtcccggtcccggttaccggttcggtaccgg

SEQ ID NO: 85968 - DNA, 952 bp, Homo sapiens
  misc_feature: GYAE6OF02JVY2R.21.45.E01.1.454.CMB.1.raw
  modified_base (182)..(182): a, c, t, g, unknown or other
  misc_feature (182)..(182): n is a, c, g, or t
  modified_base (208)..(208): a, c, t, g, unknown or other
  misc_feature (208)..(208): n is a, c, g, or t
tcagtcgtcgctcgcacgaccggtgctcgatttagtgagtcagtaagggaaagggggcgtttcagagagtcatggacctcctgtgcaagaacatgaggcactgtggttttcctcctgctggtggcagctccagatgggtcctgtcccaggtccacctgcaggagtcgggcccaggactggtnaagccctcggagaccctgtccctacntttgcacgtgtcgtctaggactacccgaccgtcaaccgagtacgttcggtttcccttggtggggtccgttcgggggttccccgggcgtaaccggttccccgaacgggaaggtaaacggggttccgttcggggaggttaggggtagtttagggggacgttcggtacgtttaacgtaacgtaccggggggtaactaccggtaaagtttaacgtacgggttcgggtacgtaaaccggtacctacccccttaaccgtaacccgttaacccggtttacttttaaacggtacggttaccggtaacggtaccgtacttaagtacgttaccgtaagtccgaccgttcccttaccggtaccctaaccggtaaacccgtacgggttacccttccccgtaggtaacgggtaacgttaggtaaacgttacgttccggtacgggtttacgggaacccgggtccggtaaccgtaccgggtaaacccggaacccgggtaaccccgtaaagggttttaaccttttaccggtacgggttaccggtaaccgggaaaccgggtaccccgggtaaaacccccgggttacgggtttaaaacccgggtcccggtaaccgggtaccggtacccggggaaacggtcccgttaaaccggggtttacggttacccgggttacccggttaacggtttacccgggcccgggtttaccgggggacccggtttcccgggggacccttacccggggtttcccggttaaccccggg

SEQ ID NO: 85969 - DNA, 605 bp, Homo sapiens
  misc_feature: GYAE6OF02G0CSK.21.45.E01.1.454.CMB.1.raw
  modified_base (412)..(412): a, c, t, g, unknown or other
  misc_feature (412)..(412): n is a, c, g, or t
  modified_base (420)..(420): a, c, t, g, unknown or other
  misc_feature (420)..(420): n is a, c, g, or t
  modified_base (425)..(425): a, c, t, g, unknown or other
  misc_feature (425)..(425): n is a, c, g, or t
tcagtcgtcgctcgcacgaccggtgctcgatttagtgagtcagtaagggaaagggggctttcgagagagtcatggacctcctgtgcaagaacatgaggcacctgtggttttcctcctgctggtggcagctcccagatgggtcctgtcccaggtccacctgcaggagtcgggcccaggactggtgaagccctcggagaccctgtccctcatttgcactgtcgtctggatccaccgtcacagattcggttccttcgtggggcttcggggtccggcacgtccccagacgaaggtctggagtggagttgggagtgtcgtagtaagtacggggagtcgaatagtcggtggtcgactactccctactacaaccgtctttaagagtcgagtcactatatcagtgcgctcgccacgaccnggtctccngacgntgagactcgtgtgacgtcgcgacgaccgacggacaagttacttcgtagtgacgtaagaccggacccggtagttacggaccgtaccgccgttagggacgtccgtaacggttcggttaaccgttcggacgttcggtcccggttacggggtcccgttcggggcccgtcccggttaggtacccg

SEQ ID NO: 85970 - DNA, 849 bp, Homo sapiens
  misc_feature: GYAE6OF02HSR17.21.45.E01.1.454.CMB.1.raw
  modified_base (164)..(164): a, c, t, g, unknown or other
  misc_feature (164)..(164): n is a, c, g, or t
  modified_base (209)..(209): a, c, t, g, unknown or other
  misc_feature (209)..(209): n is a, c, g, or t
  modified_base (226)..(226): a, c, t, g, unknown or other
  misc_feature (226)..(226): n is a, c, g, or t
tcagtcgtcgctcgcacgaccggtgctcgatttagtgagtcagtaagggaaagggggcgtttcagagagtcatggacctcctgtgcaagaacatgaggcactgtggttttcctcctgctggtggcagctccagagtgggtcctgtcccaggtccacctgcaggngtcgggccaggactggtgacgccctcggacgaccctgtccctagnttcgctacgtgtgtcgnggtactccctacggtacaactagtacgttcggttccttggtcggggtcgttcggggtaccggcgtaccgtcccgagacggtaggtcgtggacgtggaggtgggagtgtactagtaacggtacgggagtactaagttagtcgtgggtactaccgaccgttaccctaacgttaaccgtaaccccgtttacttttaaacggaacggttcgtaacggtactaaccgttaagtaacgttacaacggtcgtaccgtaccgttccccggtaaccctaacccgggtaaaaccgttaccggttaccccggttacccgttaacgggggtaaacggtaacgttacgggtaaagtttaaccggttcggttaacgggtacccgggaaacccggttcccgggtaaccgaaacggtaaccccggaaacgggtaccgttaaaacggtttacgttttccggtaagggttacgaccggggtaaacgtacccggggtaaacccggttaagggttacgacccggttaaccggccgggttaccgggacggttaccgtaacgggttacggttaccctcgggttaaccgcgggtcccggttacgggggtcccggtaccggggtcctaccccggttaggtaccccgg

SEQ ID NO: 85971 - DNA, 782 bp, Homo sapiens
  misc_feature: GYAE6OF02HHT8A.21.45.E01.1.454.CMB.1.raw
  modified_base (207)..(207): a, c, t, g, unknown or other
  misc_feature (207)..(207): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctggagaccctgtccctnatttgcactgtgtctggatccaccgtcacagactggttccttcgtggggctcgggtccggcacgtccccgagacggaagggtctggagtggagttgggagtgtctagtaagtacggggagtacgtaatagtcggtggtagacctacgtacccctaactaacctaaccccgttacttttaaacgagttcgtaagtccaacgtttatacgtactaggtcgacgtcttaccgtccaacgtaacccgtaggggttccctacccgttggaacggtagtacgtaaggtactcggttggccggtaaccggggcccgtacgaacggaacccgaccgggtaaccctaaaggttaccgttttccgtacgggttacggacccggtaacgggtaaccggggtaacccccgggttaaagggttaccggtaccgggtaaccgtccccgggttagggggaaccggtcccggtaaaccgggtttcggggttaaaccctttacccgggaacgttcccggggtcccgggttagggggggtacccccccggttgggggtacccccggtccccgggtttacggggttaaccccgg

SEQ ID NO: 85972 - DNA, 723 bp, Homo sapiens
  misc_feature: GYAE6OF02IZQ4Z.21.45.E01.1.454.CMB.1.raw
  modified_base (271)..(271): a, c, t, g, unknown or other
  misc_feature (271)..(271): n is a, c, g, or t
tcagtcgtcgctcgcacgaccggtgctcgatttagtgagtcagtaagggaaagggggctttcagagagtcatggacctcctgtgcaagaacatgaggcacctgtggttttcctcctgctggtggcagcctccagatgggtcctgtcccaggtccacctgcaggagtccgggcccaggactggtagaacgccccgtcggacgaccctgtcccctctagtttcgactactgtgtctggactcccaccgtcaacagtacttcggttccttcggnggggtccgtcggggtccggcgaccgtccccgaggtacggtacggtcgtggtaggtggtaggttgggagttggtacttaaggtaaggtacggggtatacgtaaagtacgttcggtggtacgtacctaccgttacccgtaaccgtaccgtaaccgtttacgtttaagacgttacgtacgttacctactaatactacgtagtcgacgtccgtaccgtaccgaaccgaaccgtacgttaccctacccgtaggaggtaacgtaggtaagtacgttcgtacgtacggaccggccgacgaacggaccgaccgtacgtaacgtttcgttacgtggtacgacgtaaccggaaccggtacccgtaagtaccggacgtacgtccgtaggaccgtacgtacggttaccggtactacgacgttccggccggtccgggtccggtccggtcccgtcccggtagtccg

SEQ ID NO: 85973 - DNA, 762 bp, Homo sapiens
  misc_feature: GYAE6OF02I8UH1.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggttttcctcctgctggtggcagctcccagatgggtcctgtcccaggtccacctgcaggagtcgggcccaggactggtgaacgcccgtacggagaccctgtccctctatttcgacactgtgtcgtggactcccgaccgtcacgtagtagtcggtttccgttcgtcggggtcgttcggggtaccggccgtaccgtccccaggacggtaaggtcgtggtaggtggtagttgggagtgttactaaggtaagtcggggtatacgtaatgtcggtggtcgacgtaccttcctaactaccgtaaccgttacgttaagacgtcgtagtctacttagtactgtagtcgtacgccgttacgtcccgaacgtaaccgtacgtcccgtccgtaggacggtacgtacgtacgtacgttcgtaagggtcgtaccgggacccgacgtacgaaccgtaccgggtaaccgtagtttacgttcggttacggtaccgtaacggtaccggtacggttaacccccggtaggtaccggaccggtaccgtaccgggtcggggtaaccgtaccggtaacggtttaaccggttaccggttacccggagggttacccggtacggggttaccccggggggtccgttacccggggaccccgttcccccgggttagggttaccccg

SEQ ID NO: 85974 - DNA, 891 bp, Homo sapiens
  misc_feature: GYAE6OF02I05EW.21.45.E01.1.454.CMB.1.raw
  modified_base (212)..(212): a, c, t, g, unknown or other
  misc_feature (212)..(212): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaacgcccgtcgggacgaccctgtccctntatttcgcacgtgtcgtcgtggacttcccgaccgtcaccagacgttcggttcccttcggtcggggcttcggggtccgcgtacgtccccgaggacggtaggtcgtagggagttgggaggtttggggagttcggtacgttaagttaacgggttacgggggtagtaacgtaaattacggttacgggtacggttacgaccctaccgttaccccgtaactaaccgtaaccccgtttacgttttaaacggacggttaccgtaacgttaccgtaaccttagttacttcgaacggttcgtacccggtaccttccggtaacccgtaaacccggtaacccggtaccgggttacccttacccggtacgggtaaacgggttacgtacggtaacgtacttccggttacggggaccggtacccggggttaccgtaccgaaccggttaaccggaccggggttaaccttaaacggtttaccggttttaccgtacgggttcggtaaccggtaaacggggtacccgggtaaccccgggttaaggttacccgggaccgggtacccggtaccgggtttaccggggacggttacccggtaacggttttaccgggttaacccggttcgtaaccgggttccggtcccggggtacgggggttacccggttacgggccccgggttcccggtaccggttacccgg

SEQ ID NO: 85975 - DNA, 858 bp, Homo sapiens
  misc_feature: GYAE6OF02F1UU9.21.45.E01.1.454.CMB.1.raw
  modified_base (114)..(114): a, c, t, g, unknown or other
  misc_feature (114)..(114): n is a, c, g, or t
  modified_base (208)..(208): a, c, t, g, unknown or other
  misc_feature (208)..(208): n is a, c, g, or t
tcagtcgtcgctcgcacgaccggtgctcgatttagtgagtcagtaagggaaagggggctttcagagagtcatggacctcctgtgcaagaacatgaggcacctgtggtttttccncctgctggtggcagctccagatcggtcctgtcccaggtccacctgcaggagtccggcccaggactggtgaagccctcggacgaccctgtccctntatttgcatgtcgtacgtggactccaccgtcacagtacgttcggttaccttcggtggggtccgtacggggtcccggaccgtacggtccccgaaggtacggaacgggtccgtagggacggttaggggtagtttgggaaggttggttacgtaagttaaaggtacggggtacgtacgtaagttacgttcgggtaggtacgtaactaccgttacccctaacttaacccgtaaacccggtttaccttttaaacggtacggttaccgaacgttaccaacttaataactacgtaaggtcgaccgtcgtaccgtccgaaccgtaaccgtaacggtcccgtacccggtaggaacggtagtacggtaacgtacgttccgtacggtacgggaccgggtaccgaccgtaaccggaacccggtaaccggaaccgtttaacgggtttaaccgttttacggtaacgggttccggtaaccgggtaaacgggaccccgggttaaaccccgggttaggttaacccgggtccggaaccgttaccgggtacggtaaccgggtccggtaaccggtttccgggttaaccgttcccggtaacgttcccgggttcccgggtaggggttccccggttaccggggtcccggttaccccggttcccgggttacccgg

SEQ ID NO: 85976 - DNA, 869 bp, Homo sapiens
  misc_feature: GYAE6OF02JM6AQ.21.45.E01.1.454.CMB.1.raw
  modified_base (206)..(206): a, c, t, g, unknown or other
  misc_feature (206)..(206): n is a, c, g, or t
  modified_base (265)..(265): a, c, t, g, unknown or other
  misc_feature (265)..(265): n is a, c, g, or t
tcagtcgtcgctcgcacgaccggtgctcgatttagtgagtcagtaagggaaagggggacgtttcagagagtcatggacctcctgtgcaagaacatgaggcacctgtggtttttcctcctgctggtggcagctccagagtgggtcctgtccctaggtcccaccgtgcaggtacgtcggccctaggacctggtgaacgccctacgganaccctgtccctcatttgcactgtcgtctggactccaccgtcacagattcggttccttgnggggtcctcggggtccggtctacgcccctaggacggtaacgggtctacgggaggttggaggttggggagttcggttactagtaggtaaccgggggtataccgtaaatacggtccggtggtacggtacctaccgttccccgttaactaacccgtaacccgtttacggtttaaacgtcggttaaccgtagttacctaacctttaaagcgtttacccgtaagtcgggtccgtacccttaccggtaccccgtaacggaaccccgtaaccgggtcccgttacccgttacggtaacggtaacgtacggtaacgtacgttacggtaccggtaccggtaaccgggtccggtaaccgaaccgggaccgtacccgggtaacccgttaacgttaccgttttaccggtacggttacgggccgggttaaaccggaaccgggttaacccccggggtaaggtttaaccggaccccggtaaccggacccggttccggggaacggtacccggtaacccgggtttaggtacccggttaacggtaacccgtccgggttaccccgggttaaccgggggtcccggttccggggaccccccggttaccggtcccgggttaccccgg

SEQ ID NO: 85977 - DNA, 832 bp, Homo sapiens
  misc_feature: GYAE6OF02IVKFF.21.45.E01.1.454.CMB.1.raw
  modified_base (207)..(207): a, c, t, g, unknown or other
  misc_feature (207)..(207): n is a, c, g, or t
  modified_base (256)..(256): a, c, t, g, unknown or other
  misc_feature (256)..(256): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcggcccaggactggtgaagccctcggagaccctgtccctnatttggcactgtgtcgtggactccaccgtcacagattcggttccttcgngggctgggtccggcagtccccgagagaagggtctggagtggagttgggagtgttcgtataagtacggggagttccgaatagtcggtggtacgactaccttcccgttaacttaacctaacccgttacgtttttaacgacgttacgaacgtttccaacgttagttaacttactaacggtcgggtaccgtccgttccggttaccccgaacggtaaccctacgggtttaccctccccgttagggacgggtacgttacgaacggttacttcggtttacgccgggttaacccgggccccggtacgtaacccggtaaccggtaacccgggtaaccggttaaacggtttaaacgtttttcccggacggttttaccgggtacggaaaccggggtaaaccgggaaaccccccggggttaaggtttaaaccgggtacccggtaaccgggtaccccgggttcgggaacggggtacccgtacgggttttaaccggtttaccggttaccgtaccggtttaccgggttccgggttacccgggggtacccgggttaccggtaccccggggttccccgttacggggttcccgg

SEQ ID NO: 85978 - DNA, 1069 bp, Homo sapiens
  misc_feature: GYAE6OF02IH4TZ.21.45.E01.1.454.CMB.1.raw
  modified_base (112)..(112): a, c, t, g, unknown or other
  misc_feature (112)..(112): n is a, c, g, or t
tcagtcgtcgctcgcacgaccggtgctcgatttagtgagtcagtaagggaaagggggctttcagagagtcatggacctctgtgcaagaacatgaggcacctgtggttttccncctgctggtggcagctccagatcgggtcctgtcccaggtccacctgcaggacgtccgggacccaggtactgggtacgaacggtccccgttacgggacgaccccttcggtcccccttacgtaacgttttcggaccctaaccgtttgggttacggttccgttacgggtaaccttaccccgacccggttaccaaaccgtaacggttacgtttccgggtttcccctttcgggtcgggggttccgttaccggggggtcccgggtaccgtaaccggttacccccgaaggtaacggtaaacgggttccgtagggtacggtacgggtaggttaggggtacgttacggttacgtaacggttaacgggttaccgggggtaacttaccgtaaacgtttacggttaccgggttaggtaccgtaaccttaccgttaccccgttaaccttaaccccggttaaccccggtttacgttttaaacggacggttaccggtaacgttaccgtaaaccttacggttaactaccgttagggttacgtacccgttaccgttaacccggtaccctaaacccggtaacccggttaacggtttcccccgtaaacccgggttagggtaaacggttacgttacggtaacgttaccgttaaccggtttaggtacccggtaacccgggtaacccgtacgaaacccgggtaaccccggtaaccgggtaaaccctttaaaggttttcgtttaccggttaaacggggtacgtaaacccggggtaccgggttaaccccggggttaacccgtttaacggggttacggtaaccccgggtaaccggggcccggttaaggggacccggttacggtaaccggggttttaacccggtttaacggttaacccggaggggtttaccccggtaccggggtttacgggggtccccggttaacccggggtccccgggttacccggttaccggttaacccgg

SEQ ID NO: 85979 - DNA, 632 bp, Homo sapiens
  misc_feature: GYAE6OF02FY2E5.21.45.E01.1.454.CMB.1.raw
  modified_base (253)..(253): a, c, t, g, unknown or other
  misc_feature (253)..(253): n is a, c, g, or t
  modified_base (389)..(389): a, c, t, g, unknown or other
  misc_feature (389)..(389): n is a, c, g, or t
  modified_base (408)..(408): a, c, t, g, unknown or other
  misc_feature (408)..(408): n is a, c, g, or t
  modified_base (430)..(430): a, c, t, g, unknown or other
  misc_feature (430)..(430): n is a, c, g, or t
  modified_base (475)..(475): a, c, t, g, unknown or other
  misc_feature (475)..(475): n is a, c, g, or t
  modified_base (482)..(482): a, c, t, g, unknown or other
  misc_feature (482)..(482): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccagggtccacctgcaggagtcgggcccaggactggtgaagccctcggagaccctgtccctcatttgcactgtgtctggatccaccgtcacagatggttccttcgnggggtctgggtccggcacgtccccagagaagggtctggagtggattgggagtgtctataagtaggggatcaatagtcggtggtgacactccctacgtaccaaccgttcttttaagagtcgagtcactatatcagtnacgctcgtccacgaaccgnggtcctcccgtggacgtatganacttcgtgtcggacggccgacgagaaccgacgggaccaaaggttnttttcgngttgacggacggtaccggtaccccgggtaagtttacggaccgtaccggtccgtaggggacggaccgtaacggttcgggttaaccctttacgggattccgggaccggtttcgggggcccgttaggggccccgtaccccgtgggttaccccg

SEQ ID NO: 85980 - DNA, 781 bp, Homo sapiens
  misc_feature: GYAE6OF02FUBSR.21.45.E01.1.454.CMB.1.raw
  modified_base (208)..(208): a, c, t, g, unknown or other
  misc_feature (208)..(208): n is a, c, g, or t
tcagtcgtcgctcgcacgaccggtgctcgatttagtgagtcagtaagggaaagggggctttcagagagtcatggacctcctgtgcaataacatgaggcacctgtggtttttcctcctgctggtggcagctcccagatgggtcctgtcccaggtccacctgcaggagtcgggcccaggactggtgaagccctggacgaccctgtccctnatttgcactgtgtctggatccaccgtcacagatcggttccttcgtggggctgggtccgcagtccccagagaagggtctggagtggattgggagtgtctagtaagtacggggagtcaagtatcggtggtgacgctcctactacaaccgtctttaagagtcgagtcacgtatatcagtgcgactcgtccacgaacctggtctcccgtagacggtatacggaagtacgttacgtcggttacggacccgggtccgacctaaacggacccggaaacccgggtacccgtaaaaagggttttaccgtttttaccgtacgggggtttaccggaaccgggtaaccggggttaaaccgggtaacccccccggggttaagggttttaaaccggggcccgggtaaaacccgggtccccggtttaagggggaacccggggttacccgtaaacccgggttttacggggtttaaacccccgtttaccggggtaaacgttttcccgggaccccgggttttaccgggggggggtaaccccgtttggggggaccccccggtttacccccgggttaggggtttaacccccgg

SEQ ID NO: 85981 - DNA, 689 bp, Homo sapiens
  misc_feature: GYAE6OF02HLKG6.21.45.E01.1.454.CMB.1.raw
  modified_base (182)..(182): a, c, t, g, unknown or other
  misc_feature (182)..(182): n is a, c, g, or t
  modified_base (206)..(206): a, c, t, g, unknown or other
  misc_feature (206)..(206): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcggcccaggactggngaagccctggagaccctgtccctnatttgcactgtgtctggatccaccgtcacagatggttccttcgtggggctgggtccggcacgtccccagtaggaacgggtctggagtggtagttgggagtgtactagtaagtacggggagtcaatagtcgtgtgactactccctactacgaaccgttctttaagacgttcgagtcctaactatacgtcacgtgaccgcgtccgtaccaacgaaccgaggttaccctcctacggaggtactgagtaacgtcgtagtcgaccggccacgaacggaccacgggacctaaaggtttacttcgtacggttaggaccggtacggaaccgggtaccccggtaggtttaaccggaccgtaacggtcccgtaggggaaccggtccggtaaccggtttacgggttaacccgttccgggtacgtttaccgggtcccggttcggggggtaaccccggttcggggtacccggttaccccggttacgggttaccccg

SEQ ID NO: 85982 - DNA, 712 bp, Homo sapiens
  misc_feature: GYAE6OF02IZ1W6.21.45.E01.1.454.CMB.1.raw
  modified_base (112)..(112): a, c, t, g, unknown or other
  misc_feature (112)..(112): n is a, c, g, or t
  modified_base (461)..(461): a, c, t, g, unknown or other
  misc_feature (461)..(461): n is a, c, g, or t
  modified_base (476)..(476): a, c, t, g, unknown or other
  misc_feature (476)..(476): n is a, c, g, or t
  modified_base (482)..(482): a, c, t, g, unknown or other
  misc_feature (482)..(482): n is a, c, g, or t
tcagtcgtcgctcgcacgaccggtgctcgatttagtgagtcagtaagggaaagggggctttcagagagtcatggacctctgtgcaagaacatgagcacctgtggtttttccnctgctggtggcagctccagagtggtcctgtcccgtaggtccacctgcgaagggaggtccggacccaggactgggtagaacgcccgtacggacgtacccttcgtccctcgtaacttgcctaccgttggtcgtcgtacggacttacccgaccgtacaacgacgtacgttcggtttccgttcgggtcgggtcgtccggggttccgacgtaccgtacccgaaggaacggttacggacgtggtaaggtggtaaggttggaggtcgtactaagtaacgtacgggtatacggtaattacgtcgtaggtaccgtacgaacctacctaaacgtactaaaccgttattaacgagtacgntacgtaactatacgngtacgngtcgtacgtcgaccgaaacgtctacgttcctaccgtagagtgttagacggttaattcggcgtaggaccggccgagtaaccgaccacggtaacgttaacttcgtttccgagtcgaccgtaggacccgttaacggtacgtacggtacaccgggagtacggacgaccggtaacgttgggtaccttaacggcgtcggcgttacggggcccgtacgggtccgtccgtacggtacg

SEQ ID NO: 85983 - DNA, 695 bp, Homo sapiens
  misc_feature: GYAE6OF02GSY8X.21.45.E01.1.454.CMB.1.raw
  modified_base (271)..(271): a, c, t, g, unknown or other
  misc_feature (271)..(271): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactgggtgaagccctggagaccctgtccctcatttgcactgtgtctggactccaccgtcacagattcggttccttcgtggggctgggtccggcncgtcccagagaacgggtctggagtggagttgggagtgtctagtaagtacggggagtcaagtatcggtggtgactactccctactaacctaaccgttctttaagacgtacgtagttcaacttatactacgagtgcgtctccgtaccaacgaaccgtacggtcctccgtagacggtatcggaagtacttccgtggtacggaccgggccgacgacggtaaccgaccgggtacctaaaggtttactttacgtacggttacggacggtaaacggtaaccgggaccccgggttaaaggtttaccggaccggtaccggtccggtagggacggtaccggtaacgggtttaacggttaccgttacggtaacgttcgggtacccggttacgggggcccggttaccggggtcccggttacccggtcgggtacccg

SEQ ID NO: 85984 - DNA, 693 bp, Homo sapiens
  misc_feature: GYAE6OF02ILIGJ.21.45.E01.1.454.CMB.1.raw
  modified_base (165)..(165): a, c, t, g, unknown or other
  misc_feature (165)..(165): n is a, c, g, or t
  modified_base (208)..(208): a, c, t, g, unknown or other
  misc_feature (208)..(208): n is a, c, g, or t
  modified_base (259)..(259): a, c, t, g, unknown or other
  misc_feature (259)..(259): n is a, c, g, or t
  modified_base (456)..(456): a, c, t, g, unknown or other
  misc_feature (456)..(456): n is a, c, g, or t
tcagtcgtcgctcgcacgaccggtgctcgatttagtgagtcagtaagggaaagggggctttcagagagtcatggacctcctgtgcaagaacatgaggcacctgtaggtttttcctcctgctggtggcagctccagatgggtcctgtcccaggtccacctgcaggngtcggcccaggactggtagaagccctggagtaccctgtccctnatttgcatgtgtctggactccaccgtcactagtagttcggttacctttcgnggggaccttggggtaccggctacggtccccgaagtacggtaagggtcgtggaggtcggtagttggggacgttgtacgtaacgtaaggtacggggacgtacgtaacgttagtccggtggttacgtaacctacccttacccgtaaactaccgtaaacccgtcttttaaacggagtcggtacgtcgtactatacttacgngtacgtaccgtcgtccgtacgaccgtaacccgtagtccctccctggacggtatagagtctcgtgtacgccggtacgcagtaccgacggtactaagttagttcgtagcgtacgaacgaccggtaccggtaacggtcgtaccgaccgttcgacggtacggtcgtaacggttacggtaccgttacgttacgaccggttcggttacgggtccggtacggtcccggttccgttaggtacccg

SEQ ID NO: 85985 - DNA, 577 bp, Homo sapiens
  misc_feature: GYAE6OF02FXX60.21.45.E01.1.454.CMB.1.raw
  modified_base (451)..(451): a, c, t, g, unknown or other
  misc_feature (451)..(451): n is a, c, g, or t
  modified_base (456)..(456): a, c, t, g, unknown or other
  misc_feature (456)..(456): n is a, c, g, or t
  modified_base (462)..(462): a, c, t, g, unknown or other
  misc_feature (462)..(462): n is a, c, g, or t
  modified_base (486)..(486): a, c, t, g, unknown or other
  misc_feature (486)..(486): n is a, c, g, or t
  modified_base (519)..(519): a, c, t, g, unknown or other
  misc_feature (519)..(519): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcggcccaggactggtgaagccctcggagaccctgtccctcatttgcactgtgtctggactccaccgtcacagattggtccttcgtggggctggggtccggcacggtccccaggaggaagggtcctgggacgtgggagttgggggacgttggtacgtataaagtacggggggagtacaagtatcggtggtgaactactccctaactaacacccgtcttttaagacgtcgatcactatatcagtgcgctcgtccaacgaccaggtcctccagaggactgatatacnggtcncgggcncgacggacacgcaagtactttcgngtcgcgagacgacccggtagtacgcgacgccgnggaggccgtcgtggtactcggactggcgtcgggccggtcggccggtcccgtgtaccgg

SEQ ID NO: 85986 - DNA, 697 bp, Homo sapiens
  misc_feature: GYAE6OF02I1CAP.21.45.E01.1.454.CMB.1.raw
  modified_base (212)..(212): a, c, t, g, unknown or other
  misc_feature (212)..(212): n is a, c, g, or t
  modified_base (274)..(274): a, c, t, g, unknown or other
  misc_feature (274)..(274): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctccagatgggtcctgtcccaggtccacctgcaggacgtccggcccaggactggtagaagccccgtggacgaccctgtcccctnatttgacctacgtgtgtctggactcccgaccgtcaacctagtagttcggtttacccttcggnggggtccgttcgggggttcccggaccgtccggtaccccccgtaaggaaccgggtaaacggggttccgtaggggtacggttacggtaaggttacgggggtaagttcggtacgttaaagtaacgggtacggggtaacgttacgtaagtacgtcggtagtacgtacctctaccctactaacccgtaccgttagtttaacgagttacgtacgtacacttatagtacgacgtgcctcgttacgaccgaacgactacgtcctccgagacgtatagatcgtacgtgcgtaccggcacgacgaccgaccgtactaagtcttctgtagcgacgacgaccgtagtacgccgacgcgtcgacgtcgtaacgtaggttactgtacgtaccggtccggtacgggtcccggtacgtcccgttacccggtagtacccg

SEQ ID NO: 85987 - DNA, 748 bp, Homo sapiens
  misc_feature: GYAE6OF02HL4CM.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggtttttcctcctgctggtgcagctccagatgggtcctgtccaggtccactgcaggagtcgggcccaggacgtggtagaacgccctacggacgaccctgtccctcatttgcactgtgtctggactccgaccgtacacagtatcgttcctagtgggtcgtcgggtccgcgacgtcccgagagtaagggtctaggagtggtagttgggagtgtacgtaagtaaggtacggggagtacgaatacgtcggttggtacgaccgaccttaccctaacgtaacctaaaccccggtttattttaaacggacgttaccggtaagttaccgtaactttaactacgtacgtaaggtcgtaccgtaccgttaccggtaacccaaccggtaaaccgtaccggttcccttaccccgtagggaaacggtagtacggtaaagtacttacgtaggtaccgggtaccggaccgtacaaccggtaccgaaccgggacctaaaggtttacgtttacgtaggtacggacgtaacggaaccggacccggttaaggttacggaccgtaacccgtcgtacgggacggtacgttaacggtacggttacgttaccgagttaccgggtccggtacggggtcccggtcgggtaccccgtcggtcggtacccg

SEQ ID NO: 85988 - DNA, 717 bp, Homo sapiens
  misc_feature: GYAE6OF02IAK7L.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcggcccaggactggtgaagccctcggacgaccctgtcccctcatttcggctactgtcgtctcggactcccgaccgtcacgagtatcggttcccttcgtcggggcgtcggggtccggcacgtccccgaaggacggaacgggtcgtgggaggtggattggggagttgtcgtaagtaagtacggggagtactaagtagtcggtggtacgacgtacctaccctaacgtacctaaccccgttacgtttaaaggtacgtaccgtagttccaacttacttaacgtccgtaagtcggccgtccgtacccgtacccgaacggtaacccgtaggttccccttcccgtacggaacggtatacgaacgattcgtggtaccgtaccgggcccgacgtaacggaccgtaccgggacctaaggttacttcgtaggtacgacgacggaccggtacccggtagttaccgacggccgtccgtacgggacggtaccgtacggttccggtacttcggacgttaccggtccggtacggggcccggtcgggaccgttcccggacggttaccg

SEQ ID NO: 85989 - DNA, 845 bp, Homo sapiens
  misc_feature: GYAE6OF02HJOSD.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgttggtttttccctcctgctggtcggcagcctccgagagtcgggtcctcgtcccgacggtcccacctggcagggagtcccgggcccaaggacgtggtagaacgccccgtacggacgtaccctcgtcccctctattcgcacttgtgtcgtacgactccgacgtacagtagtattccggttccgtcggtggggtaccgttcggggtccggacgtaccggacccgaaggaacggtacgggttacgtgggtaagggtacgggttagggttacgggtacggttcgttacggttaaaggttaaacggggttacggggtaacggttaacaaaggtttaacggttaccgggtagggttacaaccccgttaccttaacccccgttaaaccgttaacccgttaaacccgtttaacgttttaaacggcgttaaccgtaacgttacctaaacgttataacgtacgtaacgtcggtacccgtccgttacccgtaaaccgtaccgtaaaccgtcggttacccgtccgtagggaaacggcgttaacgaggtacttacgtacgccggacggtaccgacgaacgacccggaacgtaccttaacgttcgtttacgtaggtaccggacgtaaccgggttacccgaacccgggttggtaaccgacgggtaccgtccgtagggtacgtaccgtcgtaccggtacgttacgaccggttcggtaccgggtcgggcccggccgggttcccgtaccgggtctaacccg

SEQ ID NO: 85990 - DNA, 837 bp, Homo sapiens
  misc_feature: GYAE6OF02J0MVX.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggacgtcgggcccaggacgtggtagaacgccctcggacgaccctcgtccctctatttcgactacgtgttacgtcgtacggacttcccgaccgttcaaccgtagtattcggtttccttcggtcggggccgtacggggtccgtaccgtaccggtaccccgaggaaggtacgggtccgtagggacggttggtagttgggtagtgttaccgtagtaacggttacgggagtactaagtacgtcggttggtacaacctacccttacccgttaactaacccgtaaccggtttacgtttaaacggtgttaccgtacgtactaactaagttactcgtaacgtcgtccgtaccgttccgtaccgaaccgtaaccggtgttacccgtacccgttagaacggtaagtacggtaactacggttacgtaggtaccggtaccgggtcccaagtacggtaaccgtacccgggaaacttaaccgggtttatttcggtacggttacggtaaacgggtaacggtaacccggtaacccgggttaaggtaacccggtaccgggtaaccggtccggttacgggtacccggtcgttaaccggtaccggttttaccgtaacccggttggttacccggtcccggggtttccggggacccgggtttcgggtaccccgggttacccggttcggttaacccgg

SEQ ID NO: 85991 - DNA, 566 bp, Homo sapiens
  misc_feature: GYAE6OF02HH0T8.21.45.E01.1.454.CMB.1.raw
  modified_base (254)..(254): a, c, t, g, unknown or other
  misc_feature (254)..(254): n is a, c, g, or t
  modified_base (410)..(410): a, c, t, g, unknown or other
  misc_feature (410)..(410): n is a, c, g, or t
  modified_base (537)..(537): a, c, t, g, unknown or other
  misc_feature (537)..(537): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggactccaccgtcacagatcggttccttcgnggggctgggtccggcagtccccagagaagggtctggagtggattggggagtgtctagtaagtacggggagtcaagtatcggtggtagacactccctaactacaacccgttctttaagagtcgagtcactatatcagtgcgctcgtccaacgaaccnggtcctcccgtgacggatgagatcgtgtgaccggcgcacgacacggaccaagttattcgtagttcgacgtagacgaacccggagttagccgacgcgtggacgcgacgtcggtactcgagtcgtccgnggggcccgtgggccgtcccgtggtacccg

SEQ ID NO: 85992 - DNA, 771 bp, Homo sapiens
  misc_feature: GYAE6OF02G6W9V.21.45.E01.1.454.CMB.1.raw
  modified_base (164)..(164): a, c, t, g, unknown or other
  misc_feature (164)..(164): n is a, c, g, or t
  modified_base (506)..(506): a, c, t, g, unknown or other
  misc_feature (506)..(506): n is a, c, g, or t
tcagtcgtcgctcgcacgaccggtgctcgatttagtgagtcagtaagggaaaggggctttcagagagtcatggacctcctgtgcaagaacatgagcacctgtggtttttcctctgctggtgcagcctaccgagtatgggtcctgtcccaggtccactgcgaggngtccggaccaggacgtggtacgaacgcccgtggaccgacccgttcgtaccccgattagtttcgcctacgttcggtacgtctacggtactaccccgaccgtcaacgtagtacgttcggttacccgttaggcggggtaccgttcgggtccggacctacgtaccccgaggtaggtaacggtacgtggtaggtggtaacggttgggtagtcgtacgttagtaacggtacgggtaagtacgtaagtacgtcggtgtacgactacctaccgtacgtaaccgtaccgttacgttaagcgtacgtagtctaattacgtatacgagtcgctacgtccgtaccgacgtaccncgtccgtaccgtagacggtatacgtacgtactaccgtggtaccgacggtccgtacgaacgtaccgaaccgtacttaacggtacgtttcggtagtaccgggtaccgtaacggacccggttacccggtacgtacggtaacccgtacccgggtcgttaaccgggccggtacggttaccggtttaccgtaacggttccctaacgggttcccgtacccggggttaccgggtaccggtcccgggttcccggtccggtttacccggtaccgg

SEQ ID NO: 85993 - DNA, 709 bp, Homo sapiens
  misc_feature: GYAE6OF02FPJOR.21.45.E01.1.454.CMB.1.raw
  modified_base (339)..(339): a, c, t, g, unknown or other
  misc_feature (339)..(339): n is a, c, g, or t
  modified_base (365)..(365): a, c, t, g, unknown or other
  misc_feature (365)..(365): n is a, c, g, or t
tcagtcgtcgctcgcacgaccggtgctcgatttagtgagtcagtaagggaaagggggctttcagagagtcatggacctcctgtgccaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggactccaccgtcacagatggttccttcgtggggctcgggtccgcacgtcccgagagaacggtctggagtggtattgggagtgtctagtagtacgggagtacatacgtcgtggtnactactaccctactacctaaccgttntttaacgacggtacacgtctactatactcgaagtcgacgtcgtccgtaccgtaacgaaccgtaggtcccttacccgagggtaaccggtagtacgggtaacgtaacttccgtagggtcggtaacccgggcccgtacgtacgggaacctaccggggtaccctaaagggtttactttaccggtggttacgaccggtaacggtaaccgggacccccgggttaaggttaccggaccggtacgtcccggtagggacggtaccctaacggttacgtaccgtttacccggaggtttaccggccggttacggggggtcccgttacggggcccggttacccgtgggttaccccg

SEQ ID NO: 85994 - DNA, 695 bp, Homo sapiens
  misc_feature: GYAE6OF02JNTTC.21.45.E01.1.454.CMB.1.raw
  modified_base (206)..(206): a, c, t, g, unknown or other
  misc_feature (206)..(206): n is a, c, g, or t
  modified_base (256)..(256): a, c, t, g, unknown or other
  misc_feature (256)..(256): n is a, c, g, or t
  modified_base (436)..(436): a, c, t, g, unknown or other
  misc_feature (436)..(436): n is a, c, g, or t
  modified_base (512)..(512): a, c, t, g, unknown or other
  misc_feature (512)..(512): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtccaggtccacctgcaggagtcgggcccaggactggtgaagccctggacaccctgtccctnactttgcctctgtgtctggactccaccgtcacagtatcggttacccttgnggggtctgggtccgcctacgtcccagaggaaggtctgggagtggagttgggagtgtactagtagtcgggtatcaatagtcgtgtagacactcctactaccgtaccgttcgtttaagagtccgtagtacacttatatcgtagtgtacgcttaccgtccaacgaccgtaggtcccttaccgngagtactgaagtcttcgttgagtaccggcctacgtacggacgtaacccggacgtaacggtttacgtttgttaccgngggtaacccgggtaagggaacccggtaaccccggggttaggtttaacccgaaccgggttaccggtaaccggtcgggtaacgggtacccgttacgggtaccgggtttaaacccttcgttaccggtcgggtacccggtttccggggggtccctcgggggtcccctaccccggggttgttacccgg

SEQ ID NO: 85995 - DNA, 735 bp, Homo sapiens
  misc_feature: GYAE6OF02F3POE.21.45.E01.1.454.CMB.1.raw
  modified_base (183)..(183): a, c, t, g, unknown or other
  misc_feature (183)..(183): n is a, c, g, or t
  modified_base (210)..(210): a, c, t, g, unknown or other
  misc_feature (210)..(210): n is a, c, g, or t
  modified_base (469)..(469): a, c, t, g, unknown or other
  misc_feature (469)..(469): n is a, c, g, or t
tcagtcgtcgctcgcacgaccggtgctcgatttagtgagtcagtaagggaaagggggctttcgagagagtcatggacctcctgtgcaaagaacatgaggcacctgtggttttcctctgctggtggcagctccagatgggtcctgtccaggtcccacctgcaggagtccgggccaaggctggtnaacgccctggacgaccctggtcccctntatttgacctacgtggtcgtaccttgggaaccttcccgtaccgtccaaactacggtaacttttccgggttttcccttcggggtggggtccgtttcgggggtacccggcctaccggtacccgaaggaagggtacgggtccgtagggtaggtggtagttagggacgttggtactaagtaaggtacggggatacgtaatcgtacggtggtagaacctacctccctaactaaccgtaaccggttatttaacggcgttacgganctatactagtcagtcgcgtcctcggtacccaaacggtccctacggtaccgtcccgtaaggcgacgtggtaactacgtcgttacggaggaccgtaccgcggacgtacggaccgtacgtaagttcgtttgacggtcgacgacggtaccggtaccgtacggtacggacctccggtacggtagaccggtcgttaacggtacggttaaccggtcgtaccgtacggtccgggtacggggtccggtacccggtgggtacccccgtgtaaccgg

SEQ ID NO: 85996 - DNA, 797 bp, Homo sapiens
  misc_feature: GYAE6OF02HRDZ4.21.45.E01.1.454.CMB.1.raw
  modified_base (244)..(244): a, c, t, g, unknown or other
  misc_feature (244)..(244): n is a, c, g, or t
  modified_base (525)..(525): a, c, t, g, unknown or other
  misc_feature (525)..(525): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctctgctggtggcagctcccagatgggtcctgtcccaggtccacctgcaggagtccgggcccaggacctggtagaacgccctcggagaccctgtccctcatttgcactgtgtctggactccgaccgtcaacngtattcggttccttcgtgggggtctcggggtccggacacggtaccccaaggaggtaagggtctacgggaggtggacgttgggagtgtataagtaacgtacggggatactaagtgtgtggacaacacctacccgtaactaaccgtaaaccccgttactttaaaggacggtacgtaacgttctaacgttaactacgtactaaggtcgtaccgtacgtccgtaccaaacccggtaaccctaacgggttccctcccggttaggtaacgggtaaactcgggtaaanacgttaccggttaggtcggtaccgggaccccgtacgaacggaacccggtaaccggacctaaacggtttacgttttacctagggttaccggaccggtaacggaacccggtaaccccgggttaaagttacggaaccggtacccggtacccggttacgggaacgggtccgtaacccggttacgggtttaaccgtttaccgggaacgttcgggaacccccgggttggggggtccccggttacgggggtccccttccccggggttacgggtaccccg

SEQ ID NO: 85997 - DNA, 755 bp, Homo sapiens
  misc_feature: GYAE6OF02HY4XT.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggtttttcctcctgctggtggcagctccagatgggtcctgtcccaggtccacctgcaggagtcggcccaggactggtagacgccctcggacgtaccctgtcccctctacgtttgcctacgtggttgtcgtggtactcccgtaccggtcaaccgtagtacgtttcggttacccgttcggtcgggggtccgttcggggtcccggactaccggtacccccgaaggtacgggtaacgggttctagggaggtaggtacggttaggggaggttcggttacgttaagttaaacggtacgggggacgttacgtaaacgttacgtcgggttaggtacgtaaccctaccgttaccccttaacgtaacccgtaaccccgtttgtttaaacgtcgtaaccgtacgtactaacgttactactacgtagtcgtaccttccgtccgtacccgaaccgtaaccgtcggttaccctacccgtaggaacgtactagtacgtagtcgtggtaccggaccgccgtacgacgtaccgaccgggtaacctagtttacgtccgtaggacgaccgtaaggacccggtacccgtaaggttacgacgccgtacggtcgtacggtctacggtcgtacgtcgacgtcgtcgggtacggccgtcggcctaccgtgtaccg

SEQ ID NO: 85998 - DNA, 1035 bp, Homo sapiens
  misc_feature: GYAE6OF02II6KO.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggttttcctcctgctggtggcagctcccagatgggtcctgtcccaggtccacctgcaggagtcgggcccaggactggtgaacgccctcggagaccctcgtcccgtactagtttcgaccaccgttggtcgttccgtgggacttcccgacccggttcctacgagtacttcgggttaccctttcggtcgggggtccgttcgggggttacccgaccgtaccggtacccccgtagggtaacggtaaaggggttccggtcggggtaggttcgggtaaaggttttcggggaaacggtttggttaccgtaaagttaaaacgggtttaaaccgggggggtacgttaacgtaaaacgtttacggtttaccgggttacggggttaccgtaaaacccgtacccgtttaaacccccgttaaccgttaaaaccccggttaaaaccccccgggttttaactttttaaaacgggtaccggtttaaccggttaaacggtttaccccggtaaactttaacgtttaaaactaccgttaacgggggttaccgttacccggtaccccggttttacccccggtaccccgggtaaaaccggtaaacccccgtttaacccggggtttccccgtttaaccccccgggtttaagaaccgggggtaaacgttacggaaaccggtttaaccgtttacccggttaggggttaccgggtaaacccggggccccgttaaacgggtaacccgggaacccgaacggggttaacccgtaaacggttttactttaaccggttcggtacgaacggtacgggtaaccgtaaccccggggttagttaaccggaccgggaccggtccgtacgggacggtaccctagggttcccggttaacttgggaccgttccggtaccggttacgggggttccccgtacccggggccggttccccggttgtaacccggg

SEQ ID NO: 85999 - DNA, 780 bp, Homo sapiens
  misc_feature: GYAE6OF02GLIFN.21.45.E01.1.454.CMB.1.raw
  modified_base (137)..(137): a, c, t, g, unknown or other
  misc_feature (137)..(137): n is a, c, g, or t
  modified_base (203)..(203): a, c, t, g, unknown or other
  misc_feature (203)..(203): n is a, c, g, or t
  modified_base (216)..(216): a, c, t, g, unknown or other
  misc_feature (216)..(216): n is a, c, g, or t
  modified_base (247)..(247): a, c, t, g, unknown or other
  misc_feature (247)..(247): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagcctcccagntgggtcctgtcccaggtccacctgcgaggacgtccgggcccaggactggtagaacgcccgtggacncccgtcgtccctntacttgcctactgtgtctgactccaccgtanacgagtattcggttccttcggtcgggctcggggtcccgcgaccgtcccgaggaacggtacggtcgagggtaggttaggtaggttaggggtgttacggttacttaaacggtaacgggttaacggggtagtaaccgaaagtttaccggttacggttacggtaccgtaacccttaaccccggttaccccttaacgtaaaccccgtaaccccgttttaacgtttaaacggtccgttaaccggtacttaacccgaacttacgttaacgtacgttacggtaccgtccgttccggtaccctaaccccgaaccggtaaccgtaccggtaccccgttccggtacggaaccggtaggtaacggacgttacgtgtacggcggacccggtcgacgtacggaccgtacgtacgtagttacgttcgtacgacggtacgcgaacggtccggaagtaccgcgtcggacgtcgacgtacgtacggtacggtaccgtcgtacgggtcggtaccgggtccgggtccggacggtcccgtacggttccggtacg

SEQ ID NO: 86000 - DNA, 715 bp, Homo sapiens
  misc_feature: GYAE6OF02HDIDX.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggtttttcctcctgctggtggcagctccagatgggtcctgtcccaggtccacctgcaggagtccgggcccaggactgggtgaacgccccgtcggacgacccctcggtccctctagtttcgcacttgtcgtctggactcccgaccgtcacgagtattcggttccttcggtggggccgttcggggtcccggcgtaccggtccccgaggaacggaacgggtctcgggaggtggtacgttgggagttgtcgtaagtaggtacggggattacgaagtacgttcggtggttcgactaccttaccctacgttaacctaacccgttatttaaggacgttacgtagttacctaacgttatacgtactagtcgtcgtaccgttaccgaccctaaccggaacccgtaccgggttcctacccggttagacgtacgtaggtacgtacgtacgttggtacgaccggtcgacgtacgaccgaacgtaccgtaagttcttacgtcgtacgacgaaggtaaccgacccggtaagtacggacccgacgtccgtcgggagtccgtaacggttggtacccgtgtaccgcggtcccgggtcgggcccggttcggcccggtccgtaggtcccg

SEQ ID NO: 86001 - DNA, 1026 bp, Homo sapiens
  misc_feature: GYAE6OF02FVMWT.21.45.E01.1.454.CMB.1.raw
tcagtcgtcgctcgcacgaccggtgctcgatttagtgagtcagtaagggaagggggctttcagagagtcatggacctcctgtgcaagaacatgaggcacctgtggttttcctcctgctggtggcagctccagatggtcctgtccagtccactgcaggagtccggccaggactggtgaacgcccgtacggaacgaccctgtcccctactacgttttcggcctacgttggttacgtccgttagggtaccttacccggtaaccgttccgaacgtaggtacgttaccgggttttccctttccgggagggggtccgttacggggggttcccggggtacgtaaccggttcccccgaagggtaacggtaaacgggggttacccttagggggtacggttagggtaacggtttcgggggtaacgttcggtttaaccgtaaggtttaaacggtaaccgggggtagttaaccggtaagttaaccggttcgggttagggtacgtaaccgtacccgttaccccgttaaccgttaaaccgtaaccccgttttacgtttaaaggtaaccgttacggtaacggtaccgtaaccgtttaacttaacgttaccgtaagttccggtaccgttacccgtaccggttacccaaaccggtaaacccgttacgggtttaacccctcccggttaaggtaacccgggaagttaccgggtaagtaccggttacgttttcgggaaccgggtaacccgggtcccggtaaacggtaccgggaacccggtaaacccgggtaacgttaaaccgtttaccgtttaccggtacggttacggaccgtaacgggacccgggttaacccggggttaacggtttaccgggacccggttaacccggtacggttaccgggggtaaccgtacccggtaacgggtttaaccgggtttacccttcgggggtaaacccttaccggggttaccccggggtttaacggggggtccccccggttaacggggtcccccgggttaccccggtttaccggggtttaaacccccgg

SEQ ID NO: 86002 - DNA, 807 bp, Homo sapiens
  misc_feature: GYAE6OF02G92T9.21.45.E01.1.454.CMB.1.raw
tcagtcgtcgctcgcacgaccggtgctcgatttagtgagtcagtaagggaaagggggctttcagagagtcatggacctcctgtgcaagaacatgaggcactgtggttttcctctgctggtgcagctccagatgggtcctgtcccgaggtccacgtgcaggtcgtcggccaggctggtgaacgccctggacgacccgtcgtccctatattcgctacgtgttcgtctaggtactcccaccgttcaccgtagtcgttcgggttccttcggtgggccgttcgggtccggcgtacgtaccccgaggtaacgacggtcgtggaggtggtagttggagtcgtacgtataaggtacgggtacgacgtaatacgtcggttcgtacgacgtaccgttaccgtaccgttaaccgtaaccgtttacgttaaacgacgttacgacgtacgtaaccgtttaagtacgttacgtaacggtccgtacgttaccttaccggtaaccgtaaccggtaaccgtaacgggttcccttaccggtaacggtacggttacgtacggtaacgtacgttcgtcggttaccgggtaacgggcccgtacgttaaccggaccggaacccgggtaacgttaacggtttaaaccctttgtacgggttaacggaaccgttaaggaaccccggggttaaccggaccgggttttaaggacccggtaaccgtacccggtacgggaaccggttaccggtaacccggttacggttacccggtatacccggtccggttacgggtccgggtacccgtcgggtacccgcccgggttagtaccccgg

SEQ ID NO: 86003 - DNA, 1044 bp, Homo sapiens
  misc_feature: GYAE6OF02ISS9O.21.45.E01.1.454.CMB.1.raw
tcagtcgtcgctcgcacgaccggtgctcgatttagtgagtcagtaagggaaagggggctttcagagagtcatggacctctgtgcaagaacatgaggcactgtggttttcctctgctggtgcagcctccagtatgggtcctgtccgaggtccacctgcaggagtccggaccaggactggtacgacgtcccgtaggactaccctgtccctctattcgctatgtgtcgtggtacctccgacgtcacgtagtacgttcggttccgtcgtggggaccgtcggggttaccgaccgtacccggttaccccgaaggtaacgggtaacgggttcggtacgggtaacgggtagggttaacgggtttacgggaacggttttacgttaaccggtaaaaggttaaaccggggtttaaaccggggggtacgtttaaaccgtaaaacggtttaacggtttcggttaaaggggttaaccgtaaacccgttaaccccgtttaacccccgttaaaccgtaaaccccggttaaaccccggtttttaacgtttaaacgggtaacgtaccgggttaacttaacccgtaaacggtttaacttaacgtaccggtaaacggtaccggttaccgtaccggttacccggtaacccgtaaacccgaccggtttaccggttaccctaaccggggtttaaggaaccgggtaacgttaacggtaaccggttacttacccggttaacggggtaacccggggaccgtaacccgggtaagtaaaccggggtaaaccccggtaacccgggtttaaccgtaaaacgtttttacgtttacccgggtaagggtaccgggtaaccgtaaaaccggggttaccccgggaaaccgggtttttaaagtaccccggggaacgttacccgggttaacccgggtagggtaaaccccgggttttacctaaaccggggttttacgggtaaccccggtttaacggacccgggtttacccgggtaccggggggtttaccccgggtaccggggtaacccgggtaccccgtttaccccggggttagaacccggg

SEQ ID NO: 86004 - DNA, 821 bp, Homo sapiens
  misc_feature: GYAE6OF02FN7HY.21.45.E01.1.454.CMB.1.raw
  modified_base (117)..(117): a, c, t, g, unknown or other
  misc_feature (117)..(117): n is a, c, g, or t
  modified_base (224)..(224): a, c, t, g, unknown or other
  misc_feature (224)..(224): n is a, c, g, or t
  modified_base (264)..(264): a, c, t, g, unknown or other
  misc_feature (264)..(264): n is a, c, g, or t
tcagtcgtcgctcgcacgaccggtgctcgatttagtgagtcagtaagggaaagggggtcgtttcagagacgtcatggacctcctgtgcaagaacatgaggcacctgtggtttttccncctgctggtggcagcctcccagatgggtcctgtcccaggttccaccttgcagggtacgtccgggaccctaggactggtgaacgcccgtacggagaccctcgtccctntagtttgctacgtgtcgtcgtaggactccgaccgtcaacngtacgttcggtttcctcgtcggggtactcggggtcccggtcaccggtcccgaacggtaacgtacgggtcgtacgggtacggttacgggtagttcgggggtaacggttcggtaaccgttaaggttaacggttacggggtacgtacgttaagtttacggttacggttacggtacgtacccgtaaccgttacccgttaacgttaacccgtaacccgttttaacgtttaaacgtacggttacgtacggtactacttactaactacgtagtcgtccgtacgttacgtacccgaacgtaaccgtcggttaccctccgaggtaacgtacgtaggaagttactcgttacggaacgccggtaccggacgtaaccggaaccgtaaccggtaacgtaagttacgtttacgtacgggtacggtacgaacggtaaccgggtaccggttaacggttagtaacccgtcggtaccggtagggacggtaccgttaacggttcggttaccgttacggtaacgttcgggtaccgggttcgggtacccgggtggtaccccggtcggttaccgggtcg

SEQ ID NO: 86005 - DNA, 859 bp, Homo sapiens
  misc_feature: GYAE6OF02GJ2BQ.21.45.E01.1.454.CMB.1.raw
  modified_base (114)..(114): a, c, t, g, unknown or other
  misc_feature (114)..(114): n is a, c, g, or t
tcagtcgtcgctcgcacgaccggtgctcgatttagtgagtcagtaagggaaagggggcgtttcagagagtcatggacctcctgtgcaagaacatgaggcacctgtggttttccncctgctggtggcagcctccagatcgggtcctgtcccaggtccacctgcaggagtcgggcccaggactgggtcgaacgccccgtacgggacgtacccttcgtcccctgtatttgcctactggtcgtctggactcccgaccgtcaaccgagtcgttcggtttacccgttggtcggggtaccgttcggggtccggtcgtaccggtacccgaaggtacggtaacgggttcacgggtaggtaggtaggtcgggtattcgttacgtaagtaacggtacgggtacgtacgtaagtacgttcggtaggtacgaccgtaccgttacccgtaacttaaccgtacccgttacgttttaagacgttacgaacgttacaacctttagttacgtacgtaaggtccgaccgtccgtaccgtaccgtaaaccgtaacccggttacggttaccccttaccgtacggtaccgggtacgtacggtacgtacttacggttacggtaccggtaccggtccaacgaccggtaaccgtaaccgggtacctaacggtttaactttccgtacggtacggtaccggtaaccggtaccgggttaccccggttaaggttacccggtaccgggtaaccggtacccgggtacgggtacgggtacccgttaacgggttaccggtttacggtaccgttaacgggttcccggttaccggggttaccgggggtccccgggttaccgggtaccccggttcccggtaacgggtttacccgg

SEQ ID NO: 86006 - DNA, 976 bp, Homo sapiens
  misc_feature: GYAE6OF02IT5I0.21.45.E01.1.454.CMB.1.raw
  modified_base (114)..(114): a, c, t, g, unknown or other
  misc_feature (114)..(114): n is a, c, g, or t
  modified_base (195)..(195): a, c, t, g, unknown or other
  misc_feature (195)..(195): n is a, c, g, or t
  modified_base (455)..(455): a, c, t, g, unknown or other
  misc_feature (455)..(455): n is a, c, g, or t
tcagtcgtcgctcgcacgaccggtgctcgatttagtgagtcagtaagggaaagggggctttcagagagtcatggacctcctgtgcaagaacatggggcacctgtggtttttccnctgctggtggcagctcccagatgggtcctgtcccaggtccacctgcaggagtcggcccaggactggtgaacgccctcgganaccctgtccctcatttcgctactgtgtcgtggactccgacgtcacagtacgttggttacccttggtcggggtaccgtccggggttccggccgtacggttacccccgaaggacggtaaacgggttcctaggggacgttagggagttaggggtagttcgtacttaaaggtaaacggtacggggtacgtacgtaaagttacgtcggtaggtacgaaccgtaaccgtacccttactaaccgtaacccggtttcgtttaaacggngttaacccgtaacgttcctaaacgttaattaacgtccgtaaggtccgtaccggtaccttaccggtaacccgtaaacccggtaaacccggtacgggttaccccttaccccggttagggtaaaccgggtacgttaacggtaaccgtttaacgttacggttaccgggtttaaacccggggaaccccggttaccgggaacccggtaaaccgggtaaccccggttaacccgggtaaaacccgttttaaacggttttaaaccggttttccgtaacggtaaccggggttaaccggtaaaccggggtaaaccccgggttaacccccgggggttaacttttaaaccggggacccgggttaaaccggtacccggggttaacggggacgttaacccggtacccgggttaaaccgggtttaccggtttacccgggtaaccgttaccggggttaccccggggttaccgggggtaccgggttaccccggggtcccccgggtttaacccgggtaccgggtttacccgttaacccgg

SEQ ID NO: 86007 - DNA, 682 bp, Homo sapiens
  misc_feature: GYAE6OF02GN2Z6.21.45.E01.1.454.CMB.1.raw
  modified_base (206)..(206): a, c, t, g, unknown or other
  misc_feature (206)..(206): n is a, c, g, or t
  modified_base (629)..(629): a, c, t, g, unknown or other
  misc_feature (629)..(629): n is a, c, g, or t
tcagtcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggctggtgaagccctcggagacctgtccctnattgcactgtcgtctggactccaccgtcacagtagtcggttccttcgtcggggtctcggggtccggactacggtccccgagtaaggaacgggtccgtagggaggtggtacgttaggggagtgtactaagtaaggtaacggggtagtacgtaagtagtcggtggtacgaaccgtaccgtacccctactaaccgtaaccccgttatttaaacggacgtacgtacgtacctaactagtaactcgtagtcgtaccgtacgttccgtacccaacgtaaccgacggttcccacccgtgggtaaggacgttaggaagtacttcggtacggtacggaccggcgacacggtacaccggtactaaaggttactttcgtagtcggacgaagggtacccgtaaccgggtaagtacgacgcgtaccggtgacggtnaccggtggtactcggagtccgcggtggggtaccctcggccgtccgtggtaccg

SEQ ID NO: 86008 - DNA, 820 bp, Homo sapiens
  misc_feature: GYAE6OF02G8L4X.21.45.E01.1.454.CMB.1.raw
  modified_base (114)..(114): a, c, t, g, unknown or other
  misc_feature (114)..(114): n is a, c, g, or t
  modified_base (274)..(274): a, c, t, g, unknown or other
  misc_feature (274)..(274): n is a, c, g, or t
tcagtcgtcgctcgcacgaccggtgctcgatttagtgagtcagtaagggaaagggggctttcagagagtcatggacctcctgtgcaagaacatgaggcacctgtggtttttccncctgctggtggcagctcccgagatgggtcctgtcccaggtccactgcaggagtcggcccaggactggtgacgcccgtggacgaccctcgtccctcatttcgctacttgtcgtacgtggtacctcccgacccgtcaactacgtgtttccgttccgttcggngggtccgtcgggccggtcgaccgtacccgaggaacggtaagggtcgtcgggtaggtacggtagttggggtagtcgtacgtaagtaacggtacggggtagtaacgtaagttgtacggttggtacgaaccttacccgtaccgtaacctaacccgttaacccgttagttaaacggtacgtacgttaacgttaccgtatttaacgtacgtagtacggtaccgttaccggtcccgttaacccgtaccccgtaaacccgggtaacccgtaaccgggtttcccgttaaccccggtggtaacggtacgtaacgggtacgtaccgttcggttacggcccgggaccggttccggaacgtacgggaacccgtaacgttaaccggtaaacctttcgttacggttacggttacgacggtaaccgggtaacccgttaaccgggttacgtacggaccgtacgtccgggtaggccgttaaccgtcggttacggtacctggtaccggtacgggtccggttaccgggtccgttaccgggtcccgttccgggtacgttacccggg

SEQ ID NO: 86009 - DNA, 819 bp, Homo sapiens
  misc_feature: GYAE6OF02JYH1N.21.45.E01.1.454.CMB.1.raw
  modified_base (591)..(591): a, c, t, g, unknown or other
  misc_feature (591)..(591): n is a, c, g, or t
  modified_base (805)..(805): a, c, t, g, unknown or other
  misc_feature (805)..(805): n is a, c, g, or t
tcagtcgtcgctcgcacgaccggtgctcgatttagtgagtcagtaagggaaagggggctttcagagagtcatggacctcctgtgcaaagaacatgaggcacctggtggtttttcctcctgctggtggcagcctcccgagtattcgggtcctacggtcccgtagggtccaaccgttgccgaggacggtccgggacccaggacgtggtagaacgtcccctagggacacccgttgtccctatagttcgctactggtcgcgtacggactacccgacgtccagtaagtccgttaggtttcccgtcggaggggtccgttcgggtccccgtacgtaacccggtccccgaaggaacggggttaaacggtccgttagggtaaaggtcgggttaaggtacggggtacgttaccgttagttaaacggaacggtaacgggggtattaacctaagttaacggtccgggtagtaccgacgtaccgtaccccgtaacgtaccgtaacccgtttatttaacggtaggtaccgtagtacctaactgtaactggacgtgccgtacctaccggtctaaccgaaaccgtgttacctccggtagtaccggtntaacggtcgttacgtcgttacggtaacggccggtaaccgtaccgacggtaccgtaaccggtaaccgttaacggtttcgttacggtaccgtacggtacggaacgttccgggaaccgttacggttacgaccggtacgttcgacggtaacgtacggttacggtaccgttcggtactacggtccggttaaccggtcgggtaccggtcggttaaccccncggtttaaccgtcc

SEQ ID NO: 86010 - DNA, 832 bp, Homo sapiens
  misc_feature: GYAE6OF02IJCKQ.21.45.E01.1.454.CMB.1.raw
  modified_base (110)..(110): a, c, t, g, unknown or other
  misc_feature (110)..(110): n is a, c, g, or t
  modified_base (118)..(118): a, c, t, g, unknown or other
  misc_feature (118)..(118): n is a, c, g, or t
  modified_base (536)..(536): a, c, t, g, unknown or other
  misc_feature (536)..(536): n is a, c, g, or t
tcagtcgtcgctcgcacgaccggtgctcgatttagtgagtcagtaagggaaagggggctttcagagagtcatggacctcctgtgcaagaacatgagcactgtggttttcnctgctggnggacacgctaccgagtacgtgggtcctggtacccaggtcctaccgtggcaaggcgtcgggacccaggacgtggtagaacggcccttgggaacgtccctggtccctacgatttcggaccttacgtggtacgtctacgggtacctacccgtaccgtacaaacgtacgggtaactttacgggtttcccttagggtcgggggtaccttaccggggtaccgtacgtaccggtaccccgtaagggtaacggtaaaggggttaaccgtgggtaacggtagggtaggttagggtaggttacgttacgtaaacggttaacggtaacggggtagtactaaaggttactggttacggtagaaccgtaccttaaccctactaaccgtaaccgttagttaaactacggtacgtaggtactaacgtaactanaccgtaagtacggactacgacgttccgaaccgtaacgaccgttacggtaccgagtacggaagtagtaagtaacgtacgtagacggtacgacccggacaaacggtaacacccgtaacttaaaccggtttactttaccggtacggtaacggtaccgaaccgggtaccgggaacccgtttagggtaaccggaccgtaccgtcggacgggtaaccggtcgtaacggtacggttaccgttacggtaacctaccggggtccgtacgggtaggttcccggtacgtccccggttagttacccgg

SEQ ID NO: 86011 - DNA, 771 bp, Homo sapiens
  misc_feature: GYAE6OF02F89EL.21.45.E01.1.454.CMB.1.raw
tcagtcgtcgctcgcacgaccggtgctcgatttagtgagtcagtaagggaaagggggctttcagagagtcatggacctcctgtgcaagaacatgaggcgcctgtggtttttcctcctgctggtggcagctcccagatgggtcctgtcccaggtccacctgcaggacgtccgggcccaggactggtagaacgccctcgggacgaccctcgtcccctctatttcgacacttgtgtctggactcccaccgtccacagtacttcggtttccttcggtcggggtcgtcggggtcccggctacccggtcccaggaggtaacgggtcgtggaggtggtaggtgggtagtcgtataagtaacggtacgggtagtactaagtacgtcggtaggtactacctaccgtccccttaactaccgttaaccccgttttactttaaacggacggttaccgacgttacctaaccttatactcgtaacggttcggaccgtccgttacccgtaccgtaacccggtaaaccgtccgggttacccctaccggtagggacggttacgtagaacggttacttcggtcggtaccggacccggtcgaccggacgaacccgtaccgggactaacggtttcttcgtaggcggtaccgtaacggtacccgggtacccgttagtacgaccggaccggttccgtagggtccggtaaccgtcggttacggttaccgtacgtcggttaccggtccggggttaccgggtcccgggttacggccccggttaccgtaggttcccg

SEQ ID NO: 86012 - DNA, 1198 bp, Homo sapiens
  misc_feature: GYAE6OF02H6XTL.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggttttcctctgctggtgcagctccagatcggtcctgtcccaggtccacctgcaggacgtccgggcccaggaccgtggtacgaacgcccgtggacgtacccgtcgtccctactagtttcgccgtacgttgttcgtactcggtaacttcccgaccgtacaacgtacgtacgttcggtttcccttggtcgggtacgtcggggtccgctacgtcccgaggacggtaacgggtcgtaggtaggtagggtagttgggagtgtacgtaagtaacggtacgggtagtacgtaagttacgtcggtagttcgtaccaaccgttaccgtaactaaccgttaaccggttagttttaaacggaccggttacgtaacgttaccgtaacgttaacgttacgtaccggtacggttcgtaccggttcccgttacccggtaacccgtaaacccggtacccgttaacgggttacccctaccccgggttagggtaaacggtaacggtttaacggtaaacggttaaccgttaccgggttacggtaacccggggtaccccggtacccgggttaaccgaaaacccgggtaaacccgggttaaaccccggggttaccccgtttaaaaaacgggttttttcccgttttttaccccggggtaacggggttttaccccggggtaaaacccggggttaaacccggggggttaaaaacccccccggggttttaaaacccccggggggtttttaaaacccgggggtttaaaaccccgggggtaaaaacccccccccccgggggggttttaaaaccccggggggggtttttaaaaccccccgggggggtttttaaacccccgggggggggttaaaacccccgggggggttttaaaacccccccgggggttttaaaacccccgggggtttttttttaaaacccccgggggggggttttttaaaaaaccccccggggttttttaaaccccccgggggtttttaaaaaccccgggggggttttaaccccccccccggggggggtttttacccccgggggggggggttttttaaaaccccccggggggggggttttaacccccccccgggggggggtttttaaccccc

SEQ ID NO: 86013 - DNA, 776 bp, Homo sapiens
  misc_feature: GYAE6OF02FRTJ2.21.45.E01.1.454.CMB.1.raw
tcagtcgtcgctcgcacgaccggtgctcgatttagtgagtcagtaagggaaagggggctttcagagagtcatggacctcctgtgcaagaacatgaggcacctgtggtttttcctcctgctgggtggcagcctcccgagatcggggtcctgtcccgaggtccaccgtgcgaggacggtccgggcccaggctgggtacgaacggcccgtcggaacgtacctgtcccctctagtttcgcacgttggtacgtcgtaggacctaccgaccgtacaacgtaacgtcgttcggttccgttacggtcggggtccgttcggggtacccgcgtaccgtaccggacgtacgggtaacgggtccgtagggtaggtacggtacggttgggtacggtagtacgtaaggttaacggtacgggggtagtaactaacgtagttacggtcgggtagaccgtaacctccctaacgtaaccgttaccgttaccgtttaaaggtcgtacgttagtactaacttaagtacttacgtagtcgaacgttccgtaccggtaccaacccggtacgtacggttaccgtacccgtcggaggtacgtcggaaacgtactaggtcggtacggtcccgacggacgtacggaccgacggtaccgtaagttacgttcggacggtgacggtaccggaaccggtaccgtacggtacgtcgggtaccgtccggtacggcggtaccgtccggttaagcggtaacctacggtcggtccggtccgggaccggtggtccccggtcggtaccgtcgg

SEQ ID NO: 86014 - DNA, 915 bp, Homo sapiens
  misc_feature: GYAE6OF02G13LJ.21.45.E01.1.454.CMB.1.raw
  modified_base (115)..(115): a, c, t, g, unknown or other
  misc_feature (115)..(115): n is a, c, g, or t
  modified_base (537)..(537): a, c, t, g, unknown or other
  misc_feature (537)..(537): n is a, c, g, or t
tcagtcgtcgctcgcacgaccggtgctcgatttagtgagtcagtaagggaaagggggctttcagagagtcatcggacctcctgtgcaagaacatgaggcacctgtcggttttccncctgctggtcggcagctccagatgggtcctgtcccaggtccactgcaggtacgtcggccaggactggtgaacgtcccgtacggacgtaccctcgtaccctatagtttcgcacgttgtctcgacggtacctcccgtaaccgtcaacgtagtacgttcggttcccgttcggtcggggtaccgttcgggggtcccgacgtaccggttaccccgaaggtaacggtaacgggttccggtaggaggtacgggtaacggttggggtacggtttacgtaacggttaacggttaacggtaccgggggtaacttacggtaaacgtttacggttacggtagggttacctacccggttaaccttaccccggttaactaacccggttaaccgttaacgtttaagaccgttacgtacgttaccgtacttaacgtancgtaacggtcgtaccgtcttacccggtaccgtaacccgaccgttacgtcccgtacccgtacggtaggtacgtagtaacgtacgttcgtacgtccggtacggacccgacggttacggaccgtaaccggtacgttaaaccgttcgtttacgggttacgcgggtaaccgtaccgggtaacccgggtaccgggtttaacgtaccgggtacccgtacccgggttacccgggtagggttaacccggtacccggttaccggggtttaacccggtttacccggtaaccggtttaaccccgggtttcggggtaaccccgggggtttaccgggggtccccgggttaaccccggggtcccggttccccgggtttaccggttaccccggg

SEQ ID NO: 86015 - DNA, 560 bp, Homo sapiens
  misc_feature: GYAE6OF01BY4YK.22.30.C08.1.454.CMB.1.raw
  modified_base (153)..(153): a, c, t, g, unknown or other
  misc_feature (153)..(153): n is a, c, g, or t
  modified_base (260)..(260): a, c, t, g, unknown or other
  misc_feature (260)..(260): n is a, c, g, or t
  modified_base (277)..(277): a, c, t, g, unknown or other
  misc_feature (277)..(277): n is a, c, g, or t
  modified_base (327)..(327): a, c, t, g, unknown or other
  misc_feature (327)..(327): n is a, c, g, or t
  modified_base (330)..(330): a, c, t, g, unknown or other
  misc_feature (330)..(330): n is a, c, g, or t
  modified_base (332)..(332): a, c, t, g, unknown or other
  misc_feature (332)..(332): n is a, c, g, or t
  modified_base (334)..(334): a, c, t, g, unknown or other
  misc_feature (334)..(334): n is a, c, g, or t
  modified_base (347)..(347): a, c, t, g, unknown or other
  misc_feature (347)..(347): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagcggngtgttcctaggtcgctattttagagtgtcagtgtgaggtgcgcctggtggaatcgtggggggccttggtccagcctggggggtccctgagctcgcctgtgcagcctntggattcgagtttggancctactgtctgacttgggccgccaggctccgagggagggctggagtgggngcngnanacaacgagacganataagtaattagtgtgcgtcgtgtagaggcgtactacacactctcagagacgaacgtacgaacgaactactacttcgttctcgtacgagtagtacgacgacgtcgtcgacggacggaccggacggaccgacggtcgtcgttcgttacgtttcgttgtcgtacgacgagacgtagtacgtaactaacgtacgttacttattattagtagtaacg

SEQ ID NO: 86016 - DNA, 561 bp, Homo sapiens
  misc_feature: GYAE6OF01CZ6KN.22.30.C08.1.454.CMB.1.raw
  modified_base (253)..(253): a, c, t, g, unknown or other
  misc_feature (253)..(253): n is a, c, g, or t
  modified_base (421)..(421): a, c, t, g, unknown or other
  misc_feature (421)..(421): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctccaggttgtactgactcaatcgccctctgcctctgcctccctgggagcctcggtcaacctcacctgcgttcttagtagtcaacacgattactacaccgtcgcgtggcatcaacaacngccggagaagggccctcgctactaatgaagattgccattttggcagccacacaaggggtcggatccctgatcgcttcgtcggctccagctctggggccagcgctactcaccatctcacgcctccagtctcgaagatgagctgacgtattactgtcagacagtgggacnctggcgtgtcggtcgtggttcggcggtagggaccaagcgtacgaccgttcgtacggtcacgtcccgaaagggcctacgccccccgtcgggtccaccgttccgttaccggttccccggccccttcccgtcgccggtaccgg

SEQ ID NO: 86017 - DNA, 534 bp, Homo sapiens
  misc_feature: GYAE6OF01AVGMO.22.30.C08.1.454.CMB.1.raw
  modified_base (346)..(346): a, c, t, g, unknown or other
  misc_feature (346)..(346): n is a, c, g, or t
  modified_base (359)..(359): a, c, t, g, unknown or other
  misc_feature (359)..(359): n is a, c, g, or t
  modified_base (365)..(365): a, c, t, g, unknown or other
  misc_feature (365)..(365): n is a, c, g, or t
  modified_base (418)..(418): a, c, t, g, unknown or other
  misc_feature (418)..(418): n is a, c, g, or t
  modified_base (422)..(422): a, c, t, g, unknown or other
  misc_feature (422)..(422): n is a, c, g, or t
  modified_base (428)..(428): a, c, t, g, unknown or other
  misc_feature (428)..(428): n is a, c, g, or t
  modified_base (433)..(433): a, c, t, g, unknown or other
  misc_feature (433)..(433): n is a, c, g, or t
  modified_base (521)..(521): a, c, t, g, unknown or other
  misc_feature (521)..(521): n is a, c, g, or t
tcagacatacgcgtcacgaccggtgctcgatttagtctgacgtcaaagggaaaggggcgtcagagaggagccttagccccggactccaaggcctttccacttggtgatcagcactgagcacagaggactcaccatgggattggggctgagcgtgcgttctagtgctatttagagtgtcagtgtgaggtgcgcctggtggaatcgtgggggggccttggtccagcctggggggtccctgagctcgcctgtgcagcctctggattcgagtttggagcctactgtctgcttgggccgccaggctccgaggggagggctggagtcgggtggccagcatcaacgagcgganagtaaggatttangtgctntgtgagggccatcaccatctccagcgacaacgtcaaagactgaacttgtttcngcangtgacncgcgngacgacgcggagtaccacgtctgtacttagttcgtgtcggtacaggtaggacgtagtaacttactacgttaagtttactttacgttancgggtaagtaacg

SEQ ID NO: 86018 - DNA, 529 bp, Homo sapiens
  misc_feature: GYAE6OF01A78NH.22.30.C08.1.454.CMB.1.raw
  modified_base (177)..(178): a, c, t, g, unknown or other
  misc_feature (177)..(178): n is a, c, g, or t
  modified_base (181)..(181): a, c, t, g, unknown or other
  misc_feature (181)..(181): n is a, c, g, or t
  modified_base (183)..(183): a, c, t, g, unknown or other
  misc_feature (183)..(183): n is a, c, g, or t
  modified_base (190)..(190): a, c, t, g, unknown or other
  misc_feature (190)..(190): n is a, c, g, or t
  modified_base (192)..(192): a, c, t, g, unknown or other
  misc_feature (192)..(192): n is a, c, g, or t
  modified_base (208)..(208): a, c, t, g, unknown or other
  misc_feature (208)..(208): n is a, c, g, or t
  modified_base (221)..(221): a, c, t, g, unknown or other
  misc_feature (221)..(221): n is a, c, g, or t
  modified_base (229)..(229): a, c, t, g, unknown or other
  misc_feature (229)..(229): n is a, c, g, or t
  modified_base (250)..(250): a, c, t, g, unknown or other
  misc_feature (250)..(250): n is a, c, g, or t
  modified_base (255)..(255): a, c, t, g, unknown or other
  misc_feature (255)..(255): n is a, c, g, or t
  modified_base (302)..(302): a, c, t, g, unknown or other
  misc_feature (302)..(302): n is a, c, g, or t
tcagacatacgcgtcacgaccggtgctcgatttagtctgacgtcaaagggaaagggcgtcagagaggagccttagccccggactccaaggcctttccacttggtgatcagcactgagcacagaggactcaccatgggattggggctgaggcggctggtctaggtcgctattagatgnngcngngtgcgcngngatgtggggctgggcngtcgtcgggctgnggcctgcntcgctgctcagctgagttgcnccttngctgtagttggcaccgtggcctcgaggacgcagggagtggtgcgagngcacagagacgagagagtagtagtagtagtactgtgtgtagcgtagtcgacggatcttcactacgtacacgacgaacgaactacacgtacgtacttagtacgtagtagtacgacgacgtacgacgacgacgacgacgacgacgtacgtacgtcgttcgttcgttcgtcgtcgtcggtacgacggtacgtacgtacgtacgtacgttacgtacgtacgtcgtcgtacg

SEQ ID NO: 86019 - DNA, 552 bp, Homo sapiens
  misc_feature: GYAE6OF01CTH8K.22.30.C08.1.454.CMB.1.raw
  modified_base (546)..(546): a, c, t, g, unknown or other
  misc_feature (546)..(546): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgccctccctgggagcctcggtcaacctcacctgcgttcttagtagtcaacacgattactacaccgtcgcgtggcatcaacaacagccggagaacgggccctcgctactaatgaagattggcctattttggcagccaccagaagggggtcggatccctgatcgcttctcgggctccgagctcgtggggccagccgctacctcaccatcctacacgccctcagtctgaagctgagctgactattactgtcagacagtggacgctggcgtctggcgtggtccgggcggacgggaccaagtcgtacgaccgtcgtaggtccacggacccaagggcctcggccccctggtccactccgtccgttccccgcccttcccgcnccgtcg

SEQ ID NO: 86020 - DNA, 527 bp, Homo sapiens
  misc_feature: GYAE6OF01A5EC3.22.30.C08.1.454.CMB.1.raw
  modified_base (374)..(374): a, c, t, g, unknown or other
  misc_feature (374)..(374): n is a, c, g, or t
  modified_base (436)..(436): a, c, t, g, unknown or other
  misc_feature (436)..(436): n is a, c, g, or t
  modified_base (480)..(480): a, c, t, g, unknown or other
  misc_feature (480)..(480): n is a, c, g, or t
  modified_base (518)..(518): a, c, t, g, unknown or other
  misc_feature (518)..(518): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagcgtggcttttccttgttgctattttagaaggtgtccagtgtgaggtgcgcctggtggaatcgtgggggggccttggtccagccgtggggggtccctgagactcgcctgtgcagcctctggattcgagtttggagcctactgtctgacttgggtccgccaggctccgaggggaagggctgggagtgggtgccagcatcaacgaagacggacagtaaggaatttagngtggcctcgtgtgaagggccgattcacatctccagagacaacgtcaaagactcactgtttcngcagatggacagcctgcgagccgaggacacggctgtctatttcngtgtcgagtagacgagactactactagttattacttanggagtaacg

SEQ ID NO: 86021 - DNA, 523 bp, Homo sapiens
  misc_feature: GYAE6OF01C69NK.22.30.C08.1.454.CMB.1.raw
  modified_base (516)..(516): a, c, t, g, unknown or other
  misc_feature (516)..(516): n is a, c, g, or t
  modified_base (518)..(518): a, c, t, g, unknown or other
  misc_feature (518)..(518): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtctaggtcagcccaaggctgccccctggtcactctcgttcccaccctccncncgtcg

SEQ ID NO: 86022 - DNA, 604 bp, Homo sapiens
  misc_feature: GYAE6OF01D6WIO.22.30.C08.1.454.CMB.1.raw
  modified_base (383)..(383): a, c, t, g, unknown or other
  misc_feature (383)..(383): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacgaggtctctctcccaggttgtactgactcaatcgccctctgcctctgccctcccgtgggacgcctcggtccaacctcaccgtgcgttcttagtagtcaacacgattaccacaccgtcgcgtgcatcaacacagccgagaacggcctcgctactaatgaagtatggcctagttttggcagccaccacgaagggggtcggatcccgtgatcgcttcgtcgggctccgagctcgtcggggccgagcgctacctcaccatcnccacgcctcgagtctagaagatgaggctagacttattactgtacagactagtcgggacgcgtggtcgtcgtggcgttggttcgggacgggacgggaccaaggtccgtacgtacccgtccgtaggtccaccggacccgtaacgggccctccggccccccgttcggtaccctaccgttcccgttcccgttacccccacccccttcctcccgaccggttacccg

SEQ ID NO: 86023 - DNA, 733 bp, Homo sapiens
  misc_feature: GYAE6OF01EK2QB.22.30.C08.1.454.CMB.1.raw
  modified_base (444)..(444): a, c, t, g, unknown or other
  misc_feature (444)..(444): n is a, c, g, or t
tcagacatacgcgtcacgaccggtgctcgatttagtctgacgtcaaagggaaagggctcagagaggagccttagccccggactccaaggcctttccacttggtgatcagcactgagcacagaggactcaccatgggattggggctgagcgtgcgttcctaggtcgctatttagagtgtccagtgtgagtgcgcctggtgaatcgtgggggccttggtccagccgtggggtccctgacgactcgcctgtgcagtcctctggacttcgagtttggacgtcctacgtgtctgaccgttcggtaccgtcgtaacggtccgttccgaaggggtaacgggtcccttaggggtaacgttcggggtacggtaccccgtaaggtaccgttaacgttaccgaaaccggtaacggtaccggtaaccgtaagttaaacggggtaacttttaacggnggttaacggtcccgttagtcgtacggtaacgggtccgtaacgtttccgaaccgtaagttcctaccgaagtacgacctaacgtcgaaacggtaactcgtaacgttgtttccgagaccgtaggttaacgtcggtaacacgtccgtagtaccggaacggtccgtaaggtacccgtagggttcctacggtttaccgtaacgtttccggaggttaccggttacgaacgttacgtaacccggtgttaacctaccgtacgttacgtactttacggacgttacggaacgtttaacgg

SEQ ID NO: 86024 - DNA, 578 bp, Homo sapiens
  misc_feature: GYAE6OF01DM2QJ.22.30.C08.1.454.CMB.1.raw
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaaacaacagccggagaagggccctcgctacttaatgaagattggcctattttggcagccaccacgaagggggtcgggatcccgtgatcgcttctcgggctccagctctggggccgagcgctacctcaccatcctccacgcctccagtctagaagtatgaggctgacttattactgtacagacagtgggacgctggcgtcgtggctggttcgggcggacgggaccaaggcctaggacccgttccgtaggtccacgaccccgaaggtcctcggccccccgtcgggtccaccgttccgttccggttcccccgccccttcccgcgtccggtaccg

SEQ ID NO: 86025 - DNA, 664 bp, Homo sapiens
  misc_feature: GYAE6OF01BSZH9.22.30.C08.1.454.CMB.1.raw
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatccgccctctgcctctcgccctcccgtgggacgcctcggtccaacctcacctgtcgttcttagtagtacaaacacgtattactacaccgtcgcgtggcatcaaacaacgagccggagaacggccctcgctactaatgaagattggctatttggcagccacgacgaagggggtcggactcccgtgactcgcgttcgtcgggctccgagctcgtcgggggccaggccgcctaccgtcacctatcctccgacgccctcgacgtctgaacgagtaggacgtctagacttattactagtacagacgaggtcgggacgtcgtggtcgtcgtcgggtcgttcggtcgggtaccgggaacggggaaccaaggtcgtacggtacccggttaccggtacggtaccgaccggacccggaaacgggtcccgtacccggtccccccggttcggtaccctacccgttacccgttcccgttaccccccgtaccccgttccccgtcccgtaaccggttacccgg

SEQ ID NO: 86026 - DNA, 530 bp, Homo sapiens
  misc_feature: GYAE6OF01DHLXK.22.30.C08.1.454.CMB.1.raw
  modified_base (411)..(411): a, c, t, g, unknown or other
  misc_feature (411)..(411): n is a, c, g, or t
  modified_base (525)..(525): a, c, t, g, unknown or other
  misc_feature (525)..(525): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctcgtggggccagcgctacctcaccatctccagccctcagtctagagatgaggctgactattacngtacagacagtgggacgctggcgtctggctggttcggcggagggaccaaggctcgaccgttcgtaggtcagcccaagggcctcgcccctggcactctcgttccccaccctctcncgtcg

SEQ ID NO: 86027 - DNA, 525 bp, Homo sapiens
  misc_feature: GYAE6OF01ERLVG.22.30.C08.1.454.CMB.1.raw
  modified_base (334)..(334): a, c, t, g, unknown or other
  misc_feature (334)..(334): n is a, c, g, or t
  modified_base (520)..(520): a, c, t, g, unknown or other
  misc_feature (520)..(520): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacacagccggagaagggccctcgctacttaatgaagattggccattttggcagccacacaaggggtcgggatccctgatcgcttcncgggctccagctctggggccgagcgctacctcaccatctccagtctccagtctgaagatgaggctgactattactgtcagacagtgggacgctggcgtctgggctgttcggcggagggaccaaggctgaccgtctaggtccagcccaaggcctcgcccctcggcactctcgttccccgcctcctcncgtcg

SEQ ID NO: 86028 - DNA, 617 bp, Homo sapiens
  misc_feature: GYAE6OF01AO22V.22.30.C08.1.454.CMB.1.raw
  modified_base (399)..(399): a, c, t, g, unknown or other
  misc_feature (399)..(399): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaaggccctcgctacttaatgaagattggccattttggcagccaccacgaagggggtcgggatccctgatcgcttctcgggcctccgagctcgtcggggccgagcgctacctcaccatctccagccctcagtctgaagntgaggctagactattactgtacagacagtgggaccgtcgtggcgttcgtcgggtcttcgggttccggggacgggtacggggaaccaaggtccgtacggacccgttccgttaagggtccgacgggtacccccgaaagggtccctccggacccccccggttcgggtacccaccgttccgttcccggttccccccgccccttcccgtcgaacccggtccgg

SEQ ID NO: 86029 - DNA, 590 bp, Homo sapiens
  misc_feature: GYAE6OF01CH6D4.22.30.C08.1.454.CMB.1.raw
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaaacacgattactacaccgtcgcgtggcatcaacaacagccggagaacgggccctcgctacttaatgaagattggccatttggcagccacgacgaagggggtcggatccctgatcgcttcgtcgggctccagtctcgtggggccgagcgctaacccgtcaaccatcctccacgccctccagtctgaagtactgaggctgactaattacgtgtacagacagtcgggacgcgtggcgtctgggcttggttcgggcgggaacgggaccaacggtcgtacggacccgtccgtaggtccacggtcccgaagggcctaccggccccccgtcggtccaccgttccgtccggttcccccgtacccctcctccgccgtaccg

SEQ ID NO: 86030 - DNA, 600 bp, Homo sapiens
  misc_feature: GYAE6OF01AICA2.22.30.C08.1.454.CMB.1.raw
  modified_base (187)..(187): a, c, t, g, unknown or other
  misc_feature (187)..(187): n is a, c, g, or t
  modified_base (247)..(247): a, c, t, g, unknown or other
  misc_feature (247)..(247): n is a, c, g, or t
  modified_base (348)..(348): a, c, t, g, unknown or other
  misc_feature (348)..(348): n is a, c, g, or t
  modified_base (381)..(381): a, c, t, g, unknown or other
  misc_feature (381)..(381): n is a, c, g, or t
  modified_base (395)..(395): a, c, t, g, unknown or other
  misc_feature (395)..(395): n is a, c, g, or t
  modified_base (419)..(419): a, c, t, g, unknown or other
  misc_feature (419)..(419): n is a, c, g, or t
  modified_base (432)..(432): a, c, t, g, unknown or other
  misc_feature (432)..(432): n is a, c, g, or t
  modified_base (453)..(453): a, c, t, g, unknown or other
  misc_feature (453)..(453): n is a, c, g, or t
  modified_base (469)..(469): a, c, t, g, unknown or other
  misc_feature (469)..(469): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagcggtgtgttctaggtcgctatttagagtgtcagtgtgngtgcgcctggtaggatcgtggggggccttggtccagcctgggggtcctgagctcgcctgnactgcctctggaacttcgtagtttcggagtccctatgtctgacttgggtcctcgaggtccgtccgaagggacggtgtggtaggtgggtaggccagtcgtancgaacgagtacggactaagtaaggtaatttcgnggtcgctcgtaggngaacgggcattcacctattccacnggactacaacgtnaaactacgtctaacttgttcngactagtacgtgtacncgtctgaccggaggtacggtaacgacggtacgtacgttacgttattacgttcgttacgttacgtacgtacggtaggacggtacgtaacgtaacgtaacgtaacgttacgttacgttacgtacgtacgtacg

SEQ ID NO: 86031 - DNA, 510 bp, Homo sapiens
  misc_feature: GYAE6OF01D62YI.22.30.C08.1.454.CMB.1.raw
  modified_base (367)..(367): a, c, t, g, unknown or other
  misc_feature (367)..(367): n is a, c, g, or t
  modified_base (422)..(422): a, c, t, g, unknown or other
  misc_feature (422)..(422): n is a, c, g, or t
  modified_base (433)..(433): a, c, t, g, unknown or other
  misc_feature (433)..(433): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagctggcttttccttgttgctattttagaggtgtccagtgtgaggtgcgcctggtggaatcgtggggggccttggtccaggccgtggggggtccctgagactcgcctgtgcagcctctggattcgagtttggagcctactgtctgacttgggtccgcaggctccgaggggagggctggagtgggtgccagcatcaacgagacggacataaggtaatttangtgcctctgtgaggcattcacatctcagagacaacgtcaagaactcactgtttcngcagatggacngcctgcgagccgagacacggctgtctattcgtgtgtcgagagacgagactactacgtagttattcttatgagtaacg

SEQ ID NO: 86032 - DNA, 606 bp, Homo sapiens
  misc_feature: GYAE6OF01DOABG.22.30.C08.1.454.CMB.1.raw
tcagacatacgcgtcacgaccggtgctcgatttagtctgacgtcaaagggaaagggggagctctgggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacgaagggggtcggatccctgatcgcttcgtcgggctccagctcgtggggccgagcgctacctcaccatcctccagcctcagtctagagatgagctgactattactgtcagacagtcgggaccgcgtgggcgtcgtgggcttaggttcgggacgggacggggtacccgaaggtccgtacggacccggttccgtaacgggtccacggaccccgaaagggtccctcccggcccccccgttcgggtacccacccgttccgttccggtttccccccgccccttccctcccgaccgggtaccg

SEQ ID NO: 86033 - DNA, 590 bp, Homo sapiens
  misc_feature: GYAE6OF01CO7WZ.22.30.C08.1.454.CMB.1.raw
  modified_base (424)..(424): a, c, t, g, unknown or other
  misc_feature (424)..(424): n is a, c, g, or t
  modified_base (443)..(443): a, c, t, g, unknown or other
  misc_feature (443)..(443): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctccaggttgtactgactcaatcgccctctgtctctgcctccctgggacgcctcggtcaacctcacctgcgttctagtagtcaacacgattactacaccgtcgcgtggcatcaacacagccggagaacggccctcgctactaatgaagattggccatttggcagccaccacgaagggggtcggatccctgatcgcttcgtcgggctccagctcgtaggggccgagccgctaaccctcacctatcgtccacgtccctccgagtcagtagactggaggctagactagttacngtcagactagtgggacgtntggcgttcgtggcgttaggttcgggcggtaacgggacgacggcgttcggacccgttcgtacggtcgaacggtcccgaacgggcctccggacccccgtcggtaccgtaccttccgttccgttacccccgcccttccgccgtccgtacg

SEQ ID NO: 86034 - DNA, 572 bp, Homo sapiens
  misc_feature: GYAE6OF01BEJ7N.22.30.C08.1.454.CMB.1.raw
  modified_base (184)..(184): a, c, t, g, unknown or other
  misc_feature (184)..(184): n is a, c, g, or t
  modified_base (338)..(338): a, c, t, g, unknown or other
  misc_feature (338)..(338): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggancctcggtcaacctcacctgcgttcttagtagtcaacacgattactacaccgtcgcgtgcatcaacaacagccggagaacgggccctcgctacttaatgaagattggccattttgggcagccaccacgaagggggtcggatccctgatcgcttcncgggctccagctcgtggggccgagcgctacctcaccatctccagccctccagtctgaagatgaggctgactattactgtcagacagtgggacgcgtggcgtcgtgggcgttggttcgggcggagggacctaagcgtaggacccgtcgtagggtccacgaccccgaaggcctccgccccccgtcggtccaccgttcccgttcgttacccccaccccgttccctccgtccgtaccg

SEQ ID NO: 86035 - DNA, 561 bp, Homo sapiens
  misc_feature: GYAE6OF01BEI1O.22.30.C08.1.454.CMB.1.raw
  modified_base (396)..(396): a, c, t, g, unknown or other
  misc_feature (396)..(396): n is a, c, g, or t
  modified_base (433)..(433): a, c, t, g, unknown or other
  misc_feature (433)..(433): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtgcgtggcatcaacaacagccggagaaggccctcgctacttaatgaagattggcctattttggcagccaccacgaagggggtcggatcccgtgatcgcttcgtcgggctccagctcgtggggccagcgctacctcaccatctccagcctccagtctgaagntgaggctagacttattactgtacagactagtgggacncgtggcgtctggcttggtcgggacggagggtaccaagcgtaggaccgtccgtaggtcacgcccgaagggcctcgcccccgtggtccctacgtccgttcggttcccccgaccctccctccgaccgtccg

SEQ ID NO: 86036 - DNA, 518 bp, Homo sapiens
  misc_feature: GYAE6OF01BFLRJ.22.30.C08.1.454.CMB.1.raw
  modified_base (303)..(303): a, c, t, g, unknown or other
  misc_feature (303)..(303): n is a, c, g, or t
  modified_base (373)..(373): a, c, t, g, unknown or other
  misc_feature (373)..(373): n is a, c, g, or t
  modified_base (435)..(435): a, c, t, g, unknown or other
  misc_feature (435)..(435): n is a, c, g, or t
  modified_base (492)..(492): a, c, t, g, unknown or other
  misc_feature (492)..(492): n is a, c, g, or t
  modified_base (507)..(507): a, c, t, g, unknown or other
  misc_feature (507)..(507): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagctggcttttccttgttgctattttagaaggtgtccagtgtgaggtgcgcctggtggaatcgtgggggggccttggtccagcctggggggtccctgagactcgcctgtgcagcctctggattcgagtttggagcctactgtctgacttgggtccnccaggctccgaggggaaggggctgggagtgggtggccagcatcaacgaagacggacagtaaggaatttangtggcctctgtgaagggccgattcaccatctcagagacaacgtcaaagaactcactgtttcngcagatggacagcctgcgagccgaggcacgctgtctattctgtgtcgagagacgganatacactagttattnttatgagtacg

SEQ ID NO: 86037 - DNA, 575 bp, Homo sapiens
  misc_feature: GYAE6OF01DRGUO.22.30.C08.1.454.CMB.1.raw
  modified_base (184)..(184): a, c, t, g, unknown or other
  misc_feature (184)..(184): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggancctggtcaacctcacctgcgttcttagagtcaacacgattactacaccgtcgcgtggcatcaacacagccggagaagggcctcgctacttaatgaagattggcctattttggcagccaccacgaagggggtcggatccctgatcgcttctcgggctccagctcgtggggccgagccgctacctcaccgatcctccagccctcaacgtctagaagtatcgacggctagacttattactgtacacgacagtcgggacgcgtggcgtcgtgtctggttcggcgggacggaccgtaagctacggcccgttcgtacggtcacggcccgaaggtcctccggcccccgtgggtccctacgttcccttcggttacccccacccttccgtccgcggtacg

SEQ ID NO: 86038 - DNA, 596 bp, Homo sapiens
  misc_feature: GYAE6OF01DOC39.22.30.C08.1.454.CMB.1.raw
  modified_base (420)..(420): a, c, t, g, unknown or other
  misc_feature (420)..(420): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctccaggttgtactgactcaatcgccctctgcctctgcctccctgggagcctcggtcaacctcacctgcgttcttagtagtcaacacgattactacaccgtcgcgtgcatcaacaacagccggagaaggccctcgctacttaatgaagattggccattttggcagccaccacgaagggggtcgggatcccgtgatcgcttcgtcgggctccagctcgtggggccgagcgctaccgtcaccatctcagccctccagttctagaagacgtgaggtctgaactattacngtacagacagtgggacgctgggtccgtgtgggtcgttcggttcggggcggacggggaccaaggcgtaggacccgtcgtacgggtcacggacccgaagggcctaccggcccccgttcggtacccgaccgttccccgttcggttacccccacccgtttccccgtcgtcccggtaccgg

SEQ ID NO: 86039 - DNA, 583 bp, Homo sapiens
  misc_feature: GYAE6OF01BYSUI.22.30.C08.1.454.CMB.1.raw
tcagacatacgcgtcacgaccggtgctcgatttagtctgacgtcaaaagggaaagggggagctctggggagtctgcaccatggcttggaccccactcctcttcctcaccctcctcctccactgcacagggtctctctcccaggttgtactgactcaatcgcctctgcctctgcctcctgggacgcctcggtcaacctcacctgcgttcttagtagtcaacacgattactacaccgtcgcgtggcatcaacaacagccggagaacggccctcgctacttaatgaagatgccattttggcagccacacgaaggggtcggatcccgtgatcgcttcgtcgggctccagctcgtcggggccgagcgctacctcgaccatcctccacgccctcacgtctgaagatgagctgactatactgtcagactagtagggacgcgtcgggtacgtcgtgggacgttggttcggacgggtagggaccgaagtcgtcggacccgtccgtaggtccacggacccgaaggtccgtaccgccccgtcggtcctacgttcccgttcgttcccccgacccttcccgtcgtaccggtaccgg

SEQ ID NO: 86040 - DNA, 586 bp, Homo sapiens
  misc_feature: GYAE6OF01CXXYS.22.30.C08.1.454.CMB.1.raw
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgccctccctgggagcctcggtcaacctcacctgcgttcttagtaccgtcaacacgattactacaccgtcgcgtggcatcaaacacagccggagaaggccctcgctacttaatgaagattggcctagttttggcagccaccgacgaagggggtcggatcccgtgatcgcttctctggctccagctcgtcgggccgagcgctacctcaccactcctccacgccctccagtctagaacgtactggacggtctagacttagttactgtcagacgagtcgggacgcgtcgggcgtcgtggtcgtggttcggacgggtagggaccaaggcgtacggaccgtccgtacggtcgacggcccgaacggtcctccggcccccgtcggtccaccgttcctaccgttcccaccctccgtcgtaccgg

SEQ ID NO: 86041 - DNA, 673 bp, Homo sapiens
  misc_feature: GYAE6OF01DAE84.22.30.C08.1.454.CMB.1.raw
  modified_base (184)..(184): a, c, t, g, unknown or other
  misc_feature (184)..(184): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggancctcggtcaacctcacctgcgttctagtagtcaacacgattactacaccgtcgcgtggcatcaaacaacaggccggagaagggccctcgctactaatgaagattggccattttggcagccaccacgaagggggtcgggatcccgtgatcgcttcgtcgggctccagctcgtggggccgagccgctaccgtcaaccatcctccacgtccctccagtcctaggaagagtgaggtctggtacttatttactgttacagacagtcggggacgcgtacgggcgttcgtcgggttcgtggttccggggacgggtaacgggacccgtaaaggccgttaccgggacccggttacccgttacgggttaccgacggtaccccggaaacgggtcccgtacccggtacccccccggttcggttacccgtaaccccgtttccgttaccccggttccccccgttaccccctttccccgttacccggtacccggttaacccggg

SEQ ID NO: 86042 - DNA, 596 bp, Homo sapiens
  misc_feature: GYAE6OF01C38IH.22.30.C08.1.454.CMB.1.raw
  modified_base (393)..(393): a, c, t, g, unknown or other
  misc_feature (393)..(393): n is a, c, g, or t
  modified_base (480)..(480): a, c, t, g, unknown or other
  misc_feature (480)..(480): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagctggcttttccttgttgctattttagaaggtgtccagtgtgaggtgcgcctggtggaatcgtgggggggccttggtccaggccgtggggggtccctgagactcgcctgtgcagcctctggattcgagtttggagtcctactgtctgtaccgttgggtccgccgaggcctaccggaggggaagggcgtgggaggtgggtcggccagcatacgaaacggaagacggacaagtaaaggtaatttagnggtaggcctgtggtaggaacgggtccgtaattccgacctatccctacgagaacgaacaacgtacaaacgtactctaacttgtttacngacagtactacggacaggtcctggacgacggaccgaggaccacggtctgttacttatttgagtgtcgtaaggagacggtagtactaacgtatagttattactagtggaattaacgg

SEQ ID NO: 86043 - DNA, 553 bp, Homo sapiens
  misc_feature: GYAE6OF01DKVLP.22.30.C08.1.454.CMB.1.raw
  modified_base (260)..(260): a, c, t, g, unknown or other
  misc_feature (260)..(260): n is a, c, g, or t
  modified_base (277)..(277): a, c, t, g, unknown or other
  misc_feature (277)..(277): n is a, c, g, or t
  modified_base (300)..(300): a, c, t, g, unknown or other
  misc_feature (300)..(300): n is a, c, g, or t
  modified_base (329)..(329): a, c, t, g, unknown or other
  misc_feature (329)..(329): n is a, c, g, or t
  modified_base (367)..(367): a, c, t, g, unknown or other
  misc_feature (367)..(367): n is a, c, g, or t
  modified_base (426)..(426): a, c, t, g, unknown or other
  misc_feature (426)..(426): n is a, c, g, or t
  modified_base (444)..(444): a, c, t, g, unknown or other
  misc_feature (444)..(444): n is a, c, g, or t
  modified_base (451)..(451): a, c, t, g, unknown or other
  misc_feature (451)..(451): n is a, c, g, or t
  modified_base (455)..(455): a, c, t, g, unknown or other
  misc_feature (455)..(455): n is a, c, g, or t
  modified_base (459)..(459): a, c, t, g, unknown or other
  misc_feature (459)..(459): n is a, c, g, or t
  modified_base (492)..(492): a, c, t, g, unknown or other
  misc_feature (492)..(492): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagcgtgcgtttcctaggtgctatttagagtgtcagtgtgaggtgcgcctggtggaatctggggggccttgggtccagcctggggggtccctgagactcgcctggtgcagcctntggattcgagtttggancctactgtctgacttgggtcccncaggctccgaggggagggctggagtgggnggccagcatcaacgagacggacagtaaggtaatttagngtggacctctggtgaaaggggcctattccaacctagtcctaccagaacgacaaacgttnaaagaactcacttgttcngcagtangacngcgngacgagccgagcctacggtctagtcttcttcgngtcgtacgaaggagacgtaagacttaacgacgtagttactttacgtaagtcgtaagtaacg

SEQ ID NO: 86044 - DNA, 674 bp, Homo sapiens
  misc_feature: GYAE6OF01D5OSZ.22.30.C08.1.454.CMB.1.raw
  modified_base (187)..(187): a, c, t, g, unknown or other
  misc_feature (187)..(187): n is a, c, g, or t
  modified_base (259)..(259): a, c, t, g, unknown or other
  misc_feature (259)..(259): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctcccgtggggacncctcggtcaacctcacctgcgttcttagtagtacaacacgtattactacaccgtcgcgtggcatcaacaacngcggagaacggccctgctacttaatgaagtatggcctatttggcagccaccacgaagggggtcggactccgtgatcgcttcgtcgggctcagctcgtggggccgagccgactaccgtcacctatcctaccagccctccgagtcctaaggaagtacgtaggacggtctggtaacttagtttacgtcgtacaacgtacgtaggttcggggaactcgtcgggtccgttcgtgggtccgttgggttccgggaccggggtaacgggaaccgtaacggcgttaccgggtacccgttaccgtaacgggtacccgacggaccccgtaaagggtcccttacccgggcccccccggttggtacccgtacccttccggttcccggttacccccctacccccttcccgtacccgtccggttacccgg

SEQ ID NO: 86045 - DNA, 684 bp, Homo sapiens
  misc_feature: GYAE6OF01B0ZYU.22.30.C08.1.454.CMB.1.raw
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagacggccctcgctacttaatgaagattggcctattttggcagccacacgaagggggtcggatccctgactcgcttcgtcgggctcagctcgtggggccgagccgctaccctcgacctagtcctccacgtccctccgagtctagaagtatggacggctggaacttagttacgtagtcaacgacaggtacggggacgtcgtcgggtcgttcgtgggtcgttgggtttccggggaccgggtacggggtaacccaacggtccgttaccggacccggttccccgtaaggggtacccaccgggtaccccgaaacggggtcccgtacccggtacccccccggtttccgggtacccctaacccgtttccccggtttcccggtttacccccccggaccccctttccccggtaccgtaacccggttaccccggg

SEQ ID NO: 86046 - DNA, 546 bp, Homo sapiens
  misc_feature: GYAE6OF01ETZX7.22.30.C08.1.454.CMB.1.raw
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtgcatcaacaacagccggagaacgggccctcgctacttaatgaagattggccattttggcagccacacgaagggggtcgggatccctgatcgcttctcgggctccagctcgtggggccgagcgctacctcaccatctccagccctcagtctgaagatgagctgactattactgtcagacagtgggacgcgtggcgtctggctgttcggcgggagggtaccaagctggaccgtccgtaggtcacgacccaaggcctacgcccccgttggcctactccgttcgttcccccgccctccctcaccgtccg

SEQ ID NO: 86047 - DNA, 595 bp, Homo sapiens
  misc_feature: GYAE6OF01CPFRY.22.30.C08.1.454.CMB.1.raw
  modified_base (328)..(328): a, c, t, g, unknown or other
  misc_feature (328)..(328): n is a, c, g, or t
  modified_base (437)..(437): a, c, t, g, unknown or other
  misc_feature (437)..(437): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacagattactacaccgtcgcgtggcatcaacaacagccggagaagggccctcgctacttaatgaagtattggcctattttggcagccaccacgaagggggtcggatcccngatcgctcgtcgggctcagctcgtggggccgagcgctacctcaccatctccacgcctccacgtctagaacgagtggacggctgactattactgtcagacagtgggacgngtcggcgtcgtggcttggttcgggacggacgggtacaacggctacggacccgttcgtacgggtccgaccggaccggtacgtcccggtacccgtcccggttccgacccgtaccgttcccggttccccgtacccgtcccgttacctcccgtcgttaccgg

SEQ ID NO: 86048 - DNA, 849 bp, Homo sapiens
  misc_feature: GYAE6OF01BOOFR.22.30.C08.1.454.CMB.1.raw
tcagacatacgcgtcacgaccggtgctcgatttagtctgacgtcaaagggaaaggggctcagagaggagccttagccccggactccaaggcctttccacttggtgatcagcactgagcacagaggactcaccagtgggagttggggctgagctggtcttttccttgttgcttattttagaggtgtcagtgtgaggtgcgcgtggtggagtcggtggggggccttggtccaggtccggtcgggggtccctgagtactcgccgtgtcgcgacgcctcgtggacgttcggtaggtttggacgtcccttacgtgttcgtcggtaccgttcggggtcccgtaccgtacgggaccgttacccgggaaggggtaacgggggtctaggggtaacgggttcggggtacgggaccccgtaaggccgtaacgttaaccggaaaaccgggaaacggaaccgggaaacgtaaacggttaaaaggggtttaaacttttttaggacgggttacggtaaccgtttcggttagggttacgggaaacgggggtccctaacgtttacccgaacctaacgttcctaaccggaacggaacgaacccgtaaacggaccgtaaaacggtaacccttaccgtaacgttttcggtttaccacggtaccgtaaggtaccgtacgggaaaccgccggttacccgacgggtaccgggaacccgaccggggtaacggaaccgtaccgggttccgttacggtttaccttaacgttttcggtggttaccggtaacgaacggtacgggtaacgtaacgttaaccgttaacctaacggttacggttaattttaccgtaaaggtacggtaaggtttaaaccgg

SEQ ID NO: 86049 - DNA, 686 bp, Homo sapiens
  misc_feature: GYAE6OF01C1SV5.22.30.C08.1.454.CMB.1.raw
  modified_base (452)..(452): a, c, t, g, unknown or other
  misc_feature (452)..(452): n is a, c, g, or t
  modified_base (479)..(479): a, c, t, g, unknown or other
  misc_feature (479)..(479): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctggggacgcctcggtcaacctcacctgcgttcttagtagtcaacacgattactacaccgtcgcgtggcatcaacaacagccggagaaggccctcgctactaatgaagattggcctattttggcagccaccgacgaagggggtcggactccctagactcgcttcgtcgggctccgagctcgtcggggccgaggccgactacccgtcacctactcctacccacgtccctcctacgtctacggaagtagtcggaggtcgtacgaacttaatttaccngttaccagtaccgtaaggtcgggacgngtcgggtcgtacgtgggtcgttcggtttccggggacgggtaacggggacccgtaaggtccgttaccgggacccgttaccggtacgggtaccgaaccggtaccccggaaacggtcccgtacccggtaccccccgttccggggttaccctacccgttcccgtttccccgttacccccgtacccccttccctcccgtacccggttaccgg

SEQ ID NO: 86050 - DNA, 653 bp, Homo sapiens
  misc_feature: GYAE6OF01C7ZMX.22.30.C08.1.454.CMB.1.raw
  modified_base (185)..(185): a, c, t, g, unknown or other
  misc_feature (185)..(185): n is a, c, g, or t
  modified_base (293)..(293): a, c, t, g, unknown or other
  misc_feature (293)..(293): n is a, c, g, or t
  modified_base (442)..(442): a, c, t, g, unknown or other
  misc_feature (442)..(442): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctccaggttgtactgactcaatcgcctctgcctctcgcctcccgtgggacnccgtcggtcaacctcacctgcgttcttagtagtcaacacgattactacgaccgtcgcgtggcatacaaacaacgacggaccggaggaacgggccctcgactacttaangaagtattcggacctagttttcggcacgaccaccgaacggaacgggggtcggactcccgtagactccgcttcgcgggctccagcctcggtcggggaccgagcgtacctacctacaccactcctaccacgtccctacacgtctacggaancgtaggacgtccgtagtaaccgttaattacgtcgttaacgagacgtaggtacgggactcgtcggcgttcgtcggcgttcgggtacgggcggaacgggtaccgaaggcgtacgaccggtccgtacggtacgaccggtacccgaggtcccgtaccggtccccgtcggtacctaccgttccctccgttcccccgacccttccgccgtcgtaccg

SEQ ID NO: 86051 - DNA, 900 bp, Homo sapiens
  misc_feature: GYAE6OF01CZ0FI.22.30.C08.1.454.CMB.1.raw
tcagacatacgcgtcacgaccggtgctcgatttagtctgacgtcaaagggaaagggggagctctggggagtctgcaccatggcttggaccccactcctcttcctcaccctcctcctccactgcacgagggtctctctcctaggttgtactgactcaactccgccctctcgcctctcgccctccgtgggactcccgtcggtaccaacctctaccgtgtccgttacttagtacgtaccaaactacgtacttaacctaccgtaccggtcggcggtcggactaactaaccaaaaccgaaacgacgggtaccgggaaaggtaaccgggtcccctaccggtaccttaaaccgttaaagtaaggtaaacgtacggttacggtacccgttaagttttcgggacgaaccgacccgaacccgaacgggtaaacgggggggttccggtaccgttcccgtaggtaaccgttccggtccgttccggtccgggtcctaccgacggtccgtcggtccggggccgaacgccggtaccctaccgtccaccgtaacctcctaccgtaccgtcccgtcgtacgtacgtaacggtaacgtcgtacggtacgtaccgtagtaaccttagttactacggtacgtaacgaccgtagggtcgggtaccgtcggtcggtccgttaggtccgggtcgggttcgggttaccggggacgggtaaacccggggtaccgtaaccgggtccgttaacccgggtacccggtaaccgggttaaccgggtacccgaaccccgggtaacccgggtaaccgggtcccccgtaccccggggtaccccccgttacccgggttacccgtccccgttacccgggttcccccggttccccccggtacccctttcccggtacccggtacccgggttacccgg

SEQ ID NO: 86052 - DNA, 704 bp, Homo sapiens
  misc_feature: GYAE6OF01B3ZEC.22.30.C08.1.454.CMB.1.raw
  modified_base (188)..(188): a, c, t, g, unknown or other
  misc_feature (188)..(188): n is a, c, g, or t
  modified_base (224)..(224): a, c, t, g, unknown or other
  misc_feature (224)..(224): n is a, c, g, or t
  modified_base (287)..(287): a, c, t, g, unknown or other
  misc_feature (287)..(287): n is a, c, g, or t
tcagacatacgcgtcacgaccggtgctcgatttagtctgacgtcaaagggtaaagggggagctctggggagtctgcaccatggcttggaccccactcctcttcctcaccctcctcctccactgcacagggtctctctcccaggttgtactgacttcaatcgccctctgcctctgccttccgtgggacncctcggtcaacctcacctgcgttctagtagtcaacncgattactacaccgtcgcgtggctatcaacacaggccggagaacggccctcggctacttaacngaagattggacctaattttggctagccacgacgaacgggggtcggactccctgacgtcgcttcgtcgggctccagcctcgtacggggccgaggccgtccttaccgtacgaacctaacttcctccgacgtccctctaggtcctaaggaacgtactcggtacggtctacggtaacttacgttacgtacggtacaacggtaaccagttcgggaccgtcgtacggtcgtcgtcgggcttcgggttcgggacgggtacgggaaccgacggtcgtacgggtacccgtaccggttacgggtaccgacgtaaccccggtaaggttcccgtcccggtacccccggttcggggtaccctaccgttccccgggttaccgtttccccccggccccgtttacccgtacccggtaacccggtttacccggg

SEQ ID NO: 86053 - DNA, 609 bp, Homo sapiens
  misc_feature: GYAE6OF01EUET2.22.30.C08.1.454.CMB.1.raw
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggcctattttggcagccaccacgaagggggtcgggatcccgtgatcgcttcgtcgggctccgagctcgtggggccgagcgctacctcaccatcctccacgccctccacgtctagaagatggacggctagtacttattacgtgtacagacagtcggacgtcgtcggcgtcgtgggcttggttccgggcgggaggggaacctaagcgtacggacccgttcccgtagggtccacggaccccgaaggcccgttaccggccccccgttcggtcccacccgttcccgttccgttacccccaccccgttccctcccgccggtacccgg

SEQ ID NO: 86054 - DNA, 647 bp, Homo sapiens
  misc_feature: GYAE6OF01EOQJE.22.30.C08.1.454.CMB.1.raw
  modified_base (411)..(411): a, c, t, g, unknown or other
  misc_feature (411)..(411): n is a, c, g, or t
  modified_base (635)..(635): a, c, t, g, unknown or other
  misc_feature (635)..(635): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattgggggctgagcgtggtctttccttagtgctattttagagtgtcagtgtgaggtgcgcctggtgaatcgtggggggccttggtccagccgtggggggtccctggagactcgcctgtgcagcctctggattcgagtttggagcctactgtctagtacgttgggtcccgcgaggcctccggaagggggtaaggggcttgggaggtggggtcggaccaggcaagtaccgaaagaacgacggaacaagttaaggtaattttagtggtcgtcccgtntggtaggacgggacgtattaccactacttcgacctaggacgactaacgtactaaacgaacttcaacgtttctttacgtgacgtaagcgttagggaacctggtaccctgggaccggaccggaccgggaaagggacccgacgggttcgtagtttaccttagtttccgtagggttacgtcgaagtaaggacgtaacgtaatacccgtaagtgtttactttagtaagngtaaaccgttag

SEQ ID NO: 86055 - DNA, 514 bp, Homo sapiens
  misc_feature: GYAE6OF01BSYHF.22.30.C08.1.454.CMB.1.raw
  modified_base (261)..(261): a, c, t, g, unknown or other
  misc_feature (261)..(261): n is a, c, g, or t
  modified_base (309)..(309): a, c, t, g, unknown or other
  misc_feature (309)..(309): n is a, c, g, or t
  modified_base (361)..(361): a, c, t, g, unknown or other
  misc_feature (361)..(361): n is a, c, g, or t
  modified_base (375)..(375): a, c, t, g, unknown or other
  misc_feature (375)..(375): n is a, c, g, or t
  modified_base (397)..(397): a, c, t, g, unknown or other
  misc_feature (397)..(397): n is a, c, g, or t
  modified_base (400)..(400): a, c, t, g, unknown or other
  misc_feature (400)..(400): n is a, c, g, or t
  modified_base (430)..(430): a, c, t, g, unknown or other
  misc_feature (430)..(430): n is a, c, g, or t
  modified_base (440)..(440): a, c, t, g, unknown or other
  misc_feature (440)..(440): n is a, c, g, or t
  modified_base (457)..(457): a, c, t, g, unknown or other
  misc_feature (457)..(457): n is a, c, g, or t
  modified_base (484)..(484): a, c, t, g, unknown or other
  misc_feature (484)..(484): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagctggtctttttccttgttgcttattttagaaggtgtccagtgtgaggtgcgcctggtggaatcgtggggggccttggtccagccgtgggggtccctgagactcgcctgtgcngcctcgtggattcggagttttggagcccttatgtctgacttgggtccnccaggcctccgaggggagggctggagtgggtgccagcagtcaacgagacganagtaagtatttagngtgctgtgtgaggcattccacntcnccagagacaacgtcaagactcacttgttcngcagatgacngctgcgagccgagaccncggctgtctattctgtgtcagagacgngactactagtagttattatagtgagtaacg

SEQ ID NO: 86056 - DNA, 582 bp, Homo sapiens
  misc_feature: GYAE6OF01CI7F5.22.30.C08.1.454.CMB.1.raw
  modified_base (398)..(398): a, c, t, g, unknown or other
  misc_feature (398)..(398): n is a, c, g, or t
tcagacatacgcgtcacgaccggtgctcgatttagtctgacgtcaaagggaaagggggagctctgggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacacgccggagaagggccctcgctacttaatgaagattggccattttggcagccacacgaagggggtcggatccctgatcgcttcgtcgggctccagctcgtggggcgagcgctacctcaccatctccacgcctccagtctgaagntggagctgtactattactgtacagacagtggacgctggcgtctgggcgttggttccgggcgggaacggggtaccgaaggtctacgggacccgtccgtagggtccacggacccgaacggtcctaccggtccccccgtggtccctacttcccgttccggttccccgccccttccgtccgcgtaccg

SEQ ID NO: 86057 - DNA, 663 bp, Homo sapiens
  misc_feature: GYAE6OF01EKG9Y.22.30.C08.1.454.CMB.1.raw
  modified_base (386)..(386): a, c, t, g, unknown or other
  misc_feature (386)..(386): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagctggcttttccttgttgctattttagaaggtgtccagtgtgaggtgcgcctggtggaagtcgtgggggggccttggtccaggccgtggggggtccctgagactcgcctgtgcagcctcgtggacttcgagtttggagcctactgtctgacgttcgggtccgcaggctccgaggggacggggctgggaggtgggtggccagcatacgaacgaagacggacaagtaaggtaattttagnggtggaacttcgtaggtacggaaacgggcctagtttccacctagtcctaccgaaggaacgaacctaaacggtacaaacgtaacctacgaacctttgtttacctgacaggtacgtcggaaccacgtcccgtaggaccgaacggtccgggaaggacccgacgggtacccgttaggttaccgttacgttttccggtaggttacgacgtaaggaacggtaacggtaacgaacttaaccgtaagtaacggtttacttactttaagtacggtaagttaaacgg

SEQ ID NO: 86058 - DNA, 640 bp, Homo sapiens
  misc_feature: GYAE6OF01EA7GE.22.30.C08.1.454.CMB.1.raw
  modified_base (185)..(185): a, c, t, g, unknown or other
  misc_feature (185)..(185): n is a, c, g, or t
  modified_base (278)..(278): a, c, t, g, unknown or other
  misc_feature (278)..(278): n is a, c, g, or t
  modified_base (282)..(282): a, c, t, g, unknown or other
  misc_feature (282)..(282): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctccaggttgtactgactcaatcgccctctgcctctgcctcccgtgggacncctcggtcaacctcacctgtcgttcttagtagtcaacacgtattactacaccgtcgcgtgcatcaacacagccggagacggcctgctactaangaantgctatttgcagccacacgagggggtcggatcccgtgatcgcttcgtcggctcgagctcgtcggggccgagccgtctaccctcaccgtactcctccacgccctaccgagtctacgaagactggacggctgtaaccttattactgtacagacgtagtacgggacgtcgtcgggtacgtcgtcgggtcgttcggttaccggggacgggtaccggggtaaccgacggtaccgtacggacccggtttaccgacgggttacccgacggtacccgaaacgggtccctacccggtccccccggtgggttaccctaccgttccgttccccgttaccccctacccttcccgtcgacccggttaccgg

SEQ ID NO: 86059 - DNA, 718 bp, Homo sapiens
  misc_feature: GYAE6OF01CFOL0.22.30.C08.1.454.CMB.1.raw
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggacgcctcggtcaacctcacctgcgttcttagtagtcaacacgattactacaccgtcgcgtggcatcaacaacagccggagacggccctcgctactaatgaagattggccattttggcagccaccacgaagggggtcggactcccgtgactcgcttcgtccgggctccgagctcgtcggggccgagcgcctaccgtcaccatcctcccgagccctccgacgttcctaggaacgtagttcggaacgggtcctagaaccttattaccgtgttaccaaggactaggtacggggaccgtcgtgggaccgttcggtcgggtccgtttgggttccggggaccgggtaacgggggtacccaaagggtcccgttaccgggtaacccggttcccggttaacgggtacccgaacccgggtaccccggtaaacggggtcccgttaccccgggtccccccggttcccgggttaccctaaccccgtttcccggttccccggttcccccccggtcccctttacccccgtcccggtaccccgggttacccgg

SEQ ID NO: 86060 - DNA, 618 bp, Homo sapiens
  misc_feature: GYAE6OF01CEHC6.22.30.C08.1.454.CMB.1.raw
  modified_base (380)..(380): a, c, t, g, unknown or other
  misc_feature (380)..(380): n is a, c, g, or t
  modified_base (398)..(398): a, c, t, g, unknown or other
  misc_feature (398)..(398): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattgggggctgagcgtggtcttttccttgttgctattttagaagtgtcagtgtgaggtgcgcctggtggaatcgtgggggggccctggtccagccgtgggggtccctgagactcgcctgtgcacgcctcgtggtattcggagtttgggacgtcctacgtgtctgaccgttggggccgcgaggccgtccggaggggacgggcgtgggaggtgggtcggccgagcatacgaaacggaagacgganaagtaaaggtaatttagngtcggtcctcgtaggtaggaacgggcctattccgacctatcctaccgagacgaacaacgtacaaagtaactctacgttcttgtgacgtagtagtacggacacggtctcggacggacggaccggaaggaccgacggtcgtacgttacttagtttcgtcggtcgtacgacgacgaacggcgtaataccgttactagttatttacgttaatggtaagttaacg

SEQ ID NO: 86061 - DNA, 629 bp, Homo sapiens
  misc_feature: GYAE6OF01CRAM6.22.30.C08.1.454.CMB.1.raw
  modified_base (271)..(271): a, c, t, g, unknown or other
  misc_feature (271)..(271): n is a, c, g, or t
  modified_base (276)..(276): a, c, t, g, unknown or other
  misc_feature (276)..(276): n is a, c, g, or t
  modified_base (286)..(286): a, c, t, g, unknown or other
  misc_feature (286)..(286): n is a, c, g, or t
  modified_base (305)..(305): a, c, t, g, unknown or other
  misc_feature (305)..(305): n is a, c, g, or t
  modified_base (343)..(343): a, c, t, g, unknown or other
  misc_feature (343)..(343): n is a, c, g, or t
  modified_base (431)..(431): a, c, t, g, unknown or other
  misc_feature (431)..(431): n is a, c, g, or t
  modified_base (504)..(504): a, c, t, g, unknown or other
  misc_feature (504)..(504): n is a, c, g, or t
  modified_base (596)..(596): a, c, t, g, unknown or other
  misc_feature (596)..(596): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattgggggctgagcggtgtcgtttcctaggtcgctaattttagagtgtcagtgtgaggtgcgctggtggaatcggtggggggccttgggtccaggcccgtggggggtcccctggacgactccgccgtgtgacgntcctntggacttcgnggtttggactcctcgtgtntgtcgttgggccgctaggcctcgagggagggtctgggngttgggcgacagctagacgaacgagcgatagtaaggttatttagtcgtcgtccgtagtgggtacggtaaacgggtcctaaccgtttanacccggtaactttcccaaccgaaagcgtaaaaccccgacgtaacgaactaacctaccgttaggtttccttacncggtaccaagttcgaccgacgttccggcgtacgagccggacgaacggtcctacgtcgttacgttctcgttgcgtagacggacgtagacgtanacttaacgcttaagttcttaagacgtatagtag

SEQ ID NO: 86062 - DNA, 568 bp, Homo sapiens
  misc_feature: GYAE6OF01B1JI5.22.30.C08.1.454.CMB.1.raw
  modified_base (429)..(429): a, c, t, g, unknown or other
  misc_feature (429)..(429): n is a, c, g, or t
  modified_base (475)..(475): a, c, t, g, unknown or other
  misc_feature (475)..(475): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattgggggctgagctggcttttccttgttgctattttagaaggtgtccagtgtgaggtgcgcctggtggatcgtggggggccttggtccagccgtgggggtccctgagactcgcctgtgcagcctctggattcgagtttggagcctactgtctgacttgggtccgccgaggcctccgaggggaacggggctgggagtgggtcggccagcatcaacggaagacggacaagtaaagggtaattttagtgtaggcctcgtggtggaacgggccatttccaccgtatcctccaganaccaacgtcaaagactcacttgtttctgctagatggacagcctgcncatggcgacgaccggccgtattactttcgagttcgacgtaaacgccgaggccgggagtactcgtacgactaccgaacgtcttaagttaacccg

SEQ ID NO: 86063 - DNA, 751 bp, Homo sapiens
  misc_feature: GYAE6OF01B46VP.22.30.C08.1.454.CMB.1.raw
tcagacatacgcgtcacgaccggtgctcgatttagtctgacgtcaaagggaaagggggagctctggggagtctgcaccatggcttggaccccactcctcttcctcaccctcctcctccactgcacagggtctctctccgaggttgtactgactcaatccgccctctgcctctcgcctcccgtgggacgcctcggtcaacctcaccgtgcgttacttagtagtcaacacgtacttactacaccgtcgcgtgcatacaaacaacgaggccggaggtaacggccctcggtactaacttaagtaggaagtaagttcggccttaagttttcgggacacgcccaacgacgaacggggggtcggactcccgtagacgtcgtaccttcgtccgggtcctccgacgtcgtcggtcggggaccgacgccggtacctaccctccgaacctactcctacccacgtccctacgacgtctaaggaacgtagtacgggtacgtctacgtaaccgttaattaccgtagttaccgaagtacgtacgggtacgggtaacccgtgtcgggtaccggtcgtacgggtaccggttcgggttaccggggaccgggtaacgggtaacccgtaacgttccggtacccggaaccgttacccggtacgggacctacggaaaccccgtaacgggccctaccccgggtcccctaccggttaccgtacccgtttccgaccccgtttccccctacccgtacccgtcgtcccggtaaccggg

SEQ ID NO: 86064 - DNA, 757 bp, Homo sapiens
  misc_feature: GYAE6OF01DR7IZ.22.30.C08.1.454.CMB.1.raw
  modified_base (298)..(298): a, c, t, g, unknown or other
  misc_feature (298)..(298): n is a, c, g, or t
tcagacatacgcgtcacgaccggtgctcgatttagtctgacgtcaaagggaaagggggagctctgggggagtctgcaccatggcttggaccccactcctcttcctcaccctcctcctccactgcacagggtctctctccaggttgtactgactcaatcgccctctcgcctcgtcgccctcccgtggggacgcccttcggtccaaccctcaccctgtccgtttcttagtagtaccaacacgtattacctacaccgtcgcgtgcatcaacaacagccggagacggccctcgctacgtaanacgaagtagtcggacctagtttcggacacgcccaaccgacggaacggggggtcggactcccgtggacgttccgtcgtttcgtccgggccttaccgacggtccgtacggtcgggggacccgtacgcccggtacctacccgtccaacccgtacttccctacccgacgtccccgtaccctaggttccgtaacggaagtcgtggacggtcttaacgtactttactttacgtacgtacgaacgacgtaggtcgggacgtcgtcgggtaccgtcgtcgggtaccgtttcgggtacccgggcgggtaaccggggtacgaacggtcccggtaccggtacccggttaccgtacggtacccggaccgtaaccccggacgggtccccgtacccgtaccccccggttcggtacccgtccttacccggtttccccgtaccccctaccccggtttcctaccggccgttaccgg

SEQ ID NO: 86065 - DNA, 752 bp, Homo sapiens
  misc_feature: GYAE6OF01A0JWA.22.30.C08.1.454.CMB.1.raw
tcagacatacgcgtcacgaccggtgctcgatttagtctgacgtcaaagggtaaagggggagcgtctgggggagtcctcgcgtacccaagtgggtcttggacccctacgtcctcttcctcaccctcctcctccactgcacagggtctctctccgaggttggtactgactcaagttcgtcctctgtccttacgtcgtcctccgtgggacgtccgtcggtccaaccgtctaccgtggtcgttcgttaggtacgtctaacgtacgtattaccgtaccggtaccgtcggcgtcggctactcaacaacgacggccggtaggaacgggtcctcgtaccttaacttaagtagtaagtacgttcggtacttacgtttcggacgtaccggtacccgaaccggtaacgggtaacgggggtaccggtaccgtaccggtaggtacgtccgtcgttcggtcggtaccgtacgtacgtcgtacggtacgggaccgtacgtaccgtacctaccgtactacctacgtaccgtaccgtacgtccgtacgtacggtacgtacgtaacgtacgtacggacgtactacgtacttacgtacgtacgtacgaacgtacgtacggtacggtacgtcgtcggtcgtacgtcggtcgtcgggtcggacggacggtacgtacgtcgtacgtaccgtcgtacgtcgtaccgtacgtacggtccgtcccggtacccgtcggtacctcgttccgtccgtcccgtaccgtccgtcggtcgtcg

SEQ ID NO: 86066 - DNA, 642 bp, Homo sapiens
  misc_feature: GYAE6OF01BQM47.22.30.C08.1.454.CMB.1.raw
  modified_base (284)..(284): a, c, t, g, unknown or other
  misc_feature (284)..(284): n is a, c, g, or t
  modified_base (289)..(289): a, c, t, g, unknown or other
  misc_feature (289)..(289): n is a, c, g, or t
  modified_base (299)..(299): a, c, t, g, unknown or other
  misc_feature (299)..(299): n is a, c, g, or t
  modified_base (360)..(360): a, c, t, g, unknown or other
  misc_feature (360)..(360): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctccaggttgtactgactcaatccgccctctcgcctctcgcctcccgtgggacgccgtcggtccaacctcacctgtcgttcttagtagtcaacacgtattacacaccgtcgcgtgcatacaacaacaggcggagacggcctcgctactangaagntgctattgcncgccacgacgaggggtcgactcctgatcgtcttcgtcggcctcgagcgtcgtcggggacgngccgactacctcacctactccacctacgccctacgtacgtcaggaagtacgtggacggtctacgtacttacttacgtcgtacgacgacgtaggttacgggacgtcggtcggtacgttgtcgggtcgttcgggtacgggacgggaccgggtacacggtcgtaccggtacccggtacgtacggtaccgtaccggacccgtaacggtcccgtcccgggccccgttcggtacccgtacgttaccccttcccggtaccccctacccgtccctcccggacttacccgg

SEQ ID NO: 86067 - DNA, 730 bp, Homo sapiens
  misc_feature: GYAE6OF01EB5GU.22.30.C08.1.454.CMB.1.raw
  modified_base (185)..(185): a, c, t, g, unknown or other
  misc_feature (185)..(185): n is a, c, g, or t
  modified_base (284)..(284): a, c, t, g, unknown or other
  misc_feature (284)..(284): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggacncctcggtcaacctcacctgtcgttcttagtagtcaacacgattactacaccgtcgcgtggcatcaacaacagccggagaacggccctcgactacttaangaagtattggcctagtttgcagccaccgaacggaacgggggtcggactcccgtgacgtcgtcgttcgtcgggctccgagccgtcggtcggggccgacggccgtcctaccgtccacctactccgtccacgtccctaccgacgttccgtaggaacgtacgtcggacggtctacgtaacctttaacttacgtacgttaccgaagtaccgtaaggttcggggaaccgtcggttcgggcccgtttacggtcgggtccgttcggggtttaccggggccggggtaacgggaccgtaacggtcgtaccggtacccgttacccggtacggaccgtacccggacccggaacgggttcccgtaccccggtaccccccggttcggttacccctccccgtttcccgttacccgtttcccccccgcccctttaccccggtacccgtcccgggttacccgg

SEQ ID NO: 86068 - DNA, 588 bp, Homo sapiens
  misc_feature: GYAE6OF01DNYAV.22.30.C08.1.454.CMB.1.raw
  modified_base (330)..(330): a, c, t, g, unknown or other
  misc_feature (330)..(330): n is a, c, g, or t
  modified_base (346)..(346): a, c, t, g, unknown or other
  misc_feature (346)..(346): n is a, c, g, or t
  modified_base (379)..(379): a, c, t, g, unknown or other
  misc_feature (379)..(379): n is a, c, g, or t
  modified_base (464)..(464): a, c, t, g, unknown or other
  misc_feature (464)..(464): n is a, c, g, or t
  modified_base (483)..(483): a, c, t, g, unknown or other
  misc_feature (483)..(483): n is a, c, g, or t
  modified_base (488)..(488): a, c, t, g, unknown or other
  misc_feature (488)..(488): n is a, c, g, or t
  modified_base (536)..(536): a, c, t, g, unknown or other
  misc_feature (536)..(536): n is a, c, g, or t
tcagacatacgcgtcacgaccggtgctcgatttagtctgacgtcaaagggaaagggctcagagaggagccttagccccggactccaaggcctttccacttggtgatcagcactgagcacagaggactcacagtgggattggggctgagcgtgtcgtttctaggtgctatttagagtgtcagtgtgagtgcgcgtggtaggacgtcggtggggggcctttgggccaggtccgttcgggggtcctgacgctcgctgtgcacgcctgtagcttgaggtttgactcctatgtctcgcttcgggcccgaggcctcgagggtacggggtctagggnggtcgggcgaccaggnactacgaaagaggaccgatagtaaagttattgngtcgtcctgtggagaacgggtcaattccaactcgttacacgagaacgaactaacggtacaaaggtacctacgctttacggtttcncgaacgtagtacgagaacncgcgngacgacggaccgagccgtagttccgtacgttacttcgttgtcgtacgnggaaacgacgacgacgtaactacgtaacgtacttacttagtacagtagtaac

SEQ ID NO: 86069 - DNA, 563 bp, Homo sapiens
  misc_feature: GYAE6OF01AVYPU.22.30.C08.1.454.CMB.1.raw
  modified_base (434)..(434): a, c, t, g, unknown or other
  misc_feature (434)..(434): n is a, c, g, or t
  modified_base (557)..(557): a, c, t, g, unknown or other
  misc_feature (557)..(557): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaacgggccctcgctaacttaatgaagattggcctattttggcagccaccacgaaggggtcggatcccgtgatcgcttctcgggctccagctcgtggggccgagcgctacctcaccatctcagcctccagtctgaagatgagtctagactattactgtcagacagttcgggacncgtcggcgtctgggtctggttccgggcgggacgggtaccgaaggcctcggacccgtcgtacgggcacggccccaagggccttaccgcccccttggcctacgtcctcgttccccaccctcctcncgtccg

SEQ ID NO: 86070 - DNA, 581 bp, Homo sapiens
  misc_feature: GYAE6OF01D8YLW.22.30.C08.1.454.CMB.1.raw
  modified_base (270)..(270): a, c, t, g, unknown or other
  misc_feature (270)..(270): n is a, c, g, or t
  modified_base (358)..(358): a, c, t, g, unknown or other
  misc_feature (358)..(358): n is a, c, g, or t
  modified_base (361)..(361): a, c, t, g, unknown or other
  misc_feature (361)..(361): n is a, c, g, or t
  modified_base (379)..(379): a, c, t, g, unknown or other
  misc_feature (379)..(379): n is a, c, g, or t
  modified_base (391)..(391): a, c, t, g, unknown or other
  misc_feature (391)..(391): n is a, c, g, or t
  modified_base (398)..(398): a, c, t, g, unknown or other
  misc_feature (398)..(398): n is a, c, g, or t
  modified_base (471)..(471): a, c, t, g, unknown or other
  misc_feature (471)..(471): n is a, c, g, or t
  modified_base (514)..(514): a, c, t, g, unknown or other
  misc_feature (514)..(514): n is a, c, g, or t
  modified_base (546)..(546): a, c, t, g, unknown or other
  misc_feature (546)..(546): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccagtgggattggggctgagcgtgtcgttttccgttgtgcttattttagaaggtgtcagtgtgaggtgcgcctggtggatcggtggggggtccttgggtccaggtccggtcggggggtccctgacgtactccgccgttgngcgacgccgtcgtggatttcgtaggtttgggactcctagttgtctgtacgttgggcccgcgaggctcgaggggaggctggaggtgggngcngcatacgaacgagacganagtaagtatttngtgactntggtaggacggtctagtcacctagtacctcgaagaacgtaccaacgtacaaactaacctctaactttgttccngactagagtggaaccgtcgagcgacggccgaagaccgcggttntacgttcttcgttgtcgtagcgagagacgtanactacgttaacgttagttatttagtagtgtagtag

SEQ ID NO: 86071 - DNA, 633 bp, Homo sapiens
  misc_feature: GYAE6OF01DLAQ8.22.30.C08.1.454.CMB.1.raw
  modified_base (205)..(205): a, c, t, g, unknown or other
  misc_feature (205)..(205): n is a, c, g, or t
  modified_base (251)..(251): a, c, t, g, unknown or other
  misc_feature (251)..(251): n is a, c, g, or t
  modified_base (254)..(254): a, c, t, g, unknown or other
  misc_feature (254)..(254): n is a, c, g, or t
  modified_base (258)..(258): a, c, t, g, unknown or other
  misc_feature (258)..(258): n is a, c, g, or t
  modified_base (268)..(268): a, c, t, g, unknown or other
  misc_feature (268)..(268): n is a, c, g, or t
  modified_base (275)..(275): a, c, t, g, unknown or other
  misc_feature (275)..(275): n is a, c, g, or t
  modified_base (297)..(297): a, c, t, g, unknown or other
  misc_feature (297)..(297): n is a, c, g, or t
  modified_base (305)..(305): a, c, t, g, unknown or other
  misc_feature (305)..(305): n is a, c, g, or t
  modified_base (316)..(316): a, c, t, g, unknown or other
  misc_feature (316)..(316): n is a, c, g, or t
  modified_base (318)..(318): a, c, t, g, unknown or other
  misc_feature (318)..(318): n is a, c, g, or t
  modified_base (321)..(321): a, c, t, g, unknown or other
  misc_feature (321)..(321): n is a, c, g, or t
  modified_base (335)..(335): a, c, t, g, unknown or other
  misc_feature (335)..(335): n is a, c, g, or t
  modified_base (365)..(365): a, c, t, g, unknown or other
  misc_feature (365)..(365): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattgggggctgagcggtcgtcgttcctaaggtcgctaatttagagtctcagtgtgagtcgcgcgtggngaatcggtgggggccttgccagccgtggggtcctgacgctcgctgngcngccntggtattcgngttggcncctagtgtcgtagtgtcggccncgaggccncgagggacggngnggnggtggcgactcganacgacgaagagatataagttaacgtattgngtcgtccgtgtaggaggacgtctactaccacgtctaccgagacgaacgtaactaaacgtacaactaaccgttgtaccgtttgtccgagtaacgaggtcgtacgcgtacgtcgacggtaccgaccggtacggacgtacgtccggtttgttaacttacgttacgttacgttacggttacggtaacggtacggaaggtaacggtaacgttaacgttaacgttaacggttaacgtttaacgtttacgttaacgttacggttaacggtaacgg

SEQ ID NO: 86072 - DNA, 643 bp, Homo sapiens
  misc_feature: GYAE6OF01D2I3O.22.30.C08.1.454.CMB.1.raw
  modified_base (504)..(504): a, c, t, g, unknown or other
  misc_feature (504)..(504): n is a, c, g, or t
  modified_base (522)..(522): a, c, t, g, unknown or other
  misc_feature (522)..(522): n is a, c, g, or t
tcagacatacgcgtcacgaccggtgctcgatttagtctgacgtcaaagggaaaggggctcagagaggagccttagccccggactccaaggccctttccacttggtgatcagcactgagcacagaggactcaccatgggattggggctgagctggtcttttccttgttgcttattttagaaggtgtccagtgtgaggtgcgcctggtggaatcgtggggggccttggtccagccgtgggggtccctgagacctcgcctgtgcagcctctggtattcgtagtttggagtccttacgtgtctgtaccgtttcggggtcccgccgagggccttccggaagggggaaggggctgggaggtggggtcgccgagcatcgaaacgaaggaacggacaagtaaaggtaattttagtggtacggtccttcgtaggtacgggaaacgggtccgtaatttcccaaccctattccctacgagaacgactaaacgtcaaagaacctcactttgtttcnggtacaggtctaggaccngtccgaggaccggacgcccggaaggccgacggtctgttaccttagtttcgtggttcgacgaaggaaggaccgaaagtacttaccgtaacgtagtttaactttcgtaatggaacgttaaacg

SEQ ID NO: 86073 - DNA, 700 bp, Homo sapiens
  misc_feature: GYAE6OF01ALKAX.22.30.C08.1.454.CMB.1.raw
  modified_base (560)..(560): a, c, t, g, unknown or other
  misc_feature (560)..(560): n is a, c, g, or t
  modified_base (579)..(579): a, c, t, g, unknown or other
  misc_feature (579)..(579): n is a, c, g, or t
  modified_base (587)..(587): a, c, t, g, unknown or other
  misc_feature (587)..(587): n is a, c, g, or t
  modified_base (662)..(662): a, c, t, g, unknown or other
  misc_feature (662)..(662): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggagttggggctgagctggtcttttccttgttgcttattttagaaggtgtcagtgtgaggtgcgcctggtggatcggtggggggtccttggtccagccggtggggggtccctgacgctcgcctggtgcacgtcctcgtggtatttccggtaggtttcgggacgtcccgttacgttcgttccgttggtaccggtttcgggggtccccgccggtacgggtccgtacccgggaagggggaacgggggtccgtggggtagggtcggggtcggcccgaggcgtacgtaccgaaacggaacggaaccggtaactaagttaaaggttaattttagtcggtacggtcctcgtggtacggaacgggtccgtactccgacctactccacgaaggacgaacctacgtaacaacgtacctctaaccttcgtttaccngacaaggtacgtacggacncggtccgnggtaccggacggaccgggtacgggaccgtacggtcttagttacttcgttcgttgtcgtacgaggtacgaacggtnaacttacgtacgtagttacttagttactggtataacgg

SEQ ID NO: 86074 - DNA, 713 bp, Homo sapiens
  misc_feature: GYAE6OF01A2NUX.22.30.C08.1.454.CMB.1.raw
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctcgccctccctggggacgcccttcggtcaacctcaccctgccgttcttagtagtccaacacgtattaccgtacaccgtcgcgtggcatcaacacaggccgagacggccctcgctactatgaagtattggactatttcggcacgccacgacgaaggggtcggactcccgtgactcgtcttcgcgggctccgagtctcgtcggggccgagccgacgtacctccgacctactccaccgacgtccctccgtagtccgtaggtaacgacgtcggtacggactacgaacgttattacgtgtaccgagtacctaggtaccggacgtcgtacgggtccgtacgtcgggttcgtacgggttcgggaccgggacggtaaccgtacggttactaccgggtacccttaccgggtacggttaacccgacccgggttaccccgaaaccgggtccccgttaccccggtaccccccggttcggtacccgttacccggttacccgtttcccccggttaccccccgttacccgtccccttaccccgggtaagttaccccgg

SEQ ID NO: 86075 - DNA, 657 bp, Homo sapiens
  misc_feature: GYAE6OF01EHHIS.22.30.C08.1.454.CMB.1.raw
  modified_base (301)..(301): a, c, t, g, unknown or other
  misc_feature (301)..(301): n is a, c, g, or t
tcagacatacgcgtcacgaccggtgctcgatttagtctgacgtcaaaagggaaagggggagctctggggagtctgcaccatggcttggaccccactcctcttcctcaccctcctcctccactgcacagggtctctctcccaggttgtactgactcaatcgccctctgcctctcgcctcccgtgggacgcctcggtaccaacctcacctgtcgtttcttagtacgtacaacacgtacttacctaccgaccgtcgcgtggcactacaaacacgagccggaagacggccctcgactaacttaangaagtattcggctagtttcggcacgccacgacggaacgggggtcggactccgtgactcgtcttcgtcgggctcgacggctcggcgggccgagcgtacctaccgtccacctactcctaccgacgccgtaccgacgtcgtagaacgtagtcgacggtctagtacttaacttacgtacgtacgacgtaacgacggtacgggacgtcgtacggtcgttcggtcggtcggttacgggtcgggacgggacgggtaccgaggtcgtacgtaccgtcgtacggtcgaccgaccgacggtccgtcccgcccggtcggtacctaccgttacccgttccgtccccgtccctacgtcgccgttaccgg

SEQ ID NO: 86076 - DNA, 543 bp, Homo sapiens
  misc_feature: GYAE6OF01B0E21.22.30.C08.1.454.CMB.1.raw
  modified_base (371)..(371): a, c, t, g, unknown or other
  misc_feature (371)..(371): n is a, c, g, or t
  modified_base (453)..(453): a, c, t, g, unknown or other
  misc_feature (453)..(453): n is a, c, g, or t
  modified_base (490)..(490): a, c, t, g, unknown or other
  misc_feature (490)..(490): n is a, c, g, or t
  modified_base (506)..(506): a, c, t, g, unknown or other
  misc_feature (506)..(506): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatggggattggggctgagctggcttttccttgttgctattttagaaggtgtccagtgtgaggtgcgcctggtggaatcgtgggggggccttggtccagccgtggggggtccctgagacctcgcctgtgcagcctctggattcgagtttggagcctactgtctgacttgggtccgccaggcctccgagggtaagggctggagtgggtcggcagcatcaagagacgacagtaagtatttangtggctcgtgtgaacgggcgtattcgactatctccagtacgacaacgtacaaagactcacttgttctagccgagtatggacngtctgccgagaccgtagacgacggtctgtctctttgngtgtacgagagacganactacctaagtacgttactttacgttatgtaagtacg

SEQ ID NO: 86077 - DNA, 827 bp, Homo sapiens
  misc_feature: GYAE6OF01CQ56C.22.30.C08.1.454.CMB.1.raw
  modified_base (167)..(167): a, c, t, g, unknown or other
  misc_feature (167)..(167): n is a, c, g, or t
  modified_base (311)..(311): a, c, t, g, unknown or other
  misc_feature (311)..(311): n is a, c, g, or t
tcagacatacgcgtcacgaccggtgctcgatttagtctgacgtcaaagggaaagggggagctctggggagtctgcaccatggcttggaccccatcctcttcctccaccctcctcctccactgcacgagggtcctctctcccgaggttgtactgactcaatcgccctntgcctctcgcctccgtgggacgcctcggtccaacctcacctgtcgttcttagtacgtacaaactacgtacttacaccgaccgtcgcgtggcataccaaacgacgacggaccggacgaaacggccctccggtacttaaccttaancgtaaagtacttgggtacctaagttttcggacctacgacccaaccgtaaacggaacggggggtccgggtaccttacccgtagtaacgtccggtcttccggttccgggcttacccgaacggtcccgttcgggttccgggggacccggtacggaccgtacccgttaacccgtacccgtacccgtaactccctacccgaccgtcccctaaccggtacgtaccgtaaggtaagtacggtaacggtcgtaacgtacgtaacgttaacgtttactacgtaacgacgtaacgtaggtaccgggtacgccggttggtacggttctacgggtcggtttaccggggtccggggtaaccgggaaccgggggaaccttaagggtccccgttacgggtacccgtaccggtaacggttaccggaccgtaaccggaccggtaccggtccccggtcccccggttacggtacccgtccgttacccgttcccggttacccccgtcccgttaccccgtccgaaccggtttaccgg

SEQ ID NO: 86078 - DNA, 740 bp, Homo sapiens
  misc_feature: GYAE6OF01D3FIH.22.30.C08.1.454.CMB.1.raw
  modified_base (192)..(192): a, c, t, g, unknown or other
  misc_feature (192)..(192): n is a, c, g, or t
tcagacatacgcgtcacgaccggtgctcgatttagtctgacgtcaaagggaaagggggagctcgtggggagtctgcaccatggcttggacccactcctcttcctcaccctcctcctccactcgcacgagggtctctcctccgtaggttgtactgactcaactccgcctctcgcctctcgcctccgtgggacnccgtcggtaccaacctcaccgtgtccgtttcttagtacgtacaacgtacgtactttaaccaccgaccggtcggcgtggctactaccaaacgacgacggaccggaagaaccgggtcctacgtacttaacgttaagtagtaacgtacgtcgtacttagttacgacgacgtaccgaacggaacgggtacggggtccgtaccgtccgtacgtacgtccgtcgttccggtccggtcctccgtacgtccggtcggtccgggaccgtacgtccgtacccgtacctacctacctactccgtaccgtaccgtaccgtacgtacgtacgtagtaacgtacgtacggtacgtacgtacgttaacgttacgtacgtacgtacgtaacggtacgtacggtacggtacgtcgtcggtcgtcgtcggtcgtcgggtaccgggacggaccggtaacgtacgtcgtaccggtaccgtacggtacgtacgaccgaccgtaccgtccgtcccgtcccgtcgtaccgtccgttcccgtcccgtcccgtccgttccgtcgtccggtacg

SEQ ID NO: 86079 - DNA, 641 bp, Homo sapiens
  misc_feature: GYAE6OF01CXKDE.22.30.C08.1.454.CMB.1.raw
  modified_base (191)..(191): a, c, t, g, unknown or other
  misc_feature (191)..(191): n is a, c, g, or t
  modified_base (199)..(199): a, c, t, g, unknown or other
  misc_feature (199)..(199): n is a, c, g, or t
  modified_base (267)..(267): a, c, t, g, unknown or other
  misc_feature (267)..(267): n is a, c, g, or t
  modified_base (284)..(284): a, c, t, g, unknown or other
  misc_feature (284)..(284): n is a, c, g, or t
  modified_base (303)..(303): a, c, t, g, unknown or other
  misc_feature (303)..(303): n is a, c, g, or t
  modified_base (328)..(328): a, c, t, g, unknown or other
  misc_feature (328)..(328): n is a, c, g, or t
  modified_base (371)..(371): a, c, t, g, unknown or other
  misc_feature (371)..(371): n is a, c, g, or t
  modified_base (447)..(447): a, c, t, g, unknown or other
  misc_feature (447)..(447): n is a, c, g, or t
  modified_base (455)..(455): a, c, t, g, unknown or other
  misc_feature (455)..(455): n is a, c, g, or t
  modified_base (475)..(475): a, c, t, g, unknown or other
  misc_feature (475)..(475): n is a, c, g, or t
  modified_base (513)..(513): a, c, t, g, unknown or other
  misc_feature (513)..(513): n is a, c, g, or t
  modified_base (522)..(522): a, c, t, g, unknown or other
  misc_feature (522)..(522): n is a, c, g, or t
  modified_base (527)..(527): a, c, t, g, unknown or other
  misc_feature (527)..(527): n is a, c, g, or t
tcagacatacgcgtcacgaccggtgctcgatttagtctgacgtcaaagggaaagggggctcagagaggagccttagccccggactccaaggccctttccacttggtgatcagcattgagcacagaggactcaccagtgggagttcggggctgaggcggtcgtcgtttcctaggtcgctatttagagtctcngtgcgagngcgcgtggtagagtcggcggggtcttcgcgagtcccggttggggcccaggctacgtcggcctagcganacgtcagtgacgttagngttagaacctcgttccgtntacgacgtaacgttcggtaccacgngggtcctacggaaggggacgttggaaggttcggtaaggccggnacgttacggaataccgaaaggtgaccgaagtagtaaacgttgtccgtgaaggtcctggtacgcggaaacctccgtntaacccgntaccacgtacagacgacganaactacgtactctcgtactcgtagacgtagctacgacncgacgcggngacgnggtacgaccgtgtaacgtacgttacgttgtaaccggtagtaccgtaacggacgtaggtaacgtaaccgttagtaaccttaacgttacgtacttacgtaacggcgttacgtaacg

SEQ ID NO: 86080 - DNA, 837 bp, Homo sapiens
  misc_feature: GYAE6OF01DECZO.22.30.C08.1.454.CMB.1.raw
tcagacatacgcgtcacgaccggtgctcgatttagtctgacgtcaaagggaaaggggctcagagaggagccttagccccggactccaaggcctttccacttggtgatcagcactgagcacagaggactcaccatgggagttggggctgagctggtcttttccttgttgcttattttagaaggtgtccagtgtgaggtgcgccgtggtggaatcggtgggggggtccttgggtcccgaggtccggttcggggggtcccctggacggacctcggccgtggtcgcacgtccgtgtggtactttcggtaggtttggacgtcccttagtcgttcgtcgtacggtttcggggtccccgaccgacgggtccgtaccgggaagggggaacgggggtcgtggggtacgggttggggtcggcccgtaaggcgaacgtacgaaaacggaaggaaccggactaaaggttaaacgggttaatttttagtacgggttcggtacccttacggttacgggtacgggtaaaccgggggtcccgttaagttttcccgaaacccgttacgttacccgttaacccggaaaggtaaccggaaaccccgtaaacggtaacccgtaaaacggtaaacccttcgtaaccgttttcgtttacgacgtacgtagttaagtacgggacctacggtccgtacggacccgggtaacggacccgggtaaggacccggacggttccggttacggtttaccttttacggttccgtagggtttccgtaacggaacgggtaacggtaaaccggtaagtaaccgtttaactacgttaacgtttactttaccgttaagaggttacgttaaacg

SEQ ID NO: 86081 - DNA, 174 bp, Homo sapiens
  misc_feature: GYAE6OF01CHDCI.22.30.C08.1.454.CMB.1.raw
  modified_base (165)..(165): a, c, t, g, unknown or other
  misc_feature (165)..(165): n is a, c, g, or t
  modified_base (170)..(174): a, c, t, g, unknown or other
  misc_feature (170)..(174): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagcgggctggcaaggcgnatagnnnnn

SEQ ID NO: 86082 - DNA, 956 bp, Homo sapiens
  misc_feature: GYAE6OF01DTF0P.22.30.C08.1.454.CMB.1.raw
tcagacatacgcgtcacgaccggtgctcgatttagtctgacgtcaaagggaaagggggagctctggggagtctgcaccatggcttggaccccactcctcttcctcaccctcctcctccactgcacagggtctctctccaggttgtactgactcaatccgccctctcgcctctcgcctcccgtgggacgccgttcggtaccaaccctccaccttcggtccgttttactttaaggtacgtaccaaaccgtaacgtaactttaacctaaccgtacccggttccggtcggtcggacctaactaaccaaaacgaaaccgacgggaccggggaacggaaccggggccccttaccggtaccttaaccgttaaagtacggtaaacgtaggttacggtaccgttaagttttcggacctaccggaccccgaaccgaaccgggaaacgggggggttccgggtacgtacccgtacggtacgttccggtccgtttccggtccgggtcctaccgacggtccgtccggtcgggggccgtaaccggccgtacccgtaaccctccaacccgtacgtaccctaccgaccgtacccgtaccgtacggttaccgtaacggtaacgtacgtacgggacgggtaccgttacgtaaccgtttaacgtttaccgtacggttaacgaacggtaacggtaacgggttaccggggtaaccggtccggttcgggtaccggttcgggttacggttcgggtttccggggttaccgggggtaccggggaacggggtaacccggtaacggtaccgggttaccggtaaccccggtacggtaccgggtacggaaccccggtacccggtaaccgggttcccgtacccccggttacccccgggttcccgttaccccgtaacccgttttccccgggttaccccggttaccccccgttaccccgttccccggtacccggtacggttaccccggg

SEQ ID NO: 86083 - DNA, 606 bp, Homo sapiens
  misc_feature: GYAE6OF01CF8E2.22.30.C08.1.454.CMB.1.raw
  modified_base (475)..(475): a, c, t, g, unknown or other
  misc_feature (475)..(475): n is a, c, g, or t
  modified_base (491)..(491): a, c, t, g, unknown or other
  misc_feature (491)..(491): n is a, c, g, or t
  modified_base (541)..(541): a, c, t, g, unknown or other
  misc_feature (541)..(541): n is a, c, g, or t
  modified_base (594)..(594): a, c, t, g, unknown or other
  misc_feature (594)..(594): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagctggtcttttccttgttgctattttagaaggtgtcagtgtgaggtgcgcctggtgagtcgtggggggccttggccagccgtgggggtcctgagactcgcctggtgcacgcctctggtattcgaggtttggacgtcctatgtctgacgttcgggtccgcgaggccgtccggaggggaacggggctgggaggtgggtcggccgagacagtacaaaggaacgacggactaagtaaaggttaatttgtgtggtccctgtggtagacgggccgtattacacctatcctacgagacgaacaacgtacgaaagtaacctcgtacttcgtttcncgactagagtacgacncgtacgtggacgtacggccgaggaccgcgggtctagttacgttatttcgnggttatccggaagacggtacgtaagtactacgttactaagtttcttatttagngtaagttaacgg

SEQ ID NO: 86084 - DNA, 711 bp, Homo sapiens
  misc_feature: GYAE6OF01EW8OM.22.30.C08.1.454.CMB.1.raw
  modified_base (186)..(186): a, c, t, g, unknown or other
  misc_feature (186)..(186): n is a, c, g, or t
  modified_base (260)..(260): a, c, t, g, unknown or other
  misc_feature (260)..(260): n is a, c, g, or t
  modified_base (288)..(288): a, c, t, g, unknown or other
  misc_feature (288)..(288): n is a, c, g, or t
  modified_base (294)..(294): a, c, t, g, unknown or other
  misc_feature (294)..(294): n is a, c, g, or t
tcagacatacgcgtcacgaccggtgctcgatttagtctgacgtcaaaagggaaagggggagctctggggagtctgcaccatggcttggaccccactcctcttcctcaccctcctcctccactgcacagggtctctctcccaggttgtactgactcaatcgccctctgcctctcgcctccgtgggcnccctcggtacaacctcacctgccgttcttagacgtcgaacacgattactacgaccgtcgcgtggcatcaacacngaccggaagaacggccctcgctacttangaagtnttgcctatttggcagccaccacgaggggtcggactccctgatcgcttcgtcgggctccgagtcgtccgtggggccgagcgctaacccgtcacctactcctccacgccctaccagtctagaagtactcggacgctcgtaacttacttacgacgttcgaacgtacgtagtcggggaccgtcgtcggcgtttccgcgggtcgttcgggtttaccggggccgggtaacggggtaaccccgtaaggtcccgtagggtaaccccggttccggttaaggtcccgtaaacccggaccccggttaaacgggcccgttaaccccggtcccccgggttcccggttacccgtaacccgtttccccgtttacccgggtttccccccgggtcccccctttacccggtttaccccgccggtttaaccccggg

SEQ ID NO: 86085 - DNA, 667 bp, Homo sapiens
  misc_feature: GYAE6OF01A5ORP.22.30.C08.1.454.CMB.1.raw
  modified_base (416)..(416): a, c, t, g, unknown or other
  misc_feature (416)..(416): n is a, c, g, or t
  modified_base (474)..(474): a, c, t, g, unknown or other
  misc_feature (474)..(474): n is a, c, g, or t
tcagacatacgcgtcacgaccggtgctcgatttagtctgacgtcaaagggaaagggggagctctggggagtctgcaccatggcttggacccactcctcttcctcaccctcctcctccactgcacagggtctctctccaggttgtactgactcaatcgccctctcgcctctgcctcctgggagcctcggtcaacctcacctgtcgttcttagtagtcaacacgtattactacaccgtcgcgtaggcactcaacaacgacggccggaagaacgggccctcgcttaacgttaacgtgaaggtattggaccttagttttcggcacgacccaccgaaggaacggggggtcggactcccgtagactcggtccttacggtcgggctccgagtctcgtacggggccacgcgcctaccgcaccgntccgtccacgccctcgagtacctagaagtatcggacggtctaggtacttaacttacgngtcaacgacgaggttcgggacgtcgtgggtccgtcgtcgggtcgtttcgggtcgggacgggtaacgggacctaacggtcgttaccggacccggttacctagggtccgaccggacccgaagggtccttacccggccccgttcggtaacctcgttacccgttccgtttcccccaaccgttcctccgcggttaccg

SEQ ID NO: 86086 - DNA, 629 bp, Homo sapiens
  misc_feature: GYAE6OF01B4PEJ.22.30.C08.1.454.CMB.1.raw
  modified_base (414)..(414): a, c, t, g, unknown or other
  misc_feature (414)..(414): n is a, c, g, or t
tcagacatacgcgtcacgaccggtgctcgatttagtctgacgtcaaaagggaaagggggagctctgggggagtctgcaccatggcttggaccccactcctcttcctcaccctcctcctccactgcacagggtctctctcccaggttgtactgactcaatccgccctctgccctctcgccctcccgtggggacgcctcggtccaacctcacctgtcgtttcttagtagtcaaacacgtattaactaccaccgtcgcggtgcatacaacaacacgccggaggaacggccctcgactacttaatgaagattggacctattttggcacgcccaccacgaacgggggtcggactcccgtgactcgcttcgtcgggcctccagcctcgtcggggcaggcgctacctcaccactcctaccncgtccctcacgtctagaacgagtcgacggtcgtagacttattaccttgtacgagtacacggtagggacgtcgtacgggccgttcgtcggtcgtcggttcgggacggacgggaacgtagcgtacgacccgtcgtaggccacgacccgaaggccgtccgtacccccggtcggtcctacgttccgtccgttacccctacccctcctccgccgtaccgg

SEQ ID NO: 86087 - DNA, 747 bp, Homo sapiens
  misc_feature: GYAE6OF01AELAU.22.30.C08.1.454.CMB.1.raw
  modified_base (182)..(182): a, c, t, g, unknown or other
  misc_feature (182)..(182): n is a, c, g, or t
  modified_base (195)..(195): a, c, t, g, unknown or other
  misc_feature (195)..(195): n is a, c, g, or t
  modified_base (267)..(267): a, c, t, g, unknown or other
  misc_feature (267)..(267): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagcgtggtctttcctagttgctattttagaaggtntcagtgtgaggtncgcctggtagaatctggggggccttggtccagccgtgggggtccctgacgactccggcctgtcgcagcctcnggtattcgagttttaggagcccgtaactgtactggtaacgttgggtcccgaccgagggtccttacccgaggggaaacgggggcttaggggacggttaggggtaggcccgtaaaggctaacgtacccgaaaacggaaacggaacggaaccaacggttaaaagggtaactttttaagtgtaacgggcccttagtggtacggaaacggggtacctattaccgaaccctaagtcctacgaagtacgaaactaacggtacgaaacgtaaactcgtaacttcgtttaccaggtcctaaggaattcgggaaccagtaccccggtggaccggaacggtacccgtaaagggaccgtaccgggtcttccgggttaacttacggtttcgtacggttaggttaacgaacggaagtaaacccggtaaagtaccttaaaccgtttaacgtaagtttaacggttaaccttttagtaaccgaaagggttaaacccg

SEQ ID NO: 86088 - DNA, 740 bp, Homo sapiens
  misc_feature: GYAE6OF01C293X.22.30.C08.1.454.CMB.1.raw
  modified_base (294)..(294): a, c, t, g, unknown or other
  misc_feature (294)..(294): n is a, c, g, or t
  modified_base (300)..(300): a, c, t, g, unknown or other
  misc_feature (300)..(300): n is a, c, g, or t
  modified_base (363)..(363): a, c, t, g, unknown or other
  misc_feature (363)..(363): n is a, c, g, or t
tcagacatacgcgtcacgaccggtgctcgatttagtctgacgtcaaagggaaagggggagctctgggggagtctgcaccatggcttggaccccactcctcttcctcaccctcctcctccactgcacagggtctctctcccaggttgtactgactcaatccgccctctcgcctctcgccctcccgtgggacgccgtcggtccaacctcacctgtcgttcttagtagtacaacacgtatactacaccgtcgcgtgacatacaacaacaggacggagaacggccctcgactactaanagaagngttcgctatttggactacgccaacgagacggggtcgacgtcctgactcgtcttcgcggctcgngcgtgtcgggcgagcgtaccactcaccgtactctccgacgtccctaccgtcgtactacggtaagacgtacggacggtaccgtagtaaccgtactttaccggtacgtacgtaacgacgtacgggtcgggaacgtcgttcgggtacttcgggttccgttacgggtttccgggttacggggtaccggggtaaccgggtaacccgaacgggtaccgggttaccggtacccggttacccgggttaaggttaccccccccggaaaggtaacccggtaccggtcccgggttaccccggtcccccggttaccggttcccgttacccgttacccggttccccggttccccgttacccccggttcccgtacccgtccggttacccgg

SEQ ID NO: 86089 - DNA, 779 bp, Homo sapiens
  misc_feature: GYAE6OF01ESFXD.22.30.C08.1.454.CMB.1.raw
  modified_base (166)..(166): a, c, t, g, unknown or other
  misc_feature (166)..(166): n is a, c, g, or t
  modified_base (189)..(189): a, c, t, g, unknown or other
  misc_feature (189)..(189): n is a, c, g, or t
  modified_base (306)..(306): a, c, t, g, unknown or other
  misc_feature (306)..(306): n is a, c, g, or t
  modified_base (762)..(762): a, c, t, g, unknown or other
  misc_feature (762)..(762): n is a, c, g, or t
tcagacatacgcgtcacgaccggtgctcgatttagtctgacgtcaaaagggaaagggggagctctgggggagtctgcaccatggcttggaccccactcctcttcctcaccctcctcctccactgcacagggtctctctcccaggttgtactgactcaatcgcctcngcctctcgcctcccgtggggacncctcggtccaaccttcaccgtgctttcttagtacgtacaacacgtattactaccgaccgtcgcgtgaccatcaaacacgacggccggataacgggccctacgtaccttaacgttaanacggaagtacgttacggaccgttaagttttacggacacggtacccctaaccgaacggtaaacggggggttccggtaacttcccgtacggtacgtccgtaccgtttccgtccgggtcctacccgtaaggtccgttcccgggtacggggacccggttaacggcccggaccgtttaacccctcggaacccctaacggtccttaccccgaccgtaccccgttacccgtacgtaccgttacggaagtaacgtcggtaacggtcgtacgttaacgtactttaccagttaccaggactagggttccgggactggtcggtacgtcgtagggtccgttcggttacgggccggaacggtacgtaacgcgttaccggtaccgtaccgttaggtaccgaccgtaaccgacgggtacctccggtaccccgtcggtacctacggttccgttaccccgtcccgtaaccccncgttacgccgttaccgg

SEQ ID NO: 86090 - DNA, 555 bp, Homo sapiens
  misc_feature: GYAE6OF01EM5PR.22.30.C08.1.454.CMB.1.raw
  modified_base (374)..(374): a, c, t, g, unknown or other
  misc_feature (374)..(374): n is a, c, g, or t
  modified_base (406)..(406): a, c, t, g, unknown or other
  misc_feature (406)..(406): n is a, c, g, or t
  modified_base (450)..(450): a, c, t, g, unknown or other
  misc_feature (450)..(450): n is a, c, g, or t
  modified_base (500)..(500): a, c, t, g, unknown or other
  misc_feature (500)..(500): n is a, c, g, or t
  modified_base (545)..(545): a, c, t, g, unknown or other
  misc_feature (545)..(545): n is a, c, g, or t
tcagacatacgcgtcacgaccggtgctcgatttagtctgacgtcaaagggaaaggggctcagagaggagccttagccccggactccaaggcctttccacttggtgatcagcactgagcacagaggactcaccatgggattggggctgagctggcttttccttgttgctattttagaaggtgtccagtgtgaggtgcgcctggtggaatcgtggggggccttggtccagccgtgggggtccctgagactcgcctgtgcagcctctggattcgagtttggagcctatgtctgacgttgggtccgccaggctccgaggggagggctggagtgggtggccagcatcaacgaagacggaacagtaaaggtaattttagngtcggccttgtgtaggaacggcgattcaccgntctccaagacgaacaaccggtacaaagaactctaacttgtttcngcagtagtggacagcctgacgacgcggagacgacgtctgtcttatttcgngtcgtcaggagacggagtactactaagtagtttacttacgttaangtagtaaccg

SEQ ID NO: 86091 - DNA, 759 bp, Homo sapiens
  misc_feature: GYAE6OF01BS84Q.22.30.C08.1.454.CMB.1.raw
  modified_base (289)..(289): a, c, t, g, unknown or other
  misc_feature (289)..(289): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccgaggttgtactgactcaatccgcctctgcctctgccctccgtgggacgccgtcggtccaacctcacctgccgttcgttagtacgtcaacgagtacttactacaccgtcgcgtgcatcaacacaggcgaagacgcccgtcgactacttaangaagtagttagcctaagttttcggcacgaccgaaccgaacgggacgggggtccggactacccgtgacgtcgtacgttcgcgggtactccgagccgttcggtcgggggaccgacggtaccgtacctaccgtaccaccgtaacttcctacccgtacgtcccgtacctacggttacctaggaacgtacgtagggacggtcgttaacgtaacttaacgtttaccgtcgtaacgtaacggtactaaagggttccggaaccggtcggttacggtccggttggtaccggttacgggttccggtaccggggtacgggtaaccggggaacccgaacggtccggtaccggtaccggttcgtaacggtaccgacccggacccgtaacgggtccgttaccccggtcccgtaccggttaccctaacccgtccggtttccccgtacccccgttaccccgttcccgtcccgttcgttaacccggg

SEQ ID NO: 86092 - DNA, 637 bp, Homo sapiens
  misc_feature: GYAE6OF01DF4HW.22.30.C08.1.454.CMB.1.raw
  modified_base (185)..(185): a, c, t, g, unknown or other
  misc_feature (185)..(185): n is a, c, g, or t
tcagacatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggacncctcggtcaacctcacctgcgtttcttagtagtcaacacgattactacaccgtcgcgtggcatcaacaacaggccggagaacggccctcgctactaatgaagattggccatttggcacgccaccgacgaagggggtcggactcccgtgactcgcttcgtcgggctccgagctcgtcggggccgagcgcctacctcaccctatcctacccagtccctccgaagtcctagagtagtcgacggtctagacttaatttacgtacgtacagtacagtcgggacgcgtcggcgttcgtgggcttgggttcgggacgggtacgggaccaaggcgtaccggtacccgtacggtacggtcgaccggacccgtaagggcccttacccgggtccccccgttgggtacccctacgttcccgttcccggtttcccccgcccctttccccgcgtacccgggtaccg
